United States Patent 10,233,495 (METHODS AND COMPOSITIONS FOR SCREENING AND TREATING DEVELOPMENTAL DISORDERS) - sequence listing, part 201

SEQ ID NO: 1484 - DNA, 207746 bp, Homo sapiens
ttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggtaaggaggccgccgccgccgctccccggcctctcgtgcttcccggccgtctcgctgcccgagcggcgtcctgcgttctcggggcttcgagcaccttgctcgccgggtgcagccacctgccgccgcccgcctgtgggtcaagttacgtaaagccgggcggcagttccctggcctccgccctcgagttgtttatattttgggggaaaggagagggtcatgagtgcgggatgaaaaggtctatattttccgagcggagcggacttgccgtgggctccgtgggtctggcgttcaagtcccggcgaggggccgttctctacccctggccccgcacggtccggctttagccgcgcggggcgaggaggcgagacgacgccttcctgggctgggtcccatccctgtcctttgcccccctgggtttatgacgaaggccccagaaatcccccgcgtgttgcatgctgcctcgcacgtgaaggcagggcgctgtgaccggggacgcccgcttccttgcttccccagcctcaattcctggcttcacccgtggtgctttctgctctcccccttccggccctaggacccggacgccggctctctctcgcctgggttcggcggataacaaaaaggaaactcaagtgcaaagtaactcaaacagttgcttgtgtggttgcagttaacagcctgacctaggaatgtgtaacattttcaagactttaggatatgtgggtcagagtgaattgccgaattttaaagaaaaaccagggcgtgcggtgcaacgtctcagacctgcaaaagaccgggctgaacagggccctacgctgcctaggtggtgaaggaccgagctttccttgtgtccgtttagtgtggtattctgccttagtgagagcctcatttttagtgtttccatctgtttttgcattatgcgcttgtttattttaaacacccgctagaaattagactcctttgtgaaatgaatttcccaggccaaagtgagggttaattttgtgtgtgaagtgtgtgtgtttaaatatatatttaaagtaatttattcttgtctgtgcacacacttccagtcttcttctaaaatacttaccttgactcttctcgtttatgagataatgtaaacaggtagtttagtttgattttaaagaatgttactaccgtggggacctagtatcatgatggagagtgagtggactacaaaagctagggatatagtgatagctgctcagcctgtttgattagtacaagaaacttgcagtctgtttatgctgcttcttagttgcaaagtgaaaataaaatttgtctcccatgtacctcagaaggaagccttaagaatacttgaggtgaactttgatctgtagtggagtcttgcttccacattcagggtggaggtttgtctagagtgtgattaatcaacttatttatttgtttaaaatttacatgcagtaaaattcactcttgtgatacagttctgtcttgacaaatgctaagaggcatgtatgcaccaccacaataatggcacataaaaggttcatcaagcctcccgaattctctcagctgctcctttgcagttgatctcaccccgccaccacgcccggctaatttttagtagagagggggttttgcaatgttggccaggctggtctcaaactcctgacctcaagtaatccgcctgcctctgcctcccaaagtgctgggattacaggcgtgagccactgcgcccgcctgactgtaagtatttatctgtttgctggttgaagaatatttcagtttttggaggttataaataaagccgtcataaacattcacgtacgggtgtttgtgtgaacataattgttatttctcttggataaatacctaagagtggttttaaattgggttgtacgttttttttttttttttgagatttatttcatataccataaatttcactcttttaaaatgtacaattcagtgttttttagtatagtcacaaaattgtacaaccatcaccactctctcattccggaatatttcagcaccccaaaattaaatcgtatgtccattaggagtgactcccaatttcctcccttctcactactccacctctggcaaccactaatctttctgtctttatggatttggtaattctggacatttcatttaaatggaattatatgatatgtggccttttgtttctggcttctttaacctaatgtattttcaaggttcctccatgttgaaggatgtatgactatttcatttgctcttagggttgaataatattccattatattcatagaccacaatttatttatctatactcaccagttgctggatgtttagattattcctaaacatccaccttttggatattatgaataatgccactgaacattcatgtacaagtttttttgtggatgtatgttttaaattctcttggatatatacctagaagtggaattgctgggtcatatgctgactttgtgtaaccttttgaggaacagccaaactctttttccagagtgtttgttttcttatggttgagttttgagagttctttaaatattaaggatacaatttcttcatcagatatgtaatttgaaaatactttctcagtcttttcccattttgtcttttgcagagcatacatttttgattttgggaaaagcccagtttataaaacatttcttttatgaatcatggcttttggtattcatatctaagaaatcttttcccaacccaaagtcaaagatgttctcctgtgttttcttaaggaagttttgtagttttaggttttggatttctttttgtataaggtgtgtgatatgtgttgaaggttgaggttcatttgtttgcatgtggatgcaaatatccaattgtttagcaccacttgctaagaaagaggatcctttctctattgaattatctttgcatttcgtaaaaaaaaaatcagtagacttaatattgtgtggctttagtctgtctcaatctgtgtgtctatcatttcaccaatactacactgtcttgataactgtgtctttgtagttagtctagaaatcaggtaatgtgatccctctaactttagtctttaacaaataatttaaaaaataacaagtcattgtccaggtgtggtgctcattcctgtaatcccagcactttggaaggctgaggcgggaagattgcttgagcataggagtttgagattacagtgagctctgatcatgccactgcattccaacctaggcaacagacagcgagactctgtctcaaaataaaataaaataacatgtcagtgttttatttatagaaattggttatgttttgataaatgaaactttaaataatagctggagtatttttttaaaatattctttgagaatttcaaaagtagtaatttgataaatttggaggattttttaaaaacattgtttgaaaatttctgtaatagaaactaggtggccaggcatagtggctcatgcctgtaatcccagcactttgggagactggggagggtggatcacttcagaccagcctggccaatgtggtgaaacctcatctctacgaaaaaaataagatacaaaaattagctgggtactgtggcgctcgcctgtaatcccagctactcaggagactgaggcaggagaatcacttgaagctgggaggcataggttgcagtgagctgagatcacaccattgccctctagcctggccaacagagcgagaccctgcctcaaaaaaaaaaaaaaaaaaaaagaaactggatgctgcataggaaaattttaagataatattttatggtctaacgtgaaggacctattggtagttgtaaatgtgtgcttttgctaggcttctgaaataatccagcaaatttcaatattagcatgttactataatagtatcaattagtattcagtcattgctaataatggatggtgctctgaaaatttgttgctgagatggattctttggaaatcagaatgcatttttcccatggaagcattcttatatatgaatgaggacttttccaaaaacctgtttaactataatgcagcagaagagtgctactgtactgggttcaatacagtaagtagactcactgctagaagactctgtcttacaggggatgaaaaaggaattgagcttcattccaggactgactcttggcaaattttgatgttggtaaggtatactttttatacacttctatttataattctcccttcccatatatcatctagttagagaggtggtaatatttcatagactcatctgaaatttatcttcccaactttctccagcaattttctttttctttttcttttctttttgagacggagtctcgttctgtcacccgggtgggagtgcagtgacgcgatctcggctcactgcaacctctgtctcacggcctcaagtgagtctcctgcctcagcctcccgagtagctgggattaaaggtgcccaccatcatgcatggctaatttttgtatttttagtagggacggcatttcaccacgtcaaccaggctggtctcgaacgcctgacctcaagtgatccacctgccttggcctcccaaagtgctgggattacaggtgtgagccactgcgtccggccatttcacatattttctttaagagctaggctgcatcagaatcagccataggtgcttattatgaatacagaacctgcccccagagattataaattatttatctggagtaggacatgaaaatatttttttaaacaaatgacactggggacttgatgcacagttgggtacattttaagagaacattaaggggaaaagtattagaattttaaatagacaaaagcagtagtaaaagtggcttgtgtgatagaattatcatttgtaacacaggaagtacctgtacttcatagccccttcttaagttagcctcctttgtctctattttgttttctccgaaatcacaatacttggacaaatttgtaatttttttttgataatgcctgacatctttatgtaacattagaagttcagatttcttgtctattaactaacatacgtattctgtttttgaaatgttaatctcccagttttccctttataatagaatcatgtgtttagtggccacttagctggataccgccatgataccagaagcagtacaaaagatgaagattcagttaggatacagttttcgatttttaaggagtcattcttctgtgcccagaatacactagggagccaaacaaatgattcttacagtctggtgttaatgaccaattctaattccttatgtattatttttatatttatgttctaagatactttaataaaactttaaagactatgaaacattttattataaaaagtgttaggagattttacagtgcctctccatatacccattatctagattctgtcattaatattatgtattaacagctttattgacgtataattaacatgcagtaaaatacacgttaaagtctacaatttgataagttttagcatatatgtgcatgcaggtaacaatcatcacatgataatgaacatatctgtcatacctagaagtttccttgtgcctttttgtaaaccgtatcttctaaccctccttgtcccttatacccttcttgtccccaggtttttgctgatttgctttctgttactgcatattagcttgagttttctagacttggataaatgggattgtacagtttgtattctttcagtctggcttatttcagcataattattttgagattcatccatgtggtagtacaatcaataatttattcctttttattgctgaccatagcaagtggtggtgaggatgtgcaaaaactggaactctgttaatatgtctcctggggatgtaaaatgttaaacaacttgggaaaacagtttggcaatttcttaaaaagttaaacatacatcaaccatgttatcaagccattgtgcttctacatgtttacccaagagaaatgaaagcatatgttcatacaaagatttgcacacagatgtgcatagcagctttatttttaatagccccaaatgggaaacagtccaagtatccaccaacaggtgaatggataaacaaactggcatatccatataatggaataccattaatatttaaccacacatgttttgtcacatacctgtccatctgtccatctctctatccatgcagcaattcatattattaaatgtatttcagaataagttgtagagatgagctcatttcctcctaaatacttcagcatgtgtatcattagagtgcaatatttgcttagtttttttccttttgaggtaaaatttatgtagaagaaaatatacaaatcttaagtgtacattgactgagttttgacaaatacatacacacatgtaactcaaacccagtcaagatatagaacatgaccatcaccccagaaagtctttttcctgacctttcctaatttattcctaccctcatcttcagaggcaacaaatactctaatttttttctttctgtcatacatacacatctattctgctttgctgagagtgttttcttttccttcaagaatgttggagccaggcatgatggctcatgcctgtaattttagcactttgggaagctgaggtggccagatcagttgaggccaggagttcgagcccagcctggccaacatggtgagaccctgtctctactaaaaatacaaaaattagctgggtgtggtggcgggcacctgtagtcccagctacttgggaggctgagacacgagaatcgcttgaacatgggaggcggaggttgcagtgagccgagatcgtgctactgcactccagcctaggtgacagagcaagactccgtctcaaaaaaacaaaaacaaaagaatgctggattttgtcaaatgtttttttctgcatctattactattatcacaggatttttttcttttttaatctgttggtgtgatacattacattaattgatctttgaatgttgaactagccttgcatacctagaataaatcccatttggtcatgacgtgtatgtttagcactcagtatctccaggggtttagttccaagacctgtgcagataccaaagtccacaacagggagggcatggaagctccccaccaccttactttgctctgtccatctctttatctgtatcctttgtaatatcctttatgataaactgttaaatataagtatttccctgagttttgtgagttatcccagcaaattatcaaaccaaataaaatcaggtgcgaaccctgatttatagctggtcaatcagaagcacagatcacagcctgcgacttgtgactgacatctgaagtgaggggcagtcttatggaactgagcccttaccatgtgggatatgacattatctctttttttttttttgagacagagtctcgctctgtcgccaggctggagtgcggtggcgcaattttggctcactgcaacctccgcctcccgggttcaagtgattctcctgcctcagcctcccgagtagctgggactacaggcgcctgtcaccacaccaggctactttttgtatttttagtagagacggagtttcaccatgttgaccaggatggtcttgatctcttgaccttgtgatccacctgccttggcctcccaaagtgctgggattacaggcgtgagctactgcgcccggctcgatatgacaccctttctaggtagatagtgtcattatttaattgaattatagttagtgtctgttggagaattgtttagggattgggggaaaaacttcacatatctggttatctaagggttctgtgtcgaatatgagagtagagagaaaaacctttattttcctttgacagtgtcttatcatatttatagctgttttctgttttgttatacttgtttcctttttaaacagtcttcccctcctcttttgccctctctggttttaattgatcatgtgatatgatttaatttttttctcctgtcttagcataccaattatgcttcttaaacaatttatttaagtggttgtattacagtttgtgctgttcacttaaaactagtccaagtccacgtccaaataacattataggtcaggtatagtggctcacgcctgtaattccagcattttgggggactgaggctggcggatcatttaaggttaagagtacgagacctgcctggtcaacatggtgaaaccccatctctactagaaatacaaaaaatttgctgagcatggtaatgtgcgcctgtagtctcagctactcaggaggctgaggtatgagaatctcttgaactgggaggcagtgagccgagattgtgccacttcactctagcctgggcgacagtgcgaaactctgtctcaaaaaacacaaaaacaaaaatcccactatactacttcatggaaaatggaggtagtatatgtaatactctatcttacaatacagtatacagattcctcccttctgcccattgtaacattgttgtcattaatttcacttacctataagctgtaataatccaatgcattgctgctattagtattttagacatttttctattaatttaagaataaggaagaaaagacttaatttaccttcatctcttaattctctaatgctcctgtgaatctgagtttttggtttaaatcattttccttctttctgaagaactcctttatttatttgttttttttaatttttgagatggagtcctgctgtgttgcccagcctggagtgcagtggcgcagtctctgcttactgcaacctctgcctcctgggttcaagcgattctcctgcctcagcctcctaagtagctgggactacagatgcatgccaccatgcccagctaatttttgtatttttagtagaaatggggtttcactatgttgaccagaatggtcttgatctcttgacctagtaatctgcccgcctcggcctcccaaagtgctgggattacaggtgtgacccaccacacccggcctatcttaaccattttaagtgtacacttcatgtcattaagtacacttacattgtgcaaccatcaccaccattcatctcctgacttcaccattattcatctcctgaattcttcatcttgcaaaactgaaccacttacccgttaagcaatgactacccattccaccgtcttcccagaccccagtaaccgttattctacttttgatgtctgtaaattcgaatacttgaagtataagtggaattatacagtatttgccatttgttattggtttcttttacttggcataatgtcctcaaggtgcatccgtgttgtaggaaatgtcagcatttcaataatttttcaagctaaatagtatcccattgtatgtatatactgcattttgtttctccattcatctgttgatgaatagttgggcagcttccaccttttggctgttgtgaataatggtgttatgaatgtggatatttttctttgaagttcagtctgtgctgtcagatttttgggttacatacccagaagcagaattactggatcatatagtaattccattatcaatttttttgaggaattatcatactactttctatagtgactgcaccattttacattcctaccaacagtgtacaaaggtcaccatttctccacatcctcaccaacatttattttctctttttttgatagtagttatcctaatggatatgaggtggtatcttgtagttttcatttacatttctctaattagtaatgttgaacatcttttcatgggcttattgaccatttgtatatcttaattggagaaacatctatttaagtcctttgtccatcttttaatcaggttgtttgttttttgagttgtaagagtttacatacaaacatacacacacacacacacacacacacacaatgttagctgcttatcagatatatgatttgcaaatatttcccattttgtgtgttaccttttcttcctttttttccctgctaacttttattttaggttcatggggtacatgtgtgggtttgttgtgtgggttaattgtgtgtcactggggtttgatgtataaattattttgtcacccaggtagagagcatagtacccgatagatagttttttgatcctcaccctccccacaccctccaccctcaagtaggccttggtgtttgttgtttccttctttgtgtccatgtgtactggatagagtttgaatacatgtccccaccaagtctcatatttaattgtaatccccattgttggaggtggggactggtgggaggcagttgggtcataggggtggatctttcatggcttggtgctgtccttgcaatagttcttgcaagatctggttaagtgtgtggcacctccctatgcactccccctcttgctcctgctgtgaccatgtgatgttctggctccgcttttgccttctgccatgattgaaagcttcctgcgtcctccccagcagctgggcagatagatgctggtgccatgcttcctgtacagcttgcagaaccatgagccaattaaacctcttttctttgtaaattacccaggctcaggtatttctttatagcaacacaacaatggactaacacagtactcaagttttaactccgtcttgtgagaatatgcagtatttggttttctttttctgtgataactcgcttaggataatgctctccagtggcatccatgttgctgcaaagggcatgattttgctccttttcatggctgtgtggtagtccatggtgaacatatactgcattttctttatccagtccactgttgacagacatctatgttgattccatgtctttgctattgtgaagtggtgctgtgatgcacatacgcatgcatgtgtccttatggtaggacagtttatggtcctttgggtatatacccagtaatgggattgctggttctaatggtagttcttaattctttggtagttcttagttcttaaatctccagactgcattccaaagtggctgaactaatttacattcccaccagcagtgtgtaagtgttcccttttctctgcagcctcaccagcatctgttatttttgactttttaataatagccattctgactggtgtaggatcgtatctcactaatcattaatcctctaatgattagtgatgttgagttttttttttccatgtttcttggccgcatgtgtcttttgagaggtgtctgctcatgtccattgcccattttttaaatggggttgttagttttctgcttgtttgtttaagttccttatcgattctggataattagatctttgttggatgtatagcttgcaaatgttttctcccattttgtagattgtctgtttactctgtggacagtttcatttgctgtgcaagagctctttagtttaattaggtcccacttgccttttttttttttttttttgtagttctggaattttcatcatgaaatctttgtcagggcttatgtccagcatggtattccctaagttttcttctagggtttttatagttttaggttttacatttaagtctttaatctatcttgagttgattgttgtatatggtgaaaggtaggatccagtttcagtcttctgcatgtggctggccgttatctccacaccatttattgaatagggagtccttttcccattgcttgtcagttttgttaaaatcagatggttgtaggtgtctggctttatttctgggctcttgacctgttccattggtctacatgtctgtttttgtatcagtgccatgttgttttggttattgtagccttttagtataggttgaagtcaggtagtgtgatgcctcaggctttattcttttggtttagggttgctttggctattcaggctacttttttgggccagtatgaattttaaaatagttttttctaattctgtgagaaataacattggcagtttgataggaatagcattgaagctgtagattgctttgggcagtatggacattttaacaattttgattcttcctgtctatgagcatggaatgtttttccatttgtttgtgttgtctctgatttctttgagcagtgttttgcaattctcattgtagagatcttttacctctctgattagctctattcctaggcattttattctttttgtggcgattgtgaatgggattgaattcttgatttggctctcagcttggatgttattggtatatagaaatactactgatttttgtacattgattttgtatcctgaaagttggttgaagttattagttctaggaacctttgggcagagactatggagttttctaggtatagaatcataccgtctgcaaacagggatgatttgacttcctctcttcctatttggatgtcttttatttctttctctttcctgattgctctggctaagacttccagaactatgttgaataggagtaagtgggtatccttgtgttgtcctggttctcaaggggaatacttccagattttgctcattcagtgtgatgttagctgtgggtttttcatagatggctcttattatttccaggtatattcctttgatgcttagtcttttgagggtttttaacatgaagggatgttgaattttatcaaaagtcctgaatctgaaaagatgatcatgtggtttttgtttttagttctgtttagtaatgaatcacacttattgatttgtgtatattgaaccaactttgcataccaggaataaagtctacttgatcatggtagatgtgctgctggatttggtttaccattttgttgaagatttttgcatttatgttaatcagggatataggcctgaagtttcctgtttttgttatgtctctgccaggttttgttatcagaatgatgctggcttcataaaataaaatgagttagggaggagtccctccttctcaattttttggaatagtttcaataggattggtaccagctcttctttatatgtccggtagaatttggttatgaatccatctggtccagggctttttctggttggtagactttttatacaatttcagaactcattattgctctgttgaggtattcagtttcttccaggttcaatcttgggaggttgtatgtttccaggaattcatccatttcttgtagattttctagttagtgtgcatagagatgttcataatagcctctaaggattttttgtatttctctgggtcggtggtaatgtcccctttgccatttctaattgtgtttatttggatctcctctctctctttttttttctttgttagtctggctggcaatctatcttatttattctttcaaggaaccatcttttgtattttttttgttcagttcaactctaattttggttatttcttttctgtggctagctttggggttgatttgctcatttttctagttcctctaggcatgatgttagttgttaactttatatctttctaacattttgatgtgggcatttagcactataaactttcctcttaagactacattagctatgtcccagagattctggtatattgtatctttgttttcattagtttcaaataattcctttcttttcttttctttttcttcttcttttttttttttttttgagacaggttcttgccctgttgccgaggctgaagtggagtggcatgaacacggctcactgcagcctccaccttccaggctcaagcagtcctcccacctctcagcctcctgagtagctgggactgcaggtgtgcactcctacacctggctaattttttttgtattttttgtaaagacaatgtttcaccatgttggccaggctggtcttgaactcctgggctcaagtgatccccccacctaagccttgcaaagtactgggattacaggcatgagccaccgtgcctggcccaaagaatttctggatttcagtgaaattaagatttcgttgtttacccaaaagtcattcaggagtggtttaatttccatggaattgtatggttttgagagatcttcttggtattgttacctatttttattgcactgtcatcttgagaacatggttggtatgattgtgggatttttaatttgttgagaattgctttatggttgagcatgtggttggttttagatacgtgccatgtgcatatgagaataacgtatattctgtttttgttgggtgaggtgttctgtagaactctgttaggtccatttggtgaagtgttgactttaggtctgtctaatactgtcagtgggtttttgaagtctcccactattattgtgtggttgtgcaagtctctgtaggtctctgagagcttcttttttgaatctaggtgctccagtgttgggtatatacgtatttaggatagttaagtcttcttgttgaattcaaccttttattgttttgtaatgcccttctttgtcctttttgattgttgttggtttcaagtctgttttgtctgaaataagttacccatgcctgcccttttttgttttacttgcttgatagatctttctccattcctttactttgagcctatgggtggcattgcatatgaaatgggtctcataaagacaacatacaattggttcttggttcttcatatgaattgccattctgtgcctttgaagtgggatgtttagcctgtttacattcaagatgaatattgttatgtgctgatttcatcctgttatcgtgttgttagctggttggtatgcagacttgattgtatagttgctttatagagttagtggtctctgtacttaagtgtgtttctgtggtagccggtaatggtctttcatttccatggttagtactcccttaaggacctcttaaaaggcaagtctggtggtaatgagttcccttagcatttacttgtctgaaaatattttatttctgattcacttatgaagtttagtttggttagatatgaaattcttggttggaatttcttttctttaaggatgctgaattaggcccccaatttcttctggcttgtaggatttctgctgaaaggtctggtgctagcctgatgggattccctttgtagtagacctaccccttctctctagctccctttattatttttttctttcacattgaccttggagaatctgatgattatgtgtcttggggatggtcatcttgtatagtatcttgcaggggttctatgaatttcctgaatttgcatgtcaacctctctagctaggatggggaaatttttgtggacagtatcctcaaatatgtttccaagttgcttgttttctctccctctctttcagggacaacagtgagttgtagatttgatctcttcacataatctcatgtttttgggagatttttttccattgaaaagttatttttcctttatttttgtctgagttgatactgaagaaccagtcttcaagttcttgagattccctcctcagcttaatctgttctgctgttaatacttccagtgatattgtgaagttcttgtagtgagttttttagctctgtcagatcagtttggttgtttcttaaaatgactatttcatttttcagctcttgactcattttactggagtccttaaattccgtggattgggtttcaactttctcccgaatttcggtatcttctgagttttatgcccatcatttcagtgtgattaagaaccatcactaggctgggtacagtggctcacacctgtaatcccagcactttgggaggctgaggcgggcggatcacttgaggtcaggtgttcaagaccagcctggccaacatggtgaaaccctgtctctaattaaaatatagaaattagctgggtgtggtggtgggcacctgtaatcctagttacccaggaagctgaggcaggagaatcacttgaacccggaaggtggaggttgcagtgagccgagatcatgccactgcactccagcctgggcgacagggcaaaactctctcttcaaaaaaataaatatataaaataagaaccattgctggggagctactgcagtcattttaaggtaagaagacactcaggcttatagagttgctagaattcttgccctgattctttctcatctttgtgggctgatgttcctttaatctctccagttgctatcctttgaatgaggctttttgcttttatattcttggatgccccaagggtttgaccttgatataagttgagtttagtcgactggcatagtttcttgatgatttctgggtaccaaggctcagctcagcactcctggcatgcatgctataaccctggggtgttaggactaggcacatgactttgttctctgtctcctcgaggttaagcacccattgcactggtggggccaaggtgttcccggtctgctgggcaacaacactctgatggtggggccggcaaaagtgcttggttggggtggtgacagtagggtggtaaggcctgcatatacattggaaaagccgtcgggggaggctgtgggtgacggtgtcctggcaaaacagtgcggggaagctgtgcgtgggtggatgctggtggaggcccatgtgcaggtgctctctggtggttacctggggcttgccagcaaaggagctatagtggtggctgtcgggaagtgctgcggttgggcatcagcgtccattgcaattggatgtggccaggcagggactgtggaacaggcaaccagggatgggggttggggggggcgctcaaatctgacaagccctgtgccatgggcaagatagttctgttctgtctaggtccaatagtcagcaaagaccaaagctacctagaggtgtgtggtgagctttgggagatggacatacctggccatgctccactgcagccattcccacaccaggccttctgggctccgtgcagactggagtcctgtttctgccaacttcccaagcagctgtctttgcaacctcaaatgtctgtaggggtcatggagcctccttcagctaggattctagaggtccatgacaagaacaggctactccatgcctgtttaactcatcctttccccaggagcatttggggtcagaatgagtcatggtgctaggggagctccctgtaaggttcccagctttctcctccttcagcccaggatccgcatcctccttctgttcactctcagtgccttccttccaaagatctgctcagagtgtgctggtcttcttgatggcctggtctcttggtggtggaagctcttcctgactctgtgtctacttggccaccctgactcctctctgttgtctgttcactgtatatagtgtcatgtgaggaataaaagttttaacatttgacgaagtccaattcacctattttttttcttttgttgcctatgcttttggtgttatatccaagaaatcattgcaaaatgcagtgtcacagaactttctccctatgctttattctaagttttatagttttcagttttacatttagctcttggatccattttgagttaatttttgaatatggtataagcctgtcacacaggctggagtgcagtggcgcaatctcggctcactggaaactccgcttcccgggttcacgccattctgctgcctcagcctcccgagtagctggtactgcaggtgcccgccacaacacctggctaatttttttgtatttttagtagagaccgagtttcaccatgttagccaggatggtctccatctcctgacctcgtgatctgcctgcttcggcctcccaaagtgctgggattacaggcgtgagccaccttgcccaacctattgatctttttagaaaactaacagtcggtgtcccggtgcagtggctcacgcctgtaatcccagcgttctgggaggctgaggcgggtggatcacttgaggtcagcagttcgagaccagcttggccaacatgacaaaaccccgtctctactaaaaatacaaaaattagctgggcatggtggtgggcccctgtaatcccagctactcaggaggctgaggcaggagaatcacttgatcccaggaggcggaggttgcagtgagctgagatcgtgccactgcgctccagcctgggcgacacagcgagactccgtctcaaaaaagaaaaaaaaagaaaacgaatgctttatttttatttttattttttttccattctctttcacttatctttgctctgatctttattattttctcccttctgctaggtttgcattttgttttgtttttttccctatttccttaaggaataaatttaggtggtgatttgggatgtttcttctttttaaacataaacagttacagctttatgttccttctagcgctgcttttgctgtatcatactaattatgatggtacagtctttttattttcatctcgatattttctaatttttcttggggttacctttttgacccgtttcttatttaagagtgcttaattttcatatatttgttcattgttctgtttccatctgttatttccttatttattttatttatttattgttactagaaaagataccttgcataacgtcaatcttttataattttacaattttgtttttaattgacatgtattgtgcatatttattaggtacagggtgatgtttcaatacatgtatacattgtataaaaatcaaattggtatttagaatatccatcaccttatacattcatcatttccttgtggtgaggacattcaaaatctttcttctagctatgttaaaacatgcaatacagtattgttaaccatagtcactctgctgtgcaatagaacaccagaacttattcttcccatcttactgtaactttattctcattgaccaatctttacctatttcccctctcgccagtattccccagcctctggcaaccactattctatacactacttctatgagatgtcaacttttttagatttcacacgtgaaatcatgcagtatttgtctttctgtgcctggcttatttcccttagcattatgccttccaggtgcgtctgtgttgctgcaaaggacaagattatattgttttgttttgtttttttttttaaatggggaatagtatttcactgtgtatatatataccacattttctttagcagtgcatctgtttgtagacacttgatttcatatcttggcttttgtgaaaagtgctgcaataaacataaagtccaggtttctcttcaacaaactgatttcatttctttgggatatttatacattagtgggaatgatggatcatatggtaattttatttttaaattttttgaagaacttccatagtgtgttttataatggctgtactaatttatactcccaaaaacagtgtgtaagagtttccctttctccacagtcacaccagcatttatttttttgtctttttgatgatagccagtctaataggttgaggtaatatcttcttgtggttttgatttttatttatctgatgatgggtgatgctgagccttttctcatatatatacctgttgaccatttgtatgttttcttttctctttacaaaaattttgacacttgttttatgacctcacatatatcctggagaatgtcccatgtgcacctgagaaaaatgtgtattctgctgttggtgggtggagtgttctgtatgtgtcttttggtccagttggtcaatagtattaagtcctatatttccttattaatcttctgtgtggttgttctgtccattactgaaagtggggtattgaagccttctactgctaatgtagtgctatctgtttctctcctcaattctgtcagtgtttgcttcatatgttttgctggtctcatgtttggtgcatacatgtttataattgttacatctttttagtgaagtgtcggttttatcattatataatgcccttctttgttttttgtaacagattttgacttaaagtttatatgtctaatattagtataggttgaatatgccttatctgaaatgcttggaatcagaagtgatatggattttggattttttttttcttcagattttagaatacgtacatatacataatgagatatcttggagatgagacccaagtctaacacaaaattcatttatgtttcaaatataccttgtacacatagcccaaagataattttatacaatattttaaataattttctgcatgaaacaaagcttgtgtaccttcaaccatcagaaaggaaaggcgtcactgtctcagctgcccatgtggacaatctgtggttgtttggcatcatcgttattcttgactgaatttatatgctgatcagcaataattttctcacatttattcacacgtaagttgttaacagtaagacatatgaggtaccattaattcagtgaaaatacagtgtgttcagggtgagtaagcagcacagtagcatcactgggaatatatgtatccactgttaaacagcagcagcaacaaacagtggcaggcaggctctcagtctccacctacaatgctgtgttttgattaaaaggtaactgtagaatgtactgtatttatttattttttttttcaagtgagaagaaacattagaagcagttgaggggcccggaattggatcctcaggggatgaggaggcattttgctagatggcttttaaaaatgtttcctccagaaccatctgcctcactaactcttttttgtctgagaagtctctgattttataaactgtcataatttattgttctgttatgaatgcctgctgctccagtcctttaataagcccatcacacattttcaccatgtaccatgtggtctataggtacctttttgcattggtaacatcatcatctttatcttcatcatccacttgtggtattatgtctgcactcagaaagtttccgattttggagttttggattagtgatgcccaggtatctttgctcttttggttatttttgcatgggcttacttttttttaaatctttttgcttttgacctatgagtgtccttagagccaaagtgagtttcttgtagaccacgtacttttattttttttgtctctctctctttctctctatttatttattttgagatggagtctcactctgttgcccaggctggagtgcagtggcgtgatgtcggctcactgcaacctccgcctcctgggttcaagcaattctcctgccttagtctcccaagtagctgggattacaggcatgcaccatcacgaccggctaattttgtacttttagtagagatgggatttcaccattttggtcaggctggtctcgaactgctgacttcaggtgatccacctgcctcagcctctcgaagtgccaggattacaggcgtgaaccaccgctcccggctgggatcctgtttattttaatccattctgccaatctgtctttttgtaggagagttaagccatttatatttgaagtagttacagatagggaaggacttaatattgccattttgctaattactttctatgtgtcttacagcatttcttctttctgttttaccccttagtgcctttcctttggtttagttaattttttatagcaactttgattcattttgtgtttaattaactaataacataattaatattaacatcaagatagcaatgaggtctcgctgtgttgcccaggctggacttctaggcttgtgtgatcctcccacctcagcctcctcaagtagctgggactacgggtgcctgccaccatgcctggatgacttttgtgtatgttctaaaggtattttctttgtggttacgatggggttacatgtaacatcctaatgttatagcagtgtattttaaactttcattaatcccattacctgtatgttacagcttttgcaattgtcctatagttcttagacattctgttctattatttttctcattttctttttttattggctttgaattgggaagtttttatttacgtatcttggggcttactgattttgcattaaataattttttctcaatggtttattgcaagtatatttaaatgtagtttactttttgcatgttgatcttgtatcatgctactttgttagactcatttgtataattctgattaaaatgtttgtatatattaacattgagctacaattgcagaggtcaaaagatacaattagtgaagatttggtcaagcatactctgttagactatgtagaagaatgaaggtgagataataagattataggcagattatattatctgttatgcacattatttatatatttttcctgattatgacaggaatgaagcatacatattaactttttaaaatgaaaaatatttgattgtttgaatcttttttttaatcttttttaggagctgtggccctcaagaatcttcaaattaaagaaaatgccctggtaggttttgactatgaaaaatttgtaaagttattgcatttaattatgtataattcttcctgattcagtttgtcaccttaaattatttaaatttgagaaagttttttgtaaataatttttgcaaaatgtaaattttgctaaatggagttttaatctccctgaaagcacaaatggacagtgtgattttttttctatttaaaaatacatattgttttaggctgggcatggtggctcatgcctgtaatcccagcactttgggaggtcaaggcaggtggattatttgaggtcagtagttcgagactagcctggccaacatggtgaaaccccatctctactaaaaatgcaaaaagcttcgccaggcatggtggtggacgccagtaatcccagctgccagggaggatgaggcaggagaatcgcttgaacccaggaggtggaggctgtagtaaatggagatcgtgctactgcactccagcctgggtgacagagtgagactctgtctcaaaacaaaacaaaacaaaaacaaacatacaaaaaatacagatgtttttatttcaaatttttaacttgttttctgattttttttttaagacaggctcatgctgtgtcaccccaggctgcagtgcagtggtgtgatcatagcttactgtaggcctcagctcctaggctcaagctgtcttcccctttcagcctcctgagcagctgaaaagtttttaatctgataaagactagttcatttttttaattgcttgtgcttttattgtcatattcaagaagtctttaccgaatctaatgtcgtgaagattttcccttatgttttcttctaagagttgtatagttttagctcttaggtttagatcttagatccattttgaggtaatttttgtatatggtataggataagggttcagtttcatgtttttgcgagtggatatctagttttcctagcaccatttatttaaaaggctattctttgaatggggagaacgttttgaaagtttattttttacaaaacgcgtattttgcaaaatagagttttaatctccctaaaagcataaaatgacattgtaattgccacttctttttcttaaaataatataaaattggtaatgatttgatatgagtagattttctggtcatttttactgtagacctttatccccaattattattaaaagagcagcttccctggattttatggatttgatagtaatattgcagttatatgtttatatatttaaataaatgttgatgataaggaaatgtgtaagtttattaaaaaatcccttgaaataatttttggaagtaaagagtattcatttatgttgttaaactctatatctactaatgttttgtgtatatataaattttttctgtagagtcaactggatgtaccatttaaagttaaagttggtcacataggtaagccatattcattattgggatatcctccttcctggacatgcagccagaataatttgcctaatatatctattatgtgatatttttcatgtttctgagcatcaattaaaaataatcatgtgtttttgtctcagtagagctttgttgtgcaacttaaaaatattgtccgatacatatatcccttgcctagtatttgatatcctaatacattacatatctctttaggtggtaaattgagttaattcaaaggattacctctaagggagagcttaactgtttcagtttcctaggtttctgtctagttaccactgctatattttgattaacattggatatattgtgtaaagaataggttctgcatcatccaggccctgtgactaggggccgatttgaaaactaatttctgctctgcaagtttttgtatggtttcagaaaatactgtgctttttcttgtttggtattatttttaccagtgtttactgtttatatcttaaatatattggttgagcagtaaatgattggaatttgaggttttaacatctttaataaaaacttatctgtcatgtttcttgtgttacagttttactggtttaaatattgtgcaagataatagtgtctttagttgggacttggagatatttttgttatatagatagttttgtggtaggatgtatacattgttattgaagctatactgttgtcacttggggaacaaagtattctgaaaggttacctagattacatgataaaggtcttcataattatgtgtacttatggttggtattagaccacataccatagaaaactttcatcatcatatgttactgacagtagaattctatcctccccactcctaccttttaaagactgtttactgtaagagggggagaatgtcacccatttttatctacctaacattttaattttttcatatttctgattatttacatgtgtacattttaaatacttacaagtttatatgtattgaaatacttgtaattatgctatttttacagttttatattttttcattagcgtataaaaaggatttctcataatctgagttgatttgatctcatttattctgtaccataataatccagtgaatgcatatttggatattgtagaataattttatttttccattggtacagaagtattacaatacatatttttatataacttttaaacttttaccaaaggtcattgaattttacagtgatgattgtcgtatttcagtgtatgtaaatttaacctcaattcaagaacagtcaaaaaatatatcaggagagtagatagactattttctttagaatctgcccgccttctcttttcttgcctaatcttgtttaaaaatgataaggtaatttttagtgataatataagatagtagaaagtacactgaactaaacccaagataattttgagagtcatttaaggtgttgtgtacctctgtcgtagcacctgtcttttaaaaatatcactgttttttcccccttctagtagacatcgagtttcttgagaagaagtgggtttaatttttaatgtatcctcaccacttagcacattacttggtatatatagtaggggcacaatttattgtatgaaagtaatacatgtttccaaatgaatgatacagtagtacaatcagttttataggaatgtatgtccccttgctattattgggtattgatctttcaaaatttccctcgtttagaatgcagaattatagatatatcaaatataaatacacatgtacatattataaaagaggttgtcttctgtggaaggtttttggaattacatctgtgtatttttttgaaatttgccaaattttctactaggagtctacattttataagggaaggaagaaaaggtttgtttgtttgtttggtttttgagacagcatcttgctctgttgcccaggctggagtacagtggtgcgatcttggctcattgcaacctatgccttcctggctcaagtaaccctcccacctcagtccccgagtagctgggactacaggtgtacgccgccatgcctggctaatttttgtagtttttgtagagacagggttttgccatgttgcccaggcttgtcttgaactcctggactcaagggatcctcctaccacagccacccaaaatgctggggttacagatgtgagccactgcgcctggtcaagtttggattttttaaaaaaacatttgtggtgaaaatggcacactgttaatatgtgtttattatttttacagttttgtaattgctctttgtccttttgttcatttactttttttgaagtattactgtatgtattttaagcagtctgttggtacatttataaataaattaaccgtgtcaaatttgttacagttttttcacaatcttattatttcattttggttatatttttggtctgtacagaaatttgaaatgatccccatgttctctggtttaaaaacttagaaagttattcctcttttagaaatcagatagtttagaggccgggcagggtagctgatacctgtaatcccggtactttgggaggcagaggcaagaggattgcttgaggccaggagtttgagaccagcctgggcaaaatagtgagactgtgactctacaaaaaatataaaaaagaaatcagatagttcatttttctctgaagtgatattatatgatgaaatctttttctcagtttgaagttttctacacatggagtttataaaatatcatgagatggatctaagtggatttaaaaaaatttcccaatcactaaccagttttagcaacatagtatatttaataatctattccttacacaattatggcagctgtataaatctagacactcataccatttaaacaattctaaaatattttaaaactctctattacgaaaatattctcaagatacaaaactagagtgagtagtataagaaaccccatacatagtgtttttgtagttcaagaacccttacgcttaaaaaaaaaattctttgctgtttgattttcttaggatgttttcattagtttgcataattttcaaatattacccagaatattttattattactttatgtgtagttttcatatatatagtttatatgtatgattattaccatatgtgtatatgtgaattactatacatacatacatacgtatgtaacacacatatacataatgaaaaatatacatacacacacttatttaaagtatacaatctacctttcattgcggggaggtaaaggtctcactctgtcacccaggctggagggcagtagcatgatcatggctcactgtagtcctgacctcctgggctcaagatcctcccacctcagcctcccaggtagctgggactacaggcacatactgtcacgcctggctaatttttttagtttttattcatagagacagggttttgccatgttgcctaggctggtcttgaactcctgggttcaagcgatccacctgccttagcttcccaaagtgctaggattccaggtgttagccactgcgcctggcctaatctaccatcttaaagcattaaaaaatataggtttagagtaagaactggggaaattcaaagttatgatattaaggattgttgattaagggaagaagaacattgttttgtttatggtacagagaactgtaaatagaaacttgtatatttcgaatataatctaggttttccaacagtactgatataaatacaataatttcaaatcattacaacaaacacttgttgtttgtagttgtaaaatagctttcaataaagtgattaaacgcttaaggacaaaggccactttattatctcttcaatgcctgacagaaaatagactaaccataaatgcaggttgaaggagtaatattttttgtcctttttttttttcccaaaaaaatgtaggtaatcttaaacttataattccatggaaaaacctttatactcaacctgttgaagccgtattggaagaaatttatttacttatagtgccttcttctagtaagttaaatttaaaaaaattataatttaagttattcttttttatggatggaaaaatatttatattcaaaatacttttggaatttttttgagattttaatatttaaatttgatatttgttaattcaaattaaattggtttttactctacatttttggcaactttgaattatttattatttatttattattatttttttttaagatggagtctcgcactgtcacctgggctggagtgcagtggcaccatctcagctcactgcaacctctgcctcctgggttcaagcgattctcctgcctcagcctcctgagtagctgggattataggcgcctgccaccacgcccagctagcttttgtatctttagtagagatggggtttcaccgtgttggccaggctggtttcgaactcctgacctcatgattcgcccagcttggcctcccaaagtgctgggattacaggcatgagccaccgcgcccggccaattaatgattatttgtaaggatttttttggaatgactatatttaaatttaaggtagttatgattcttcctttttaatcttcctataggaataaaatatgatcctttaaaagaagagaaacaactcatggaagcaaagcaacaggaactgaaaagaatagaagaagcaaaacaaaaagtagttgatcaaggtaaagaaaacagtaaataacaatgctaataagagaagtagaaaagacctaaatatttatcataattgaatattatttttctctggagatgctgagattatttcagaaatatgatagaatctcattgcatggggaattttaatgtggtttgtatgctttgttatgtgtacaggaattttaccttatggaaatttatcttaaggcaaataatatgtctagcttattattattattaggtttacatattttttatatatatatatatacacacacacacatatacatactaggtaaggtcagtttttaatgatagcaattaattttatcaagcatattttcttaattttctagcctttgcttttgtattccttttatatcaattcttcacccttttggagatacttagtttcttgacatatttctatttgcctctatctgtttatttaccctctggcttcacatattttccaattaaacttagacaatatgttccattactgcaacctctttttcattattggaagcggtgtcctgaagaaatctaattccttttcacctgttctctgatccttactgccagctactttttaaactctcacctagtgggttttttgccttggcatgtaaatacgctgttctttatcttgaaacatgaagtcattttcttaacctagtcatctgtttatgttcttctcctctgtcattcatttaatagttaaacatcttaaaattaaaaagtttactgacttcactgtctctgaaatgcattgattttcttttaataaaaaataataagcttcaataatgttttacttgttggcaaacattaatagagatttaacatgtaattcttggcaatatctcttgtaattctgttttttctctgtaacagttactttatattatgtgtagtcatttatccttacctccagtcctctttcctaagtctcttaggccttttctttttaaaaattatttttattttatcaagataatatatatacatagctttaaaagttaagcagtattatagtgtccggattaaaaaaaaaaaccaactgttcctggcccaggcccgcacctatattactaaatatggtgctcaaacctctgtgtcttgatttatttagatattatatatatatatatatatatatatatatatatatatataaaacgtgttatatgtaacataacatgcatattatctataacataacatattttataacatataattaatgacattacatattttaaactcatctcgtgtttcattggcatatatatgacatatataatatataacgtgtaatatatatattacacacacatccttttatgatgtactatgaagattgaccctattttttcatcttctctatatagttctgtcacatttttggttaaatcagaattcattgttaatagtatcatggctatatataaatgttttatttatatataaataaagtggctttaagtatgactgtttattttgtaggcttttagttaacctccctgttctcccatgtacaaaatttggatcctattagggccattttctctaaaataaacccttgtgttctcactagggtgggaaagggatgttgcttggatattgggctgggagagaaggggacctaacttaactgctccttatacagatttaaatcagttcttgtgttatcttcctctctctccactgtgttccatgtttgctattttttgtttggtggggtttccagttcctgtgtctttccagggttctgtgacttggatttttgttgttgttgttgtttgttttaaactcatcttgtgttttgtttcattaccctgcaagatataggcattgatatgcttttcatgtaaaatggatagttggttttattcaggattggtactttattgacagtaatatgcaaaaaaagagcaaagggatttaaggtgttggtaaaataacatatcatggaatctgagctgcataaggaagtcaggaggaagtagtgggtagagaaagaaagacaacatttaatcgaatgactaaatgaatttataaaagaaaagattttattaggtagtggtgagagtcaaagattaaaatatgatcctctgtctttaaagagcttgtattctgttgtctacttaattctataatctatttatatgtatatatattcatttaactctggtgtatttgaggtacatatgattagtatcttcagctttcctttatctaaggcctcctgggccagctgaatttgagagtaataggcaattagaggaaaagatagatttatatgtattatttctatataggagtagaaatatgaaaagaggaacagaattagaaataaagaatatagctttcattggcatttttaaggggagaaaaaggataataactatgattatcaaaggcatatttcaaaaaaattaggaacctcaattctttattcttctttattcttggtttttctttttttttgagacaaagtctcactttgtctcccaggatggaatgcagtggtgtgatctcggctcactgcagcctccacctctctggttcaaacgattctcctgcctcagcctcccaagtagctgggactacaggcatggaccaccatacctgcctaatttttatatttttaatagagacggggtttcgccatagtggccaggttggtctaaaactcctgacctcagatgatctgcccaccttggcctcccagagtgctgggattacaggtgtgagccaccttgcccctccaattcttgattctttctatttctttggaaagtaatggaacttgagatagttaatgctgttttctgaacatgaaatagttgatgaacttctttcatccttgttcaaaagaagaaagaagatcttatttcctattttgtatttactgggggaggaggatattcaactgttttacacatctatacacaggcaacttaatggtggtatcactaattttgagagagatttctgctttgctgctgttagtggattttctcatttaagtctattgtaattcttacccaataatcttcatttttaaatatatttttgtactcaggcataggttaacagaaattataaaatttaatgccagtaaattctacatggtctgctttagtctcatggcacaataaactagcttttgaaaaatgtttacttgcttttgaaagacttttggaaagcaagctattagtgttctatttacatatatatgtatatttcagcaaggcaacgtaagcatgttacttcagtatgtggatatttatagagtatatttttcattcaattttaaaaaaggaatatttgcaattgtagaacaacatctgccggaaaaacaggacacttttgcagaaaaattagttacacagatcataaaaaatcttcaggtgaaaatttccagtatccatattcgttatgaagatgatgtaagtattttaatatgtgatatttgtttttatatttatatgtaagttattttactatttaatgacacctactttttaatggccaatctgttaaatcccaaaaggttacagagctaaagatgatgtgatccttcttttctataattatagttgtaatttgcagtccttagtgttgagtgcttgattttacactttcccaaaatgttcagacattagatcatgaaggaaatgccttgggaattatgaatttagcagttatgtatttttaaaatactttaaagtatgctatatttacctcctggatggagtactggtctagcaattagtggagctagccttaaataattccttgatcctgaataggtcatttgttttctcttaaccagataattatttgctttataatcctattttgttagtcttttttaataattttttttgtaaactggaaaacatgcagtataatattcctgtgtaacacgaatacattaataattagtattctaatttgttttaggaaaaatataggaatgaaagtttttctggaaagtaataaaatgtttctgaatgtttgaaataagttacttcccaaaaagttatccctccctcccttcctccccccacctccctctctctctctctctctctctctttctctttctctctttctttctcttctcctcttctctcccctcccctccccttgcctccccttcccaagacaaggcctcacactgtcgccaggctggagtgcagttgcccgatcatgactcattgcaaccttgacattccttgctcaagtgatcctcccacctcacccccacccacccaccctgcagtagctgggactacagttgcaccccaccaggcctggctaattttcttaacatttttttttgtagaggcaggatctcactgtgttacccaggctggtctccagagctcaagcagtcctcctgccttggccttccagagtgctgggattacagatgggagccgctgcacattgacagttttttctataaagtggattttatccaactactaaaaatctgaataaattttactttctttcctctttagatcacaaatcgggacaaaccgctgtcatttggtatttcccttcaaaatctgagcatgcaggtattttgtttataaaagaatcttaaccatatttaatgtgcaatatagtctattaaactgctactatttgtatatgccagcatcagaaataggtgtctatgtagaacgggtgcacaaagggtcttcattggattggaatcgagggtatgtagattcacatttcaaaaaatggttgaaaatcaaattcagaaatatgaggtcctattattattggtaattatgatgttagatgcttttgcttactttaagaaatccatttccaagtttgtaatgagtaagtaccaaatacaagtaataaatgttcatatctgaaacttcgataagccttgaaaaacaaaaatcttcagtttttctcaatatcattattaatattgtagcatagtgttttcctgtttaatttttgaaattgaggaattttaaaaatataagaacatgtagagaattttgaaacatatgcttgcctccagaatggatggctgttaaattaagagcctattaaaatagcctatttgcttaaagtcttaaatatttttataggaataagctgttttggataaagtttgaatcccttttgttttctacttccacccacccgtccttccccagagataagtatcctaaattttaaaacttttatataatatatctattaaaaatgtaggattataaaagtttacgcgttttatatgactcttttatgagttcctttttgcactttccagtgttgttgacatttatctgtgttaccacatgtaacaaaattcattcagtttaactgctgtgtatttcattgcatgattttatttgttgtatctattgggttttgtgtaagatttctttttaattttattattatttttaaattgggcagcctcccaagccagagcaggctcagagagactccacagtttctttttaaaatgtggccccactgcaacgaaaaaagaaaaaatgccctccaaaaagttactcaaatactctcattaagttgaaaaataagaatggagaattagccattggattgggcaatgtgaagatctttggtaaccgtgataacagtagttactaatcatcacctttggaaacttgtctgccagcctagacctgttcagttagaaactctaggatttggttgcagcaatctgtgttttacaaagccctctaggtcagggttcctgggccacagaacaggaggtaaggcctgggagtgagcattaccgcctgagctctgtcagatcagaggtggcattcgattctcgtaggatcctagcgaaccttattgtgaactgcgcatctcagggatctaggttgtgcccctgatggaaaagttatctcctatgaaactggtcgttggtgccaaaaaggttggggaccactgctctaggtgatcctaatgcatgctaaactttgagagctactattctaattatccattcagttcgtctccacatagaaacgaaaaccatctttctgaaataaagatctgatcactttattcctctcagtggcttttcattgctcttagttttatccttaaacaacttataaaccctttttaaaccgaccccaggcaatatacctggttttactttttttctctgtctgttttgcattatattctcctgcatactgagctacttcagttgcctgaatgtgccatatatttgtgtacttttgggctctgcctgttgtgaatcatattccctgtcgaccttagaatcaataatttttagttacatgttatatattaggttatatataacatctctttatccatcacacccctgaattggatgctcctgccatgccctctcaatgaaatgagagggcattttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagttaaatgagttatgagttttagaagttaaatgagtatttaacttctgctgtggcacttacctgttggaagttgcctgtttctttgtttgcttttctgacccgcaatgagctccttccttgaaagcagacactttactgtggtcagttagtattttttgatggagtgatatgtctttaaaggcattttcatgaaagggacattggtctagggtatggtagataatgatttattactctgctgtttcaaatggaatgacctttttactgccattgttttttttccttttcagacaactgatcaatactgggttccatgtttacatgatgaaactgagaaactggttcgtaaggtaaataaatactgtgtttgtcaactcatggacttaagagaattttggaaagccaaatgataatatatagataaggatgtatgtgaattttgcttatttgtttaactctgtgatatggctcacttaattatttgagacttctgaaaatagtgtatgataaaaattcttcaaagaaaatgagacatctaataaattttattttcagttaatccgattggataacctgtttgcctattggaatgtgaagtctcagatgttttatcttagtgattatgataactccttggtaagtaaattttttctgtatgtatttgttggtatcatattttgcatgaggtttaattcattgtcatttatctaatatactgtagtcagtattttttcctaggcacaatctattagcagaatttacagatacaggtgaagatgtgtgtaactatacacaaacatgaatacatacccccatatctttttttttttttttttgagacaaggtcttgctctgttgcccaggctgaaatgcagtggcacgattatagctcactgcagcttctaactcttgggctcaagcaatcatccttcctgcctcagcctcttgagtagcgaggactataggcacacgccaccatgcccagctaatttttaaatttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagattagtttggtgagatgttgtttaactactttaatattttgccatagctaagttctaagtttgaattggtttttaaaattgcttttaaacatttttcttttgcagataataggattttttaggataaagacatattggcatgaatatggctaggcgtggtggctcacacctgtaatcccagcactttgggaggccgaggcgggtggatcacttgaggtcaagagttcaagaccagcatagccaacatgttaaaaccctgtctctactaaaaatacaaaaattagccaggcacggtggggcacgtctgtaatcccagccactcgggaggctgaggcaggagaatcgcatgagtccatgagacaggggttgcagtgagctgagattgcaccactgccctccagcctgggtgacagggggagactccatctcaaaaaaagacatattggcatgaatataaataaaagcaatttgtcttttaataggacgacttgaagaatggcattgtcaatgaaaatattgttccagaaggttatgattttggtaagtacattttataagataaaaaaagtagttaaagtaattggtataaattttaaattagcattgttgctatcactgtgctagttcctgttaaatttccttctatatagttaaatgtatttataatgtatatacaaaagcaaataatattatattttttagtaacgtattttattgttatgaagcttttgactatatttcaaaactataggggaaaatgtccaacaaaagatgttaataaattatgataaacctctaaggattattcagtaacaattagggtaatatttatgaagacatttcaaaatggcaagtaaaatttaataaggctagctagtacagcctttttcgaaatagtaagatcacgctgcatttaaaatttttttaatttatacttttctatgttttcctaattttccaaaatgagcatccattacttttacaatcggaaatgaattactaaaacagaaagaaaaaaatcagtgctgtttctcagtttcccaagtagctgggactatgggcacacactgccacacctggctaatctctttcgtattttagtagagacggggtttcaccatgttgcccaggctggtctccaactcctgagttcaggcaatctgcccgcctcggccttccaaaatgctaggattacaggcatgagccacctgggaacctgggaggtagaggttgcaatgagccaagatcacgccactgcactccagcctgggtgacagagtgagactccgtctctacaaaaacaaacaaaaaaaagtgctgttttttctatgataagggcacttaataaaagttggtgatggataacttaattattgaatttgcatgcctgatgtcattaaccatagaatatccttcctgaaagtatttcctttcttggctcagtgatacttttctgtctatattatacaccttcatgactactcaagtgattcttctttttgtgcccactcttaaaataattatttttattggtttgaatttagtttcattttcttgattctcttctcataggaaatattcagaacagatgagttatctgtcatatgtgtttatgattttcaaatccataatcgtaaattcgacttatttctcctttgccctgaagtcatttttgttgtatcagagttcagtgaggagagagaaagtactgagtaatttgaagaggacaaatttaatataaagaattaccaactataagaggagactggagtaacaagggactgtctcataaaaatgctaaagatatagacagaagaaacatcccctaccctagggctaagacggggtgcccaaaagagagggtccccctccttcaggactgagttgtagaccttgttggaggacatagcgtggcttattgaatggcaggaaattatctgtggtgctgtgccagcaaaacctgttggtacttcactctctggaactttctggaaattacttttagggagcctcatggaggggtgtctctctgaatgcactccagtacaaaactgccttagcaaggtgctgggggaagttgctggcatctggctgcatctagctgccatgtactgcataaggccggtgctgaagaactccgtgctggaggaaccagacactgcagaagctaccggttctgtaggagctgggtgtgggagaagccgtgttcttgcaggagtctattgaatgaacatactggaaccaggcagcataactctttcctcctgcagtgtctctccagtgtcctctactgataaagcttaacattacgccagctggaaaaagaaaaaaaaattttttttctctacattctctgccttcaaaggaaacatatttaaagatccccaaatcatttttcagagcaggctatgaaggagaagtttggagctcagaagtaaaaaattgataactggcatacctgttggagagcgaagggggaatgaagggtttctttttgtttgtgtttatatttaatcagggagatgacagcttgtttttaggctgagatgggaatgatccagtagaacatgacaaattgacgatgcaggagaaacgggggacagtttctggattgatgtaggtgaaagagaatggtgtctagtacgcaagtgaagagctttgctgcatataggagcatagttaatttatatgatagagtttagttgtgagagaagtccttatactgagtagatgagtagatatggtgataagagttgatgtaaattctcttctgagctcttcaattaaaaaatatgtatctgaggtatgttagggttctctagagggacagaactaataggacaggtgtatatttaaagatgagtttattaaggagtattgactcacatgatcacaaggtgagatcccttaaataggccatctgcaagctgaggagcaaggaagccagtctgagtcccaaagctgaagaatttggagtttgagaagaagaatttgaatgtttgagggcaggaagcatccagcacaggagaaagatgtaggctcagaggctaagccactctggtctttccatgttcatctgcctgcttttattctggccatgctggcagctgattagattgtgcccacccagattgagggtgggtctgcccttcccagtccactgactcaaatgttaatcttctttggcaacaccatcagacacacccaggaacagaagttgcatctttcaatacaattgagttgacagtcaatattaaccattacatgagatgttggaggtttttggagggaaaagagggtatgaaataggaatgctaggggagtgagagagtgaaatgacgagggcagtattctcaaagtatggttcaaactagcaacatcatttagaaatgcagatttctagggcctttcccagacctcctgaataagaacctctggaggtgaagctcagcatttgatgtttttgtatttaattttttatttgtataaaattgtggagtacaatccttacatggatatattgcatagtagtgaagtctaggctttcagtgtttccatcacctgaataatgtacattgtccccattaagtaatttcttatcatccacccctctcccatttctctacctttctgagtctccagtgactgtcattccatgctctatgtccatatatacacattatttagctcccacttacaagtgagaacatgcagtatttgttgttctgtttctgcattgtttcacttaagataatggcctccagttccatccatgttgctgcaaaaaatgtgattttcttctttttttggctgaaaagtattccatgatgttcatgtaccacattgtccggttacctgttgatggacactttggttgataccatatctttgctattgtgaatagtgctgtggtaaacatacaagcgctttttttttcttttttttttttggatagaatggtttcttttctttcgggtagatacccagtaatggaattgctggattgaatagtagttctgtttttagttctttgtgaagtatccatactgttttccacagaggttgtactgatttacattcccaccaacagtaatcccttttctccacatcctcaccaacatgtgtcattttttgtctttttaataaaaaagacattatagttttaattttcatttctcggatgatgagtgatgttgagcagtttttcatacacatgttggccatttgcatatcttcttttgaaaaatatttatgttctttgcccacttttttttttttttttttggagacagagtcttgctctgtctcccgggctggagtgcagtggcgcaatcttggctcactgtaagctccacctcacgggttcatgccattctcctgtctcagactcccgagtagctgggactacaggcacctgccaccatgcccagctaattttttgtactttaaatacagatggggtttcactgtgttagccaggatggtctcaatcttctgacctcatgatctgcctgcctcggcctcccaaagtgctgggattacaggcgtgagccactgcacccagccctttgcccactttttaatggagttgagttttttgttgttgctgtttgagtttcttgtaaactctggatattagtcccctgtatgattgatggatagtttgcagatattttctcccattctacagtttgatattttaataatctctccaggtgattctaatgaatactaaagtttgagaaccactcagatagactagggttcaataaggttctcatactttgagaacattgccttttttttttttttttggaaagggacatgtagtaagttaaatattttacattttgcaggccatatacagttcctgacacattcctctttgtttcttttaaacaactctaaaagtgtatgaatcatctttggctcactggctatacaaaaataggctgtagcatggatttggatgattcctggactgaaggactgttgtgtaattgctcagcagcattaaggatgcacttgagatttatgacactaaagtgagacccagcagtatgtttttacccccggccgtgttcagctccttaggggcactgtggagttaagttggttactccacactgacgaagtgagaagttaaggagtctatgcaaaggaatgattaaaataactgatggtggaacttcagtaaggtggggatggactgaggatgtgaagcagaggtgaagggcagagaaaggttggaggatcagtgaattgtaggtccagggtagcttctgtcaccagccactaaatttatttatttcttctgcttttttttttcaatgtaagaagaaatacagaagaaagaacaagatctttaagcatttatttatattcaaatgaacatattcttgaatgtttaatgtttaagaaattaaatgttagtccatatcaatgattaaaataaaaggaatatatcatctttatatacagattagcttataatttaatgatggatctttgtctagattctgctattactggtcttcctctgaattgttcttattctttttggcaccaaacacaaagagttgagaggaatttatcttagattatgggttcagccaagcaggtaatccagagcaaactttcactcttcatctctctccttttaccaattaaaaggaagaacacagatggatctagagaaattgatcagaaattcagaaattataattatataatggaaaccagtgttaatcctcttagcatttctaatgttcattcattctgtaaaactgtgtacttgtattaaaactatttttttgattttttttttcttaaaatgtttctgcttttaagtatcatattggtattttgagggggagttcaatttgcctttattgtatttatggaagacagtgaattttaagtaggaaaaagataaagaatcttctccacacatggttcatctgactgaaccatggcagtgtgaacatctgggaactgtagaaggggtataaaataaatggaaatcagtgttttcaacttcatcactttattgccttgagactttggaaatataactcagttttttttccatttttattatttttcagtatttcgtcccatatctgctaatgccaaacttgtgatgaatcgccgatctgattttgacttttctgcccccaaaataaacttggaaattgagttacataacatagcaattgaatttaataaaccacaggtgattttctttaatataattttcaattgtgaattattgtttgataaaagcaaaactaagattttaaatgtttcactaaaattcatgatgttatatggtagcatttccctaaaaagtcagtaatgtaacttttatcttcagcaattgaacaaaaaaatgtgatacatttaagagctttaattttccattctttagtatttcagtattatggagcttcttgaatcagttgatatgatggcacaaaatctgccatataggaagttcaaacctgatgtgcctcttcaccaccatgccagagaatggtaaatgccttgatttttttttttttttagattttaaaaatacaacataaaaataaatttctcgacttcaagaataatctttaagatataccatttttaaggtctgatacaaaccataattgatttatagctagaaatatatgtagctgctttagcttattgagttaatgaaactgatttaagggattcttgctaacacagtttacaactcgagatgctcgaataccatagttttcatttactatggacgggtcagtatatttagaattattacaaaaacaaatcctggtttgttttcttgcattgtctctccccaacccccacctcagcttccctatcagatacactgaaccaatattattaaacctgtattttaaaagctaaaaatgttacggagtctatgcaggataatcccattttaaaactcaaaagtcttgttattccagtttttaagctattccctagtttctagaagttacaattactctttcagttgactatttcagttattattcagatgactaaatgttatttgccaattaatgccttaacagttcttgtgtagaactatatttaacaaaatggagtgattttgcttattttcacttaagaaagaggaaagattaatattgaatggattattaatgcaaatggagttgggtaaaaaggaagtactcagataatatatcattttcctaatctttgtattatagttatgtatgttgttagagtagaagcaatgtcagtaatgtttcatactgttgatttgagggtgttaaatgtttttctttttttaactaggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggttagcatttaaaatgaaattgttgagtgttttatactacatagctccttattggtcttcagtgactgatactccctacctttcattccaatttttattgaccttttcatctcttttacttagacttttttgtgcttctgttcttaacttcagctgaataatacaagatttgttgaaattctccagtgagcttttgaaattcgagattattctcaatcggaaggaatttgggttcatgcaaatagtatgattatgtcatttttaacctcaaaagtctaaatagtgtttgctacattgattccaacttctctgtgttggtttcaaagccttttatgtgtcaccactacattttccctatgttacaatctgaccatgcactaatttaatgtttcctgtactctgtatatttaatgctcattcttttagccacgcctatgctcataaatgctacctgcctttatctctctacctactcaattctactcatccctgaagttctacttaagtcttagtgcttgcatgaatgtctctgaattttctgcttatacagagccctttttctcttaatttttgtggtatctctagtctctaccagtagttttacatttaattatctatcttgagatattatttttgtattaatcttgtcttttagcattatgacatatttcaagagggactcttttacaaattgatgaactatagcttagagagattaaggggagttagtctcttgaagttaatgtaaacattctgaatccagaatgaatttctaatttatagattagattgacttttacttttattttcaatgtgggagactttctgaagacctagggctgttaggaatgcctgggcttagagtctttgggggatgggttcaggttgtcttagtcttgaatcataacctgagtcctccaagtctggataggagaaccctgaataagttattctgaaataataatgggttgtagttacttctcttgggggaaacatagtttgatcatgaaattctcaaaagtaattatgggtatgtcaagatagctgtgatgaaagatttagctaatctcagcttatttcaatagctatgacaactatgaaaagtgttaagtattaaaaacaagttttaagtgtatctgggtctacttgaaatacaggcatacttcactttattgtgctttgcagacattgtgttttttacaaattgaaggtttgtggcaacactgtgtctagcaaatctgtcggcaccatttttccaatagcatttattcctgtctatgtgtcacattttggtaattcccacaatatttgaaactgtttcattattattatatctgttatgatgatctatgatcagtgatctttgctgttactgttgtaactgttttggggtgccacaaactgcatccatataagacagctgttaaattaagtttagactaaagctgcctccttacatattttaagtttggccaaaaggtttctttgtacgccataaactatagcttaaatggaagtataaacagactctagtctactcttgtgccaatcaccaagttttggccaatcacatgtggccagttgttcaaaccgtgttcaaataaggtgaacactaagctataaccaaaccagctgtttctgtacctcacttccattttctctatgtcagtttcctttttctgtccataaatcttccaccgtgtggctacaccagagtctctgagcctcttctggctctggaggctgcccaatttgcaaattgttcattgcttaattaaatcttttaaatgtacttcggctgaagtttttattctaacacagcaaacttaataaatgttgtgcgtgttctgactgttctgctgactggctgttttcctgactccctctgcttgggcctccttattccatgagataaaatattgaaattaggccgattaatagccctacaaaggcctctaagtgttcaaatataaggaagaatcatacgtctctcactttaaattgaaagttggaaataattaagcttagtgagaaaggcatgttgaaagcagagataggccaaaagctaggctgcttgtgcccaatggttagctgagtcctgaaggaaattgaaagtgctattccagggaacacatgaatgataagaaagtaaaacagcctgattactgatgtggagagtgttctagtggtctagatagatgaaatcagctacagcattcctctaagccttatccagtgcaaggccctaaacatattctcttcaatactataaagactgagagaggtgaggaagctgcagaagaaaagtttgaagatagcagagattggttcttgaagtttaagggaagaagctgtctctataacaaaagtataaggcaaagaagaaagtgctgatggagaagctgcagcaagtgatcctgaagatctagctaagatcattgatgaaggtggctatactaaacagattttcagtgtagatgtaacagccttttactgagagaggatgccatctgaactctcctagctagagtgaaaaagttaatatctggcctcaaagcttcaaaggacaggctgactctcttgctagatgctgacgtagctagtgatttcaggttgaagccagtgattctttgccattctgaaactcttagggcccttaagaatatgctaactctactctggctatgctctatacacggaacagcaaagcctggatgacaacatatctgtttacaacattttaaacccaagctcagacctactgctcagtaaaaaaagatttttttcaaaatattattgctaatagacaatgcacctagtcaccaaaagctctgatagagatatacaaagagatgaatgttgttttcatgcctgctaacaccacatctgttctgccacccatggattgaagagtaattttaactttcaagtcttattatttaagaagtacattttgtaagatgatagctgccttatgaagtaggcagctatcattcctctgatggatctgggcaaagtaaattgaaaaccctctggaaaggatttgccattctatatgccattaagaatatttgtgaatcatgggtggaggtcaaaatatgaacattgacaggtgtttggaagttgattccaaccctcatggaagaccttgagaggttcaagatttcagtggagaaagtcactgcagatgtggtggaaatacgaagagaactagaagtggagcctgaacatgtgactaaattgctacaatctcatgataaaactttaaccaatgaggagctgcttcttatagaagagcaaagaaagtggtttcttgagatgaaatatactcctggtgaagatgagaacattgttgaaatgacaattagaaatttacataaaattagttgataaagcagcactgctgtttgagaggattgacttcaattttgaaggaaattctgtaagtaaaatgctatcaaacagcgttgtacgctacagataaatcagttgtgaaaagaagagtcaattgatgtggcaaacttcagttaagagattgcaatagccaccccaaccttcagcaatcaccaccctgatgagtcagcagctatcaacatcgaggcaagatcctccatcagcaaaatattacaactcgttgatggctcagatgattgttagcattttttagcaatgaagtattttaaaattaaggtatttatgttgttttcttaagacaatgccattgcacccttaatagactataatgtagtaggaacataacttttatatgcactggaaaaccaaaacatttgtctgacacttgccatactgtggtgatctggaactgaatctgcagtatctctgaggtatgcctgtatcttaatgataacatacaggctgtacacataatatgaaggatttacgattatatatctttgtatagattttttttgagacagagtcttgctttgtcactcaggttggagtgcagtggcaccatgacccctcagacttaagctgtcctctcatctcagcctcttaagtagctcggactacaggcatgtgccaccatgcctagctaatttgtatatgttttgtagaggttttgcagtgttgcccaggctggtctggaactcctgagttcaagtgattcgcctgcctcagcctcccagagtgttggggttacaggcatgagccactgtgcttggccttgtaattatatttttagttgaaaatgtaactaatatgtttacccttatctgtagtttaaacccaaataaaatcattttaaacaatgcatgtacatattttaatatgtgtttataacttgaagagtttggaactctttatgcagaatatgtattatttcatttttcaaaaaattactctctaatttactaatttccatgctgatatatgttcaagcattgcttcccagaatttaacatatgtattatattgatgaatgttctgttgtttgcttcctattatatcttttctttagtgcagccatttgatagattatgtgcttaagttaattatgtaaagttatttttgtaaagttaacacatttttgtttatatttttcaggagttggaaaaaaccttggatgtctttaatataactatagctagacagacggcagaagttgaggtaattcttggcttttcaattagtaaaaataattctgaattccatatagatatgacagatgtgatattattaatcttatactgtaacatattgtttccaaaaagtggttcaatttgctttttagtattataagaaaattatttaatattttttggcacatccatttaaatcagacagatttctatgggaaaaaatctttctaaatatttgggcttttcaaatattcagttatgaaggtaaaagccaatttattttttttcaatcatcatttcttataagatggtggaaaaactatgtggtactcctaaattcttatgttcgactaatgttgcagtttctgtgttctgttattaatgtgtatattgtttacattcattttgctcaagaggataagttctcagaatgtcttgcttatatttgtttcagttgctaaataaaggataatgtgtcatttatttgaaaatttattcattttaggtaaagaaagctggatacaaaatttacaaagaaggagtaaaagatccagaggataataaagggtggtttagctggctatggtcttggtcagaacaaaatactaatgaacagcaaccagatgttcaacctgaaagtatgtccatttcattttacagcatagttaatcactgggtgtcaaaataaagttttgccattttttgcctaattaaagtaaatagacattgaaatatatttatttaattatatataaagttattacaaataaaactattaaaacattgaaaatgtgtattagtttaaaaataaaaaataatttaaaaatcatgctagtgcttacaaaaagagctttatgcccagagatttagtgaatgcatatagcacagtaataaataaataaaaattccaaagtgttctccattgtaaatttttattgaagttgtttcttggaaagatttttgatttttaactaacagcttaagagtatagctttggaggtttagagacttaggtatatgttttagatctatcacttattagcagtgtgtctctggcaagttatttaagtgcactaaacttcagttttatcatctataacatgggaggaaattacaatgttaatactacctactttttatactaaatgtgttgattagcacagtgctattgtctaatatagttagccgtttttgagctcttgcttaatacaaatattataaattaatgttgctaaacttacatatttagcaatttatattttggataattacttgtaaaattgccagccccattcaaacattcagtgtttataatttcttaagagcgttcaagaaagtaaatttcacattctgtttattaaaggcagatacattgtgttaattttattgtttttatttaagaacataaagcacttctttctgatttgtagctcttgaagaaatgttgacacctgaagaaaaagctttactctatgaagcaattggctatagtgaaacagcagttgatccaactttactaaaaacagtaagatgttttcttgccttataccttagaatatatttatttatttatttgtttagagacagggtctcactctgttgcccaggctggactgcagtggtgtgatctctgctgccagccttaacctggcctcaagcaatcctcccacctcagcctctcgaatagctggagccacaggcatgcaccctcatgctagctaatttttgtggttttttttttgttttttttttttgatagagatggggtttcgccatgttgctcaggctggttttgaacttctgagctcaagcaatccgcctgcctcgacttcccaaagtgctgggattataggcatgaaccactgctcctgaccttatgctttggaatttaatgttacatatgtccatttttaatcctttcaaaaatatatgttactgacttgttctgtgatcttttttctgggtctgtaattgcatttattttaatttctaaggtagggataaatattgtctctttttttggggtcaatgtgatgattcttgaagaaataaaatgtccttaaaatatttggtggtttttgaaatgaatgtactataagaatatttgttatgcttatatatatatatatgttttcattttattcttctgaatataccttagtttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaagtaagtattaatttatctttttttatcatatatgaaaaaacttcactgtgttcttagacattaggtcacaatcttagtcttttgtaaagagcactatagtttcatatatccttttgtggtttcaggaaaaaggttttttttttaattgttaagataatacatgttcaatagaaaaccacattccagtgaaacatagggcattaaagaataatacaaaaatgatcagcaactacactacacaaaaagaaacagcattaacaatgtggtttttatctgagagtttttagttttattttttttaaagtagctttgagatgtaattcacataccctacaattcatttaaagtgtgtggttcattgatttttcacaactatattatatagtaatttcacattggtatatttacgaagctgtacaaccaccagcactgtattagtccattttcatgctgttaatgaagacttacccaagactgggaagaaaaagaggtttaattggaccaacagctccacatggctggggaggcctcagaattgtcaggggaggcgaaaggcacctcttccctggtggcagcaagagaaaatgaggaagatacaaaagcggaaacccctgctaaaaaccatcagatctcatgagacttattcactaccatgagaacagtatggggaagccacccccatgattcaaattatctcccaccaggtccctcccacaacacgtgggaattatgggagtacaattcaagatgagatttgggtcgggacacagagccaaaccttatcaactactatctaattctagaactttattttattttatttattttttttgagacagggtttcactctgttgcccaggctggagtatggtggtagggtcttggctcactgcagtctctgcttcctgggctcaggctaacctccagcttcagcctcctgagtagccgtgactacaggcgcgagccaccaacaccttgctaatttttagaatttttgtagagatggggtttcaccatgttgcccaggctggtctggagcttgttggctcaaagcagttcgccagcctcagcctcccgaagtgctggaattacaggtgtgagcctggctcattcgagaatatgttaacaactcccaaagaaaccctgtaatcattagcagtcactcccaagtgcccccttacccagcccctggcaacaactaatttactttctatttgaaaggatttgtccattttggacagttcatatgaatgtagtcatacaatatctggtcttttctgtttggcatttttcacttagcatgatgttttcaaggttcatcctgttgtagcatgaattagtacattcctttttattgcctagtaatctctattatggacgcatcacgttttgtttatccatttaactgttgaggatatttaggttgttccttctttttggctcttctgagtattgcagctatgagtattcatgagtaatattttgtttggaggtgggttttaattttcttgggtagacacctggggtggaattgctgtctcatatgctaatactatttaaccttttgaggaactaccagactgtttcccaaagcagcctcaccattttacatttccatgaacagtatatgatgtttccaatttcttcatatcttcatcaacacttgttattatctgttcttttgattacagccattctagtgagtatgaaatggtatctcactgtggttttgatttgcattttcctgatggctaaggattttgagctttttttctttgtgcttattggccatttcacgtgcatatcttctttggagaaatgtctattagattttttttcctattttatgttgggttgtctttttattatcgatttgcaagagttctttatatattcttgatacaaatctcttattagataaacaattttcagttattttctctcactgtgttttctttttatttttcttaatggtgaagtcaaatttatattttttttgctacacatgcttttcattataactcagaaatctttgcctactccagtggtacaaatatatactcctatatattcttataagaattttatgctatttcctcttatatgtagggttagaatccattttgagttaatgttagtgtgtggtgtgaggtgggggattcagcttcattctttttcatgagattattcagttgtcctagcaccatttgttgaaaaaactattttttcccattgaatgatcttggcaggcttgtcaaaatttataagttgatcataaatgtaaggatttctagactcttaattctaatcccattgttctatatgtctagccttatgccagtaccctactgtcttaattatggtggctttatagtagaacttgtaatcaggaagtatgactcttccagttttgtttttttgttttagctgtcctgatttccttaaacttctgtataaattttaagattatgttgtccatttatgcaaaaaaataagctcagatttgataaagattgtgttgaattttgtggatcaattttgggtgtactgaacaaattattcagcacaaattattcagctacttatctaaacaatattaagtcttccaatccatgcacattggatatcttttcatttatttagatttttaaaatttgaacaacgttttacagttttcagatacagtacacctcttaggttaaatttatttgcaagtattttattgtttttgatgatataaatggaattgttttcttaatttcattttggattattatgtgtatagaaatacaattgagttttgtatactgcacttgtaccctgcaaccttgatgaacttgtttcattagttcaatgagtttttttagttgattccttaggattttttatatacatgatcatataatctgcaaatatagttttacttcttccattccgatgtggatgccctttcttttgttttcttgcctaattgccccggctagaacctccagtagtattttaaatagagattatgagagtgggcttctcttcttgtttctgttcttcgaaggaagtgttcatcctttcaccattatgatgttagatgtgagttaggtgtggtctgcatcattttacaatcccaccagcaatgtacgtggattcatattttttccatatcattcccaacacttgttattttgtttttttattttaaattatagccatccttatgggtgtttagtatcatattgtggttttgatttgaattcccttaatgactaatgatgttcagcatcttttcatgtggatattggccctttgtataagttcattgggtcttttttttaattgagttatttttcatttgttgttgaggtgtaagaattcttttgtattctggatactaaactgtcaccggtacatgatttgcaaatatttccttctattctttattttgtgatttcacttcattgatactgtcctttggtgtacggaagtttttaattttgaagctcacttcatccggtcttatattttgttgttcatgcttttgatgtcttatctcagaaggttcacctaagccaaggttgtgaacgtctactccagtattttcttctaagagttttatacttctgtcgcttacatatacgtttatgacctgtattgagttaatttttgtaaatggcataaggaattggtacagctcatttcatttgcatgtggatatcccggtgtcccctcacacttgttgaagacactattctttcctcaatgaacactcctggtaccattgttgaaaatcaattagccatagatgtatgtatggctttatttttggactctcaattctatctcatttttattctagactttcactgtgattatcattataccaatatcgtactgttttgattactgcagatttttagtaagttttgaaattgggaagtgtcttccctattttgttctgctctttcaagaatgttttagctgttcaagggttgcttacaagaccttatgaatttgaggattcacttttccatttctggaaagtgtctctttgaaatttgatagggattgcattcagtatgtagattgcttttggtagtattgccataataacaatattaagtcttctgtgaacatgggatatctttccatttaaataaatgctaaatagatgctttttctgtttttatgaagagtttcagaaggattgttattaatccttctttaaatattttgtagaattcactagtgaagccatttggtccttgtattagtctgttcttatgctcctaataaagagatacctgagactgggtaatttataaaggagagaggtttaattgactcatagttcggtatggctggggtggcctcacaatcatggcagaaagcaaatgaggagcaaagtcatatcttatatggaggcaggcaagagagagcttgtgcaggggagctccctttataaaaccatcagacctcatgagacttattcactatcatgagaacagcactggaaaaacctaccctcttgatccagttacctcccatcaggtctctcccacgacatgggggaattatgggagctacaattcaagatgagatttgggtggggacacagccaaaccatatcagctgaattcttctttgttgagagtttttggttactgatttactccttactagttataggttttactataagtaagtttaaaaggttatagtaagttttactatactaaagtttatagtaaagttttactgatagtttataggtttataagtaggatctgtaggttacagtaaagtttactataggtttttaaggttatagaaaagttttacttcctattagttatctgattttctatttcttctcgaggcagtttttgtaatttatatatttctaggaatttgttcatttatctattttgttggtactgttttttgcagtactcttttgtagtactttttattcctctatggtgtgtcataatgcctccactttgatttctagttatagatatttgcatctttagtgttttttttcttattttaggtaaaggtttgttaaatatgttaaccttttcaaagtggcaactttgattttttttcattctctctggtgtttttgttttctgtatttcatttgtctccactctgacatgtattattttattcatactgtgagctttgggtttaatttgctcttctctttttagttctttaaagtgtaaagtgaggttattgatttgataatctttcttttttaatgtaggcatttgcaaacaaaaatttccctgtgagaactgctttggatacatcctgtatgttttgtaatattgtgtttgattcgcatccatttcaacgtattttctgatttctcttgtggttttttttttaacctgttgcttgtttaagagtgtttaatttccacataattgtgaatttttcagtttttcttctattgagttctaatttgattccattgtggttggagaagatgcttggtgtattattaaacttgttgagatttgctttgtgacctaacatttggtctatcctggagaatgttccatgtgcttgcacttgagaagaatgtattttgctgttgttgggtagagtagtccatatttgtctgttacatgtagttggtttataatgttgtttaggttctctgttactttattgttcctctgcctaaatattcctcatttaatggaagtgggagattgaaatttctaagtgttattgtgagctatttctccctttaattctgtcaaggtgtgattcatatattttgaggactttggtgtataaatgtttataattgttgtatctttgatgaattgagccttttaatcaaactataatgaccttttcttcttgtcacagttttctattgaaagatatttaagttaattaattaattattaatttagatacagggtcttgctttgccacccaggcttgagtgcagtggtgtagttatagcctcactgcagccttgaactcctgggctcaagtgatcttcccaccacagcctcctgagtagctggaattaaaggtgtgagccaccatacctggctaaagattattttatatgttagtataaccacccagctctctcttggttatgagttgcatgcagtatattttttcatcctttcactttcaacccatatgtgtctttggatgtaaaatgagtctcttttaggcagtatgcctatggtccctgacttaggctaagtatattaaatacatttttgacttggaatattttcgatgggtttattgggaaataattagtcataagttgaggagcatctgtattgttgtatcatgtttttttcatccattctgccagtctctatctttcctttgatgagtttaatttcatttacatttaacatgtttactggtaggcaagaagttctgccattttgctatttgtttattgtatgtcttataccttctgtaccctcagttcctcagtactgtcttcttagtgtttgttaattttttgggggatatatttttatttcttcctcatttctttttccaaacatattttagtcattttgttgagggctactatatagggattacaattaacagtccaaatttaagacagtcaaatttgaattgacactaacttaactttaatagtgtataaaaactctactcttatgcagctccattcttcatctttacgttatcattttcacaaattactgctttacatacttgtgttcattagtctaggtttatatttgtttttatgtgtttgtctttaaatcatagaggaattaaaaagaggagttaaaaaccaaaaatgcaatattactggctttcttatttgcttatgtagttacaattacaacagttctttatttatttgtatggctgcaaattactatctaatatcctgtcattgcagtctttaggacttcctttaacctttcttgtagggcaggtctactaatgacagacagactcagtttttgttcatctggaaatgtgttcatttttccttcattttagaaggatagttttgtcatatatagatttcttggttgacattttttttcatttagtgctttaagtacatgatcttgctgccttttggactgcatggtttctgaggagaaattagctgttaatctattacatatcttgttatgtgatgagttgcttctctcttgctgctttcaagattttccttgttttagcttttgacagttggattataatatgttgctgtgtgagtctctgagtttatcctaattggaggtctttgagcttcttggatgtataaatttgtgttctttatcaaatttgagaagtttttggccattatttctcccagtatttttaatgtctttttctttttctcatgtccttcggagagtcccgtagtgcatatgttgttccacttgatggtctcccactttaggcactgttcattgttcttcattattctttatgctccacagactcaataatttcagttgtcctgtattcaagtttgatgattctttctttgggctgcttagatcctctgtgaaacctctctgcagatggttcccaaatcatgattgttcagcttatgatttttttgattttagaatggtgcgaaagtgatccatatttagtagaaatcttactttgagtatccatacaacctttgtttttcacttttcagtacagtactgaataaattacataagctatttaacattttattgtaaaataggccttgtgttagatgatttttcccaacgtagactaatataactattctgagtacatttagggtaggctaggctaggctatgatgcttggtaggctaggtgtgtcaaatgcattttaaacttatgacatattcaacttacaatgattttattgggacataaccccattataagtcaaggaacatctgtagtgaagttttcatattggctgttgtacttttcaccttcaaaatttctgtttggttctttttaataatttctgtcgatttatattctgtgctcaaatgttattttcctggttttctttagtctttgagtgtaagcttatttaacatgatggcttagtgaacataatgctagtcttcccttttctgtgtaagctttgtacatttttgtttaaaacttgatgttttgagtggtataatgtggtaactgtggaaattagatgtcccccctctccatggttagttgttgttgattgttgaaggatgtagttttccatttgtttacctactgtagtgggtagaattgtatcatccaaaacattgtcaatttctaattcccagtacctgcaaatatagccttatttggaaatagcctttgcagatgtaatcaagttaaaatgagttcatgctgtattagtgtttgctctaattgaatgatgtgtgctcttcaaaggaaagagaaatttgaacacagactcagaaaataagacagactagagaagacaatttgcagacagacataaagaggagaatgccatgtgacgatatcttcttagctgcgcccatattaatgtagattttctgtaacgtggtgtggggattagaggtgggaaatgatcatagctcagatgccacaggctctccctgttcttatcaagttttagtagatttttttgtttgttttgagatggaatgccactctgtcgccaggctggagtgcagtggcacaatctcagctcactccacctcctgagttccagagattctcctgcctcaggctcccgagtagctgggattacaggcatgtaccaccacacccagctaatttttgtatttttagtaaagacagagtttcaccatgttggccaggatggtctcgatctcttgacctcgtgatccgcctgcctcagcctcccaaagtgctgggattacaggcgtgagccaccgagcccagcctagatttttttgaataaaagtttttctgtttgctgtatgcccttagattgatttccagagattttataattttcaccagttctttccctgtttggtttgctggggagaagagttgctgagctcctcacatagtcattctcgaagtcctgcctcatccttggtttttaaatgtttattaaattgttttatttttttgagacagagtctcactctgtcacccaagctggagggcagtggcatgatctcggctcactgcaacctccacctccctggttcaagcgattttcctgcctcagcctcccgagtagctgggactacaggctcatgcccccacacctggctaacttttgtatttttagttgagacagggtttcaccacgttggccagtttggtctcgaactcttgacctcaagttatccacctgtcttgacctcccaaaatgctgggattacgggtgtgagccacatgtctggcctttaaatgtttatttttatttttagaagaaaacatgtttatagacttgtgttaaatatgcaaaacttttcagttttacattaagcattgtagatttactgtcattttaattttagcttatcataacttttttacatataagtcaacacaaataggattctttgtgaattaatctatgtcaatttagaggaatcattgtatgtcttctttgatgggaatggactggagtcagaaatgcaaagtgaagttgtcttcattaattttttaaatcattttcaatttttaaaatccttcacaattttactgatcgctgacttttttcttttttttttaatgcagatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcagtaagcatttttttaaattactaagttttaatataatttagtttgctttgagtttgtgttaatgatgtttattttaacagaggacagtgaatagtatagtggaattcttcagacctccaaaagaggtacatctagcacagctcactgcagcaactttgacaaaactggaagaatttcgcagtaagacagcaacaggtaaatgccaatattaatgttggtgaattaaatactgtatcctatattaaacttttatttatggtagaatgtttttagtaaagtttattttaaatttattatatttctagactggttttagtttaacagaaactaatttagtacttttatgtttaaaggcagataaaaccataatcattttttacactcagaaagttcatacctagtaaccacatttaagttagttgcaaaattttgcttaggatacttggacctctatttatgacaaaaactggcctctcgttttcctttcttagaatgcgttccagattttgatatatcagcctcagggaaaaaagttctatccttttttattctctaggagagtttgaataaggtcgggtacgatttcttccttaaatatttggcagagcttaatggtaaaaccacttggttttggagatttctttgtgggaaagtttaagattacagattgaactttttaattaaatagttgaccatagagattatctgtatgattttaatgctttgtaattggttgggacttgttttctagctcaatgtatgatattaaaaaaaatgttcctcatatgctgaaaaggctgtcttttcatatctatacctattcattaggtatggattgttaatcctttacttcaaattttttgtatccttactggattttttttttccccttttgtcaccttgttctaacagttattaagagaaatacatgaaaaatgcctcattatcaatgtagatttttctatttctaatagatctgtcagtttgtttaaaaaaataaatttggctgggcgcggtggctcacacctttgatcccagcactttgggaagccgaggcgggtggatcacctgaggtcagagtttgagaccagcctggccaacatggcaaaatcataatagagacggggttttaatagagaccaggtttcaccagcctggcgacagagcaacaccctgccacacacaccaaaagtaataataataaaaattaaaaaaaaaataaattttaagactgtcattaagtacatgcaggagtaaattatttttcctcctataaaccacatctttaatgctttaatttttttccctttgtacttttttattttattttatttttgatctgatgtcagtatgaagtacaaagtttcttttcgttagaatttacctggtatatattttttcttatatttttactttttccctgtgttttcagatgtgtcatgtcaacaacatgtaataggattttttccaatctagatttatggtccttattttttatttatatctactttttgcatttaattaatttatttaggcttatgtctaacatcctattttgtgcttttgaatttggttttccttgttttatttttcttgccttcctttggataaattctaggatacctttcttcccccttccctacaatctactattgggaagttaaatattctctatctctttttattttataaattacagtatacatttttgtaaaaatataaatttaatgaaaaattttatattctcctagtcattatatggactttagtactcttgaactttatataccatccccatatactattttttttacttaaaaatactttattgtactgtatgtatatagttcatggtagtttacaattacttgtgcatttactaccttctttgctcttcatttctcttatagcttacactttttatttgattttattttctttctgttggaagttcattttttttttttttcaacctctgcctcctgggttcaagcgattctcctgcctcagcctcccgagtagctgggattacaggcacccaccacaacgcctggctaatttttaaaaaaatttttaatagagatggggtttcactgtgttggccaggctggtctcaaactcctgacctcagatgatctatcctcctcgacctcccaaagtgctgggattacaggtgtgagccatcggacctggcctggaagttcatttgtaaacttcccttgtaaatattttctcttgtaagaatctgctggtggcaaatctgtggtttgtttttgttatgtttttgttttttttttttttttttgacagtgtcttgttctgtcagccaggctgggggtgcggtggcataatctcggctcgctgcaacctctgcctcccaggttcaagcaatttttttgcctcagccttctgagtagcttggattacaggggtatgccaccacacccagctaatttttgtatttttactagagatggggtttcaccatgttggccaggctggtctcgaacttctgtcctcaggtgatccatctcagcctcccaaagtgctgggattacaggcatgagccaccatgcccgttgcatattagcttgacatgatactactgtatgtagaattaaaggttgatgttcattttctccttaacacattgaagagggcattctgtctttaggttttcattactgatgttgagaattcaggtgtcagtgtgtctgctgtttttttttgtacattatctacccttttcttttacatataagaactttttatcttttgtattctgttgtcgcaatttggtgtatccagctatagatttgctttatatatcctttttgggattcactggatttcatgaatctgagtactgggatttttaatgagttctagaaaatctatctggaaaattcttagccactaactctttacatatattctcttctggaattctggctaaatgaattttagcctttcttactccatcttccattctccttaacttctgtatcctgctttctttccatctgtttcttctctgtgttacatgctgggtaatttcttctaatttatcttctcatttactgagtccttctgtagccatgcccaatgtggtatcaaatctcttcattaagtttaatttcagtgattatatttttccctttaggaattctgttttgttaaatttaaaatctgtgttgtcattcttttttggttttgtatttcccacggatatctttacacttgtcttttttttttttttcagagatcataagtacagtattttatattctgtctcaccagttaattctctctcttcagatagtccgttatatgaagacttttgtggttctgtttttcctatcttctgtcttttgtttttgttggtacttacttatggtaacgtgtgtctttttatgcttggtaatttttaattgtaatctgctcattttccttagaatattatttgggagaattctctgaagcctgagataagtgggccttcatttcgggaagatttatatttcttctgccaggtaccttgggtatgttggtggcatagctaaattaattgcttaagatgttctggactgccaaagaattcttgggctacatacctccttgaggaatatatcatacttatcattcacagaggtattacctttttctcctaatttttctcacagcctttgtttgcatccccctgtgagagtgttttagggagaggaaggttttacttcacaattattctttctttgagtgagtgtcctttaagatttcagatttgtgaggagaactcttgcaagactctccatctttgtcttctgtttcctgtgttctgagaggctgaaattatctttggagtaagatccaatttcattgtcaaagttttaaaattctggttttgttaagcctgggagtacacttctaattgaactcagaatttgtcccattttggtggctataaaacctggcatgaaattatgatttttctcttgccatttttattatattcactttatccttattggtagatatgagatatactatctgtcattttcctttgttctctttcctaagataaaataatttagatgagtcaagaaatcacattttgataagaccttcaggaaatgtctaactagttgtcttttgttaggcaatattataataggcatcttgattcattattaatttttcttttttcacagaaaagtgtgtgttatattcttcaaaatatatgtgtcttctctggcttttgctcatttttctctactatttttatatctgaatagttttaaattagattgtacatgaataccttacctctagaaactgtagggtttgcatttattcctgtattctttgttaaaatctgggaattccattcctagtttacattctgtatattggtatattatatactgagtagaaaccaaagcataagatcaggctacttctagtcagtttttcttgattgatagaaactcatagttaaatacaaattaatcatattggaaatccactatagacattcagattttgagattttttatctctaagatttatttacctcaacttttattacttaaaaaaattaccaaacagtaaatatccacaatataaagttcacatgttacagaaatatgttttagaaagtggaagtcttcagtattttaccttctgtacataataacctttaaaatttgaagtctgttcttccaactttgttttcttttctataccaatagtataaaaatgctaattctatgaaaaaaaatggaaagcttctatgataggtttttgcacttaatttttaaaatttaatatattttggattttttctagaaagttaaaatttacctatttgtgaagagactcatatatattataatgattctggttacttaggttctttccttccctcatattcctcctttcttccttttattttgttacattctcctctattaacatcctggtttctttcttgtattataggttgagtatcccttagcagaaatgtttgggatcagaaatgtttcagatttcagatttcttcggatattggaatatttgcattttacttacttgttgaacatccttaattgggaaataggaaattcagagtattctaagcagcattttctgtgaatatgatctttgaggatcatgttattgtggtgctgaaaaagttttagatcctggagcgttttgattttggattttcagattagggatgctcagcttgttattttccccttcctttctaagaactcaaggtctttcaggtctttttgttgtcaactatggcatgagcttacagagcctgctcaactagttatcctttgtctctggcaggaaaacagatgtggtcgtttgctaaaactcttctttcagagtacaaggttctctgataggatcatagtgaatcattttctttcagttatttcatttatttactcatttaaatatatatcaagagcctaatctatatgtcagacactatgctaggttttagggaacatagcaatgatcagaatggatgtagttcttgcctattgatagatgttatactcttatggataggacaaatataaaactaagagcaatatactggaaatttttgattaatgctgtatgggtccaatcaggaaagaaaaaccacacagtaattttgataggtatgtttaatgtaatgaattattaactgtaatgagggactgttttgttactccaaagagtaactttaaagaatgtaacaagaggccaagcgccatggctcatagttgtaatcccagaggttttggtggccgagcggggaggaacacttgaggtcaggagttggagaccagcctggacaacatagtgagaccttgtctctacaaaaaattacaaaattagtcaggtttggtgacgtgtacctatcgtcccagctacttggcaggctgagactggaggattgcttgagcccgggaggtcagggctgcagtgagctatgatagcaactcctacattccagcctaagtgacagagtgagatgctgtctccaaaaatacatatatttaagaagagtagttatgaggaatatagaactgagacagcgttccctaggaagaggtctctctcttccctgagaattgaaatccacactttgttgggagaaggaacctctgtgagtcattgaatggtagaaaagccattcttgtgtctttctggtaatctgctctctaaaactttctggaaatccatcctctgaggtaaaaaggaaaaatattcatggggcaatgtctcactgccctcgttctgctgtgaaaccacctgaggagggttctaggggcagaatactggcttttgagtgctgttatgtgcacattatgcattgtgttggagaaaggcacagtgttacaggatattgctaaatgagtgtactggaaccaggaagccagctcttttctcctgcagtgtctctcctgtgttctttatctatttcagtgctagttggcaaaggaaaatcatttaagcaactcagatctactttcacagagcagacaagtgggtgaatttggagctgagtgaggaaacaattctataatcagcccaaatgctgtgaaagaaatgagaatggatagatgccccaatttagtcttggtggtagtgtcagagaagatctctgaaaattcaacattaagatcagatatatatgtaggatccacactgctaaagggtataagaaagagccttcaaggtgatggtccactgtgaagagcttaacttagcaaacaattgggtgaatttggaagttgtagaaagctgaattggttctaatgtaatgagtgaggggagagtggagggatgttaaagatgcatactcttgattatgcaaatatgaaagtcatattaagcagttaggattttgttgtaagtgcaatggaaaataggggagagacccaatcaacctaaggtcaaaataaaatactccccactcccttccattaaaaacaacttagagaaatcattgtgtcctggtatcaagaaaggctttgttgaaactaaggcttgtggtaggacttccagggagtaccagaacttagatttgtagaagccagaatacttgaggaatccttagactagagatggaaatgaagatagagaaatgcttaacagatagtctctggagaatcttgaatgtcagattgacccttctggatgcttcttgttactttagtaaaatcatgccatctgtgtttgaatccaaatcatttggggaaaaagaatgaataactgtttgagtcaattctgctcttaagtttcaggctaattggatggtcttcagaatttttgatgatctgtcagtctgttttcaaacctctatctcacctcaccttccatcctcattttaagagatttcacttgaatttgcttcttacaggctatgggaaatgccagggttttttcttcctctctctactagagtcttgcttgggctacctgtgcaaggccgttggaatcccttaaagatgacacagttttgataacagtttctcatatttcaaggaagagctgtcccagatgtaatttattagtgttatttttataaagactactggaggcagcgtaatttgtgaagaaaagaggtttatttgtttcatggttctacaggctgtacaagaagcatgactccagcatctgcttttggtgagggtttcagaatgcttccactcatggcagaaagagttggggagcccacatgtgcagagattacatggcaagagaaaggaaggaggtgccaggctcttttaaacaacaagctctaactaaaagagcgagaactcactcattaccatgaggacaacatcaagccatttgtgaggactctgcccccatgacccagacaggtcttattagggtcccacctccagcattaaaaatcaggtgtcagcatgagttttggagggctaaaatcccaaactgtagcacaggcttaggttatttattttctattttaatttaaatagatatttaaaacagaaggtattttaattacttttaatttattcattttctttctgttggcttgtatatcaagctgattatgtgttggcacttgacacttgctcaatgtctgcttttaagctttataattgtatatgtattttatttgtaattttaagtacattaaaattgttgacatattctttaatttgaacatgtattctttaataataaattcttaactttaaaggttatattcaaatatactgacctgcctacattttgtgtgtgtgtgtgtgtgtgaaaaaatgtgcctttttgtttgagtgtcagatctttttaaactttttaagtcaaatatctttcatttactctaactgatttgatggctgctcatataattttttctttaagaaagggttcacatctcatagaaaataatttgtttagatttaaaagctgatgctgatactggacttagggacataaaatagatgaatttggtatactaatcacatgcaagtgaatgaattaaatttattagactaaaaaactccaagtgaatgaaggacctagggaatggaaaactctggtttgttgccttttctggtttgcatatgattttattgaagatgatttgataatccaggattttttatattctcagaataatattaagatcaagtgttattgttcagtatggtaaatgtagcttatgaagtttatgaattgagaagtatctatgtagattctaagagttgttgtgagtaaatattttatgccactgaaactttttttttggtctgtatcttcccaattttacccaaattgagtttataggttaaaaattttttttggaagaatcactccaattttgtactcagctatatttaaataggagtacatgcattggcaggtattttaaattttatattggaagtattttgctgaggtcattttaaaattaatactaattttacattaagattgttttatcagttcatatatttagtgattctgtatttctcgagtaatttgtgaaaagtattcatagaaaagatttacatttttccaggtctactgtatattattgaaacacagaaagttcttgatctcaaaattaatttgaaggcttcatatattattgtcccacaagatggaatttttagtcctacatcaaatctgcttcttttggaccttggtcatctaaaggtatatactaataatatttgatttatgatacagcatttggggtgtttctttgttttaaatgtattttgttttttaaacagtttgatttattgctttttttcctagatttgtggtagataagtaagatttgagaaatctccctttctgttaaataaagtgaagtctcaattaggtagttttcctacacttatgaaagcaaaatgaccaattaaactctgcagggcaggtttgaatctaagcttgattgactgattgattgattgattgattgactgattgatttgagacagagtctcactctgtcgcccaggctggaatacagtactgcgaccttggctcactgcaacctctgcctcctaggttcaagtgattctcaggcctcagcctcctgagtatctgggattacatgtgcccgccaccacgcccacctaatttttgtatttttagtagagacggaatttcactatgttgcagactggtctcgaatgcctgtactgaagtgatccacttgcattggcttccctaagtgctgggattactggcgtgagccaccgcgcctggcccgaatctaagatttatatttgtagtatttgagagttgtgcttgagaagcttatttctttctcaatttagacctattacttgattacttaaagtatatagaatgatagagaattgtggaaacaatcaaatacgtcttcatctttctgaaattttttgtgcataaaactatatatatattgacattttaatatttgtatttaataattctaaattgagaaatggccttcttctgtttacctaagtcatttccctttttttctttcttttttttttttgagacagagtctggctctgtggcccaggctggagtgcagtggcacgatctcggctcactgcaagctccgcctcctgggttcatgccattctcctgccccagcctcccgagtagctgggactccaggcccccgccaccacgcccggctaattttttttgtgatttttagtagagactgggtttcaccatgttagccaggatggtctcgatctcctgacctagtgatctgcccacctcggcctcccaaagtgctgggattacaggcgtgagccaccatgcctgaccctttttttctaattatatacttttttctttccaaattttcagtagagaatacatttttttggcggtattctagatctgtgctcttcactatagtacccacttcccagccacatggggttatttaaattaattagaattaaaattaattcagtttcttagtcatattagccacatttaagagtttaatagtcagaagtggctagtggctactgtattttttgtttttgtttttgagacatagtctcactctattgtccaggctggagtgcggtggcgtgatttcagctcactgcaacctctgcctcccgagttcaagtgattcttctgcctcagcctcccaagtagctgggatttcaggcgtgtgccatcaagcccagacagtttttgtatttttagtagagatggggtttcaccatgctggtcaggctggtcttgagcccctgacctcaagttatctgctggcattgacctcccaaagtgttgggattacaggtgtgagccaccgcgcctggcctgtatttgacagcattgatatagaacatttccattattgtagaagttctactggacagcgttgctgtaaatcattaaatgtagaggaatatctatcacaatttaaagaaccaagagaggtggataatattagaatgctttttctggccacttaacaaaaatacgtgcctgtccttgatactgacatcttcccttatcctatttttaaaaattctgcatttgttaattgtgtaaacgcccactgggtatatatttataataaaatttatacagcttattattcatatttgaattttattcagttgtttcaagggcagtgtggtataatagagcataaggttaggagtaaggatatctaattttgtgactttaggcaatttgcttaacctgttacctaaaatttattacttttcaaacagagataatctttttttgagtgtttacttcacatgagctatatagagggaaaaaaagttaaaaaatgtatgtgtacacacatgtatttttatgagtaagatctttatgtactattgtggagtcatctccaggatgtttaagtgaaaaaagtaatgcgcacagtatgccaataaaggagagatacaaatataacttgcctggagttgcataaatggcagagttggaactaaaattcagctatcctatttaattctggactcttttacttcttattgtacagccatgtcagtatttgtcatcatgccatagaaacattttataagctaaatttgtctcttgatcttgctcttaatcagaaggcctcttatcacatttaaaaaatttgtagacatattattcttcaggaccatcttggtttcttttaatgcaagtaaatgggaaatatatcctaatatgtaaaaatttactttatcgctctccttattattatatatctcatcgatgaggacctttctaatagccttattatgtatgcttacttgtgaatttatcctctcctattaacattttataagtctaaaaattaaacactttatacttacattttgaagtattttgcatagtctaaactattaaaattaacttgaaggtgacgagtaaaagtcgttctgaattaccagatgtgaaacaaggtgaggccaatcttaaagagataatggatagagcttatgattcatttgatattcaacttacaagtgtacagctgctttacagtagagttggtgagtataaaatgcattatttgttgattgattttgttgaagtgattaattaggtttttagacactttgaagaccttcctcttaaatgtgttagaacgtctatatttttgaattagaaatgatagtaaatattgtctagctgttcttaccaggagcagtcttgcccccccaagagacatttgtcaatatctggagacatctttggttgtcacaggtagagcatgagtggcactcctagcatctagtgggtaaaggtgagggatactactaagcatcctacgatgttcaggccagtccctcataataaatatcagtagtgctgaggtcgagaaatcctgatctgtaccaatgttttccagcctttgaccaaagttggcccatattgaaaatgatattggtattactacacagttggataaccagaagacattgctcagggccagaagtaagcagcctaggggctctgacagtcatggacagccatacaaagacgagggtcactctcctagacatacttgtatctcattcactgtggtataccagtcaggagtctgatttagagctagttttgaagatgaagtcaaagccagaaattcacttgccaagagccatttaagtagttagggagagaccccagactcgttcagctttcttttcgttctgtcatactgcttttgaatccctagagtgttagtgaacatgcagataattcagtaaaatttgatctgttgaagagatccatatgtagagatctaagtgtttgtatgcagtcagattttaattacctgagctaaccaataaaaggagaaacaatgagaatccaaagtagttgttatcaaaattgttaatttgtataggactgaaacattttatttcttcaattatatttgcttcaggatagtgaatgtagtttgtatttttatcatattctaattgtggtggaggaaacccaaaggtatagtgggtggcagaagtacgttattttcagaattccacaaattctttttcagggaataaattactgggtttggttttccttgactgggattttatctgactcatagaattattatgttcaaatgagatagtatatatgaaaatgcattatatgactgagatcccattaatcttgttatgaatttttaaagttatttctttctgattatacctatttcagaaaatctgaacaactgagaaaccaaaaagataaacctttatgttactgcttaggcaggaacactattgatattttgttgcacatccttttagtatgtttttcagtgtgtgtacctgtgaatatatgggatgtgcttgtttggtgtttatattggaggtatttgtgaatgtattttttttacatgatttatatagttttatatccaggtattttttcttttaccagtaatattttggtcacttgaactcatggtttttattgtctatattatgctatatggctatggtctcagttatttaaccattcccttatggaacatttaggctcgtaactctgcagtgattgttgccaatcaacaacatccaagtagacttggatgtgaatttcagttttatcactagcagattgatcataggcaaattataaattcttttgagtctcagttttctaaagtgggattattatacagaattttgagaattaacatttaaacattacctagaagagtagaaattataaatcttgaataaatggtagcttttattagttactgttaaagaacctcactttttactaccttttgcattattgctttactgccatgttacttttttgggtaaggtatgtggttggtgtagtgattgtcagtggatgcgcagtagatttgataacctactgattgtatgtacctgagaatgtgacattaagattacctagatgtggggaaatttcctcatataatggaatgtgtgactatgaagtattaatagttattttaggttttgtgtgttatagttacgttaaatatgaactattttctgtacttaggtgataattggagagaagcacgaaaactcagtgtatctacccagcatattttggtacccatgcacttcaatttggaactgtctaaggccatggttttcatggatgtaaggatgcccaagtatgtactgtttgtttcatgtgaatatggattttctgggtaattctgtagctagggaaataccatacttaactgactcttccttgtgtgtgtggtgaaatgtatataactgactcttccttgtgtgtgtggtaaaatgtatataaaatttaccattttgataatttttaagagtatagttcattgtcattaggttcacgcatgttgttatgcaaccatcaccaccattcatttccagaactgtttctcttccaaactgaaactctgtactcaattaaacaataacaccccatttcaccctgcacccagcccctgacaacaaccattatatcttctgtctttatgaatttgactattttaggtgcctcatataagtggaatcatagaaaatcagattttgtgtgcctgggtttcttcacttagcataatgtcttcaagattcatccatgttggagcatatgtcagaatttcatgtatttttaaggctgattaatattccttatatgttgtatatactatgtttttatttattcatccttcaatgaacatttgtgttgttaatgctgtttggctgttgtaataatgctgctgtgtacaaatatctgcttaagtccctgatttcagtatttttgggtgtatactcagaagtagaattgctggatcatattatagttcagtgtttaagttttagaggagtgctgtgctgttttttatagcagttacaccattttactttcctaccagcacaagagtttcaatttcttcactgcctctacaacacttggtattttctgtttttttattttaatagtcatcctaataggtgtgaagtgatgtcatttttctaatgcttagtgatgttgaacatctgttcttgtgtttgttgaccattcatgtatttatttggagaaatacatattcaagatctttgcccatcttttaatctggttatttatttttttctgtttttcgagatggagtctccctctgtcacccaggctggagtgcagtggcatgatcttggctcactgctacctccacctcctgggttcaagtgattctcctgcctcagcctcctgagtagctgggactacaagcgcatgccaccacgcccagctaattttttgggtttttggtagggatgggatttcaccgtgttagccagggtgggcttgatctcctgaccttgtgatccacccgcctcagcctcccaaagtgctgggattacaggcatgagctgccgcacccggctgagttgtgagagttttaaaatatattttggatattaactctttatcagatatatgatttgcaaatattttttctcactctgtgtttccttatcactctgttgattgtggcctttgatgtctaaaagtttaaaatttttattgtccagtttatcttagttgcctatgcttttggtgtcatatccaagaaattattacaaaatccaatgtcataaagcttttcttctttgtttaccttaaagagttttatagttttagcttcttttatttagatctttgatccattgagttaatttttgtatgtgacatataggataaggaccggcctttattcttttttttttttttttttttttttttgagacagagtctcgctgtcgcccaggctggagtgcagtggcatgatctcggctcactgcaggctccgccccccagggttcacaccattctcctgcctcagcctcccgagtagctgggactacaggcgcccgccaccacgcctggctaattttttgtatttttagtagagatggggtttcaccgtgccagccaggatggtcttgatctcctgacctcgtgatccgcccgcctcggcctcccaaagtgctgggattacaggcgtgagccactgctcccggccttattcttttgcatgcaaatatctcatttcctctatacaatttgttgaaaagactgtccttttctcattgaatggccttggtaccctagttgaaaatcatttatccatatatgcaagagcttatttttgggctttctgttttattccattggtctctatgtctttattttcctgtaccacactatttagattactgtagctttataggaagttttgaaatcaggagatgtgagttatttaactttgttctttcgattgtcttggctattcgggatcctttggtattccatatgaatcttagcatgttttcttttcttgtaaaaaatgttatagagattctaacaaagagtgtatcaaatctgtagatccctttgaatagtattgacatcttaataatattgactgttatagtccatgaacatggaatatctttctatttatttgtgtctttgatttcagcaacattttctaggtctcagtactaaagtctcttgcctcatttcttaagtttattctttgtgatgctattgtaaatgaatttaaaaattttggggggattgtttattgttagtatgtgggaacttaactgatttttatatcctgcaacttgtgaatttgtttacaattctaagttttaggattctaaagttctaacagatttaagattttccacatataagatcctatcatctgtgtatggagttaatttttttccctttctgatatgggtgccttttatttctctttcttgcctaattggtctgtctagaattttttagcactctcttgaatagaagtagtttaggttggcatcctcaccttaatcctgagcccagaggaaaagctttcagtatttcaccattgagtatgatgtcagctgtggggtttttatggatgacctttattatgttgaggtagtttccttctgttcctagtttgctaactttttattatgaaaacgtgttgaattttttcaaatcctttctgtgctttgagatgatcatgtgatcatgtaaaaaatgatcaagatgatttttttccttcattctgttaatggggtatgttaccttaattgctctctatatattaaatcatatttcttgagtccagcaaaaaatccttttattccaggaataaatcctcttattctaggaataaattccaagagtaaatgatatataaaccatgtaatgggctattgatttaggtttgcttgtgcttttgggttttgcattaatatttttcagatatattggactacagatttcttttcttctagtatctttgtctggctttggtatcagggtaatgctgtctttatagaatggattagaaagtattcctgcctcttcagtttttgattgtttggtagaattcactattgaagcgatcagatcgtgggaggttttctttattgggaggtttttgattactgattcagtctccatagtagtttatccagattttgtttcttcataattcagtgttggtagatttgtgtttcttggaatttgtttcatttaaggttatccatttgttggtgtaaaattgtttgtaattgtctctctcttaacagccctttttgttttgtaaaatgagtagtaatgttaccactttcatttctgatttaaattgagtcttttctgtttttttctcagtctaactaaaggttttcaatctcgatcattttgaagaaccaactcacatttttgttgatttttttctctattgtttttctatattttatttatttctgctttcatctttgttattttttttatttcgggtagctttaggtttagtttgctgttctttttctagttccttaaggtgtaaagttaggctattgattttaggtctttcttctttattaatgtaggtgtttacagctataaagtccgcttttggcagacttttgctgcatcctatgaattttggtatgttgtattttcattttcatttgtcttgagttattttctaatttcccttgtgatttctttgatctcattgcttgtttaaccatctgtttttaaatttctatacacttgtgacttctacactttttccttctactcttgcattctagactcatttcatcattattggaaaagatacttcttatgatttcacttttttaacattttttgacgcttggttttttacctgacgtataatctgtcctggagaatgtttcatatgcacttgagaaaaatgtctattttcctggatggagtgttctatatatgtcattttagtccagttggtcaattttattggtccagtcccctgtttccttattaatctactgcctggtgtttctattcagtattgacagtgagatattgaagtctcctattattatcaaggaactgtctgtttcttcttcttaattgtgtcagtgcttgctttatatatttttgaactctgatgtttggcacatatatgtttataattgttatgtcttcttggtgaagttatactttcattatcattatgtaatgtccttctttattgcttgtaacagtttttgatttgcagtctattttggctgtttttgttacaggcatccctgctctcttttggtgattatttgcatggaatgtctttcttcattttttttttcacttttaacctgtgtgttttctatgagttaacgtgatctcttgtagacagtatgtagttgcatcctgttttttaatccattttgtcacttgaagtttttaattgagaaaaaatatatttacatttaaagtaaatacagatggggaggacttacttttgtcatattgttatttgctttctgtatgtcttacagcttttttgatccctcatttcctcctttaatggtgccctttgtgttcagtggatttttgtgtgtgacatgctttgattcctctctcatttccagttttgtatattctacaagtattttctttgtggttaccatagagattgtgtataatatcctcaagttataacagtctatttatttattatttctttatttttttagacagggtcttgttctgtcacctaggctagagaacagtgttgtggttgtagctcactgcagcattgaactcctgtgctcaagtgatcctcctgccttgtcctcctgagtagctgggactacaggcacacgtcactacactcagctaatttttaaatttttttgtagagatgggtcttgctatgttgcccaggctataacagcctatttaagattgaggcaggttgcatagtcttatacctgtaatcccagcactttgagaggccgaggtggtaggattgcttgaggcaaggagtttgagaccagcctggccaatgtagtaagaccctgtctctacaataagtaaataaataattaaataaaattagctgggcataatggtgcatgcctatagtcctagctacttgggaagttaaggtgggaggatagcttgagcccaggaggttgaggctacggtgggttatgattatgtcactgcactccagcttgggtgacaaaaattttaaaaagtgaaaaataaaactgataccaagttagcttcaattgcatgcaaaaactctacttgtttcctgttttgccccctccagtttatcttattgatgtcccagattatatttttatgtattctatacccattaacaaagaattgtaattatttcttatgcatttgtcttttaacttatgtagaaaataaatagtagagttataaaccaaaattctaataacatttgctttatactcatccatgtatttacatttactgggattattatatttcattgttagctgaagctatgtgcctgagatcctaagtagagaagtctgttgaactagactgggccatttagattatttatttctaaatagttttagactgtaggtagtcatttaacttcttccttgtaacagcaccttttttctcccttacaaatattcagacctcaggcacagatctattttaaaatttaaccaaaggcttttctcatctaacatctaccaaacacttccaggagagttgctactagcaaggcaacatgagaaggcttcatgcctagttaaagtgtactaggaagaatagagggaattagagagactctggccttttcctatatggtacatggggtggacattgtttttaatacttattatacttaacatgtaaaagggagagacccacactcttttttgttgacctttacctcatagtgactctatctactaacaaatattgtccagggccctaaatcttactctcctagattttcttttcttagaaaatcaaagcatgcactgagagtcttgaggcagaggaatggctagaatttggtttaagagacagaaggaaagaaaaccatgctacgcattcccttgttttttttcaaatccagctttagatatggttcaatttaaagagaaaaggcttaattcttttcatttctcccaaattatgtctgctgcttgtttactcttttctactgtttcttgtaaagtttttcattctgtgataaagattaaagatctgtgcgatttcttgttgtaagcatatgactaagaattgattttttttagcatagtttaagtacttttcttcttggtaagtatgctataatcttggaagttacagggtaccagaaaaagtaggtgatatttctctgagggaagaaaagggcagcttttatcttggtttggacttgctctgtcagtatatgcttaggaagaatttatgtcttgtgatgcagggaatatgtacagcatagcaggaattaaaatagctgattataagggtacagggcagaaatgacaatgacttaacttagaaagatgaaatcttagaagttatttggtttctattttataatattgtgagcagtataaagtggatatgatatgtcaaatcctgaaactccacaggtgtcaggaacattcccttgaaagttgagctgcgttaagttgaaggcaaataaaaggatgcttgctatttggtagatactgttttggtacccagcatctttagactgcgcaacttgcagatttttcaagaaagtgaaaaaaagtttaagtgcattaagagaaccgattcataatgtttaacaaagttaaactactactacgcttgtgattaattacaaatatttaaggtattggaaataaaagaaagcttgtaattttctgtaggactccagtacatttttagaaagataacgtaagtaatcagtgtgcgtacgtggaaaaagtaatttttagggaaaatgcagggataaaaatggggagtgaaaactttctctctctctctctgatagtgaaaactaactttctgtctctctcaaaggagactgtcaaggcaattaaaagaataataaagcactctgatgtggttttgctcaatgatctttgatacatagtctcatgagcaggctatttgcactgccaaaccttagttttctcataggaagcatgtacatataggaacttaaatagagagcaaaaataggttgtctgcctcatagattgtgaggactgtttacaataatgcatgtaaagtgctttcctcagtgcctgtcacatgagaaacacttgattagtagtaattgtcaattgtatatagcaaacagtagaaggacattacatgaaataagaacataaacctctgaaaaataatgagtttagcccatctaatgaaactggttaatacggtaagacggaaattggaatagagatttttagtgtttaaaatcacatttgattcagataatttgagaacagtctttttaattagtgcacttaaatcagaataattcctttataattacttatttttatcttttcaaaacagattcaagatttatggaaagttacctcttatttctttacgaatctcagataaaaaactacaagggattatggaattgattgaaagcattccaaaacctgaaccagtaactgaagtatctgcccctgtcaaatcattccaggtaatgttactttcaaaattaatataagcatgaattaagaaagtccacaaatagtatttcaaacaatcacaggaattttatataagacaatttgcaatttgttttgaatagacattaagaaaattactttttttttttttttttttttttgagatggagtctcgctctgtcaccaggctggagtgcagtggcgtgatctctgctcactgcaagctccgcctcccaggctcacgccattctcctgcctcagcctcccgagtatctgggactacaggcgcccgccaccacgcccggctaattttttgtatttttagcagagacggggtttcaccgtgttagccaggatggtctcggtctcctggtcttgtgatctgcccgcctcggcctcccaaagtgctgggcttacagacgtgagccaccacgcccagccagaaaattacatgttgagagagaaattgaaatggtaaaaagtataaatagttaagaaagatataaaataataaatctacttttctaatttctgcagcctccaatccctctcctgagcaataacactgttaactactgcttctctagtttttaaaaaaatttttgtggcatatactagtacacacatgcacaagaacatgcatgtgtgtgtgtatgtagtatgtgtgtgtatacatacatgtatatattcattttttttttttgaaacagagcctatctctgtcacccaaggtggagtgcagtggcgcaatctcggctcactgcaacctctgtctcttgggttcaagcagttctctgcctcagcctcctgagtggctgggattacaggcgcccgccaccacgccagctaatttttttttgcatttttagtagagacagggtttcaccatcttggccaggctggtcttgaactcctgaccttgtgatccacccgcctcggccttccaaagtgctgggattacaggcgtgaaccaccgtgcccggcctgtattcttttatttttaaaattaaatgaaatcattatacacactattctgaatctgtattattttcaccattattatcatatatgccttagataaatttttatgttagcacatacagatctacctcatttgtttatggtgatatagtatttcattttctgcatataccatcttttgcttaatatatcttcttttgatggatattcacattatgagtgtttacagttatgaaaaatactgctttgaacttcctcatatatatacatatatatgtgtgtatatatatatttgcttatacttttattcataggataaattcctagaaatggaattgttgagtaaaagaggatgtgaattttaaattttgattattttgccaaaaaaaaaaaaatttttttttttttgggacgaagtctccctcttttgctcgggctggagtacagtggcacaaccttggctcactgcaacctccgtctcccaggttcaagcggttgtcccatctcagcctcccaagtagctgggactacaagtgcgtgccactacacttagctgatttttgtatttttagccgagatggagtttcaccatgttggccaggctggtcttaaaatcctgacctcaagtgatctgcctgcactgggctcccaagtactgggattacaggcgtgagccactgtgcccagcccagatttgcttaacttatagtttgctaacagtgaatgaatatctttctctgctttcattactgagtattagcaaatgttaaaattttattcgaagtgaaaaaaatgtcttctggttttgatatgcttttttaaataagtagaacatactttcctaagtttactattttaatttctgtttttggaaactgctgttcatgtcttttttctattgggttatggttgtctaattaaggaagtaacctgcttgtcatttaaaattactgttttttcctcattttattgtttggttgttttttatctcatatgtaaatttatttttgccaggcagaagcgttttattttttacatagtcaatttttttttccttcatgatttctggactttgtattatgtgacttttccctttccaagagaatttcagaaagaaaaaaaatatattcacatttccctccattttcgggggtaacagggggttctttactcatgtttaaatgcttttcttttgaagtagtttcaaacttgaaacattccaaaaatagtgtaaagaaggtttttttttattattatattttaagttctgggatacatgtgcagaacatgcaggtttgttacataggtatacacgtgccatggtggtttgctgcacccatcaacccgtcatctacattaggtatttctcctaaagctatccctcccctagcccccgacccctcgacaggccccagtgtgtgatgttcccctccctgtgttcatgtgttctccttgttcaactcccacttatgagtgagaacatgcagtgtttggttttatgttcctgtgttagtttgctgagaatgatggtttccagcttcatccatgtccttgcaaaggacatgaactcatccttttttatggctgcatagtagtctatggtatatatgtgcagcattttctttatccagtctatcattgatgggcatttgggttggttctaagtctttgctattgtgaacagtgctgcattgaacatacatgtgcatgtgtctttatagtaggatgatttataatcctttgggtatgtacccagtaatgggattgctgggtcaaatggtatttctggttctagatccttgaggaattgccacactgtcttccacaatgctggaactaatttacactcccaccagcagtgtaaaagtgttcctgttttgcaacatcatctctagcatctgttgtttcccaactttttttttttttttttgagacggagtctcgctttgtcgcccagcctggagtgcagtggtgcgatcttggctcactgcaagctccacctcctgggttcacgccattctcctgcctcagcctcccgagtagctgggactacaggtgctcaccaccacgcccagctaatttttttgtatttttagtagagatggggtttcaccattttagccaggatggtctcaatctcctgacctcgtgatctgcctgcctctgcctcccaaagtgctgggattacaggtgtgagccactgagcccggccccttttcccaactttttaatgaccgacattctaactggcatgagatggtatctcattgttgttttgatttgcatttctctaataaccagtgatgatgagctttttttcatatgtttgttggccgcataaatgtcttcttttgagaagtgtctgttcatatccttcgcctactttttgatggggttgttggtttcttacttgtaaatttttttcagttctttgtagattctggattttagtcctttgtcagatggatagattgcaaaaattttctcccattctttaggttgcctgctcactctgatgataatttcttttgctgtgcagaagctcattagtttaattagatcccatttgtcaattttggcttttgttgccattgcttttggtgttttagtcatttagtctttgcccattcctgtatcctgaatggtattgcctaggtttccttctagagtttttatggttttaggtcttacatttaagtctttaatccatcttgaattaatttttgcataaggtctaaggaagtggtccagtttcagttttctgcatatggctagccagttttcccaacaccatttattaaatagggaatctttcccccattgcttgtttttgtcagatttgtctttaaatagggaatctttcccccattgcttgtttttgtcagatttgtcaaagatcagatggttctagatgtgtggtgttatttctgaggcccctgttctgttccattggtctatatctctgttttggtaccagtaccattgctgttttggttaccgtaggcttgtagtatagtttgaagtcaggtagcgtgatgcctccagctttgttctttttgcttaggattgtcttggctatacgggctcttttttggttccatatgaactttaaagtagtttttttgaattctgtgaagaaagtcaatgataacttaatggggatagccttgaatctataaattaccttgggcagtatggccattttcacaatattgattcttcctatcagtgagcatggaatgtctttccatttgtttgtgtcctctcttatttctttgagcagtgttttgtagttctccttgaagaggtccttcacatcccttgtaagttggattcctaggttattttattctctttgaagcaattgtgaatgggagttcactgattatttggctctctgtttgtctattattggtgtataggaatgcttgtgatttttgcagattgattttgtatcctgagaccttgctgaagttgcttatgagcttaaggagattttgggctgaggcattggggttttctaaatatacagtcatgtcatctgcaaacagagacgatttgatttcctttcttcctatttgaataccctttatttctttctcttgcctgatttccctggccagaacttccaatactatgttgaataggagtggtgagagagggcattcttgtcttgtgccagttttcaaagggaatgcttccagtttttgcccattcagtatgatattgtttgttgctttgtcataaatagctgttagtattttgagatacattccatcaatacctagtttattgagagtttttagcatgaagggtgttgaattttatcgaaggccttttccgcatctattgaggtaatcgtgtggtttttgtcactggttcagtttatgtgatggattacgtttattgatttgcatatgttgaaccagccttgcatctcagagatgaagccaacttgattgtgatggataagctttttgatgtgctgctggatttggtttgccagtagtttattgaggattttcacattgacgttcatcagggatattagcctgaaattctcttttttgtgtgtgtctctgccatgttttggtagcaggatgaggctggcttcataaaatgagttagggagaagtccctctttttctattgtttgggatagtttcagaaggactggtaccacctcctctttgtgcctctggtagaattcggctttgaatctatctggtcgtgggctttttttggttgataggctattaattactgcctcaatttcggaacttgttattggtctattcagggattcgacttcttcctgatttagtcttgagagggtgtatgtgtccaggaatttatccatttcttctagatttttgtagtttatttgtgtagaggtgtttatagtattctctgatagtagtttgtagttctgtggaatcagtggtgatatcctctttagcattttttattgtgtctgtttgattcttctcttttctttattagtctggctagcagtctatgtattttgttaatcttttcaaaaaaccagcacctggattcactgatatttttgaagggtttttcgtgtctctatctccttcatttctgctctgatcttagttatttcttgtcttctgctaccttttgaatttgtttcctcttgctcttgcttctctggttctttaattgtgatgttagggtgttgattttagatctttcccgctttctcctgtggggattttagtgctataaattttcctctaaacactgctttagctgtgtcccagagattctggttgtgtctttgttctcattggtttcaaagaacttacttctgccttaatttcattatttacccagtagtcattcaggagcaggttgttcagtttccatgtagttgtgcggttttgagtgagtttcttaatcctgagttctaactggattgcactgtggtctgagagactgtttgttatgactgccattcttttgcatttgctgaagcttgttttaccttcaattatgtgatcaattttagaataaatgtgatgtggttctgagaagaatgtatattctgttgatttgggggtggagagttctgtagatgtctattaggtccacttggtccagagctgagttcaagttctgaatatccttgttagttttctgtcttcttgatctgtctaatattgacagtggggtgttaaagtctcctgctgttgttgtgtgggagtctaagtctctttgtaggtctcttaagaacttgctttattctttaagaatgttgaatattggcgcccactctcttctggcttgtagggtttctgcagagagctctgctgttagtctgatggtcttccctttgtgggtaacctgacgtttctctgtggctgcccttaacattttttctttcatttcaaccttggtgaatctgacgattatgtgtcttggggttgctcttattgaggaatgtcttagtagtgttctctgtatttcctgaatttgaatgttggcctatcttgctaggttggggaagttctcctggataatatcctgaagagtgttttccaacttggttctattgtccccgtcactttcaggtacaccagtcaaatgtaggtttggtctttgcacatagtcccatatttcttggaagctttgtttgttcgttttcattcttttttctctaatcttgtcttcatgctttatttcactaagttgatcttcaatctctgatatcctttcttccgcttgatcgatttggctattgatacttgtatatgcttcacgaagttctcatgctgtgttttcccactccatcaggtcatttatgttcttctctaaattggttattctagttagcatttcctctaaccttttttcaacactcttaggttcattgcattgggttagaacatactgctttagctcagaggagtttgttattacccaccttctgaagcctgtttctgtcaattctgcaaactcattctccatccagttttgttcccttgctggcaaggagttgtgatcctttggaggagaagaggcattctggtttttggaattttagcctttctgcactggtttttccctaatctttgtggatttatctaccttgagtctttgaagttggtgaccttcggatggggtttctgtgtggacgtcctttttgttgatgttcatgctgttcctttctgtatgttagttttccttctaacagtcagacccctttgctgcaggtctgctggagtttgttggaggtccactgcagaccctgtttccctgggtatcaccagcggaggctgcagaacagcaaagattgctgcctgttccttcctctggaagcttcgtcccagaggggcacatgccagatgccagccagagctctcctgtatgaggtgtctgtcgacccctgctgggaggtgtctcccagtcaggaggcatgggggtcagggccccacttgagaaggcagtctgtctcttagcagagtttgagtgctttgctgggagatccactgctctcttcagagccagcaagcaggaatgtttaagtctgctgaagctgcacccacagccgccccttcccccaggtgctccgtcccagggagatgggagttttatctataagcccctgactgggctgctacctttctttcagagatgccctgtccaaagtggaggagtctagagaggcagtctggctacagtggctttgctgagctgcagtgggctccgcccaatttgaacttccaggcaactttgtttacactgtgagggaaaagctgccttttcaagcctcagcagtggtgattcccgctccccccaccaagcatcccaggttgacttcagactgctgtgctggcagtaagaatttcaagccagtggatcttagcttgctgggctccatgggagtgggatccgctgagcaagactggcttcagccccctttccaagggagtgaaaggttcatcttgctggcattccaggtgccactggggtatgaaagaaagctccttcagctagcttgatgtttgcccaaatggttgcccagttttgttcttgaaaccctgggccctgttggtgtaggcacccgagggaatctcctggtctgccggttgcgaagactgtgggaaaagtgtagtatctgggctggagtgcaccgttcctcatggcacagtccttcagggcttcctttggctatgggagggagttccctgatccctttgtgcttccggggtgaggcaaagccccactctgcttcagctcgccctccgttggttgcatctactgtctaaccagtcccactgagatgagccgggtacctcagttggaaatgcggaaatcactggccttctgcattgatattgcctggagctgcaggttggagttgttcatattcagccatcttgccagccaccagtgtagagaagttttatccccagtctgttagagagtatgttactacctgggcgtggtggctcacatctgtaatcccagcacttagggagcccgaggcaggcagatcacttgaggttaggagttcgagaccagcctggccaacatggtggaaccccgtctgtactaaaaatataaaaattagccaggcatggtggtgggcatctgtaatcccaactgctcaggaggctgaggtaggagaatcacttgaactctggaggtggaggttgcagtgagccaagattgcgccactgcactccagcctgggcgacagagcgatactccatctcaaaaaaaaaaaaaaagaaagtgagttaatgtcccattactcctgaatactttagtgttttgttgtattcttttcctagtctgttggtgagtttttttgtttctttaattgtcttttggagggcaaaagtttaattttgatacaattgactttagcaatattttctctagatattgagctttttgtatcacatctctgcaatttttgcctaatttaaggtcaagaagatttttccctatgtttttttctagaaattttttagagttaggttttatacttaggtctctcatccatttaatttttctatatggtgcttgtgatgggatcctctttctagttttacatctgcacttagttatttccattttgtttgttaaaaagactattcttttactattgagttgactatatatgtgtaagtctatttcagactcttccagtgatttctgtgtctatcatttccatctgtttctgtccttttgttgatatcatactgtcttaattatactataacttcatgtcttgaaatccagaaaggttagtcctccaactttttgtatttccaaaatgttttcgactgattcctttgccttttagaatcaacttatcaatttccacaaaaattctggctgagatttggatagaaattgtatcattaatttgggagaattaacattttagcagtattgagtctttcagttcattaacatggtatatctctccatttgcttaggtctttttaagtttttaaaaattggttatttgtagcttaagcatccgtttgctaatatatgttgttaaatttgtacatagtgtatgggctgaattgtgcccttcaaaatttatatattgaaccctaattctgctatttcacattgtgactgtatttacagataggttctttacagcagtgattaagttaaaatgagaccactagggtgggcgctaatccagtttgactggtgtctttataagaaaaggaaatttggtctcacagagacaccagagatgcatgcacactgaggaaagcccatgtgaggacacagaaaggaggtcatctgcaagttaacgatagaggtggcctccagaactgtgagaacatagatttctgttgttaaagtcacccagtctatgctattttgttatggcagctctggcaatctcatatacgttttggtaccaagcagtgagttgttgcttaacaagcacttagaaatgttgaagtggctttagaactgggtaatgggcagagactggaagaattttgaggcacatgttagaaaaaaacctagattctatcgtttaataaattattgatataaaatatggacgttcaagctgtttctgttgagacctcaagtggaaatgaggaacatgttatttgacattgaagggaatgtggtccttgttataaagtggcaaagatcttggttaaattatgttctagtgatgaagttggatatttagctgtggagatttctaagtaaaatgttgaaggcatcgtcttatttctcattgcagctggtcaaatcacttgaggccaggagttcaagaccagcctggccaacacgatgaaatcccgtctctactaaaaatataaaaattagctgggtgtggtggtgcacacctgtagtcccagctactcagaaggctgtggcacaacaatcacttgaacctgggaggcggaggttgcagtgagccgagattgtgccactacactccagcctgggtgacagaaggagaatctgtctcaaaaacaaaaaaaaaattgtacaatatgtggttaatatgtgtttgatttattacaaagatgccagcctagctaagtgggggaaggatcaccttttcaacatatggttctgaaacaaccggatttccatgtggaaagtaaattaatttcaacccttatcttatatgcggaatttaacttgaagcatagacctaaatataaagtccacaagtgtaatttctggaacaaaaaatgtaggttaaaattttgaatccttgcagtaggtaaagataccttaggatataaaaagcgcaaatataacaggagaaaaaaataaataaattggactttataaaaattaaatttttctgctgtttggaagacattgttaaaaaaggtgaaaaggcaaaccatctaaccatccacttgggaaaaatagttgcaaaaatatttttacaagtccagacttgtatctagaatatatgagaagactaacagctcaataataaatgactaaacaggtagcatgaaaagatgttcgactttattactcaccagaaaaatgcaaatcaaagccacatagaaatactactacacaatggttagaatggctaaaaataagaagaatggcaataccatgtcaaggtgttgccatgacaaggatttaaaactctcatatgttacttgtgaaacttgaaaatagcataaccctttgtaatttagtttggtagtttttaaaaataaggttaagtatatacttaccatatgacttgggaattctactcctaggtttttacccaagagaaatgaagtcacatgcctaccaaaagacttgaactagaatactcacagtagggttattcataatagtaaaaagttgcataaaacccaattgtctatccagaagtgaatggataaggaaaaatagtatattcatacagtagactactactcaggaaaaaaaatactaatacatgtagcagtgatgggcagtgattgagtgtagggggagcttccctcaaaactccagggcattttagggaatagaacgcaggattacttggcaattcatttaagaacttaacaaaacttgtattctaaaacctaacaactacattataaaagaggaaaataatagcccagtttcactaataaatgtaagatacaaaaatttcaaaacattaaaagttgaaattaaggtaacatagttgttacttttgggaggatgcctaatgattgcaaggagcttaagggaggcttatgagttgcttgtaatgtttcatactggacctgggtggttggtaggttgagtgtgtttactttctgaaaatgtattgaactttagagtttatgtacttcgtgtagtagattataatgtgcttaaaaaaaatgctgctgctgcttccaaaatgagcagaatttcacagaatggcaaacacaaataaccaaggaagctatttgtgtttgatatgatatgtaaccgttatgcatttgtgaaattgtaattaaaactaggatgacatggccaatgagactgatataatttgaaatctttgaacaccctaagcattgtgaggatatggagagatagaaactgtgctgctggtgttagtgtaatgtcttatcaccacttttgaaaatggtttgatagtgctcaataaggtgaacatatataattttactgtttgggaaagttttatccacaagcacctatgggcatatcaaggatgtttatagtagtgctacaagcaaaagcaaaaatctataagcaacacagatactcaccaacagtatagtggacaaataagtagtggtttcttcatcagtgcaatacaatatcacagtaaaattcagttaactatcagtgtggttaaaatttaaacattgttttgtaaaggaagtcacaggaaaatgtatgtcatatatgctacagtttggaaagaggcaggggtaaacgatgcattatttagataatcattcataggtgctttagtacaaacaactaaataaaagcaagatcatgatgagaggtagggaacgtgacaaggaggaatgagatccgggaggaacacataagaagatgcttctaggtcaggatgtggtaatgttttattgcttggctgggttggaaaattcagatgtgtcttttattattatttttttaaactgcaaaatttgtttttatatatgctgtatttctccaaactgtaaaaaagtaaatttcctgaaatacctttcagagatcaaaaataaaagtaagttcctcaattctagaggctttaagtattgtgacttgtgtgttcctcacagatgtcctgatttaatactatgttgacttaaaatataagatctgtttctactcaaagcctgtcatcaaggacattattaaaacagttctacaatttttatttagccttaaaattgtaaaactacttctttaaaatctgcgttttataatgtatttttctaatttaaacctgattatcttctcagttaattcaaattggatagctttttgtcaaaactgttgtagaactttgaataaacattttttgaataagcggtgaataaacatttttgtgctaatcaacattgaattacttttctttcagattcaaacatctacttctttgggaacatcacagatttcacagaaaataattcctctcttggaacttccatctgtttctgaagatggtaaaatgaaactgcttaaggatatttttcttattttattaaaataatttctgttttgaggcatatttttctcaaaggaccacacagaggaaggaaaatatcttttccttttaaaatctaggttcttgactgaggctctatgaatggaagacagattaacatgagaaaacaagcagatttactagcattcatatttcatgggtacatgcaagaagctcaggaatgagtaactcaaggtggtgattaaaatttgggtttatataccagtttgggcttaaacaaaggaaaagaggttttgggcttcagggataggggttgctggggaggcaaggtatatgggaaggcgaccagaaaaagtatggtacacaagggtaaagtttgttacgcagatatgtcagtgttttctccgttgataagaatgtcttgggagtaagagtcatcttccctggtacagaaaggaagatacctttacaaggtagatttctcttataaatgttaatttcccttagaaaagggaaacttaggatctgtcttcagagcttttcctgtgtctgctgtttcttaaaataattgactcagtgtaatccttatgccaaaaagacatgttttcgagtggcgtattttggtcttctgtagtcatataagaaatttaaggcaatagcagatatttgtatattttcaggaaattttaactaaaatttattttaaatagcacaattccttaaagttgcttttgcaatgggatttttttggtataaagttgaacagaaaatgacaaggaccagccaggcgcagtggctcatgcctgtaatcccagcactttgggaggccaaggcgggcggatcatgaggtcaagagatcgagaccattctggccaacatggtgaaaccccacctctactaaaagtacaaaaattagctgggagtggtgctgcacacctgtagtcccggcgactcgggaagctgaggcaggagaatcgcctgaacccaggaggcggaggttgcagtgagcagagatcgtgccactgtgctccagcctggtgacagagcgagagtccgaatcaaaaaaaaaaaaaaaaaaaatgacagggaccactaataagttaattatctttatttggctgtgagttaaaaaacaccacaaaacttcacagatgtcttaatttctaatgtgttttttagttatttggaaaattttgctatagtatatttaaaacatttttaaaaatataattattaaaggaaaatcatcaataattatctacatttacatataaaaatatataactattctgataccaaatatgtgctttttaatgaccgtattagaaaaggtgtatgtctatatttttaagactttaaaaattgataaatgttaaataacagaaactgccatgtcgattcttggtttcttagagaacaatttttctttatttatagtcaccagagagaagttgtttgtgagatcatctactttaacttcagtcttagtttattagggatatacttctgattgtttcatttaaacctagttttaatggttttactaagttatctaatgctttttcagtcctttttaatatcagcatatgtgtatgctgatgtgtattacatatcaacgtatatgtacatatacctatatttgtgtatatatatgtatacaaagtagtgcttgatctcagtttacttcattcagactctgctgctaatattgcagagtttatacctaagtcctgttacactatccaggtagagtgagcatattaacatattactttgagtattcatggtgtgtataatcatcggcattggcatttcctgtaaaatttaagcaattttaaaatagactatttcaaaagatgggcttcttaagctaaagattacatcttaataatgttccatgcttctttataaccaagaatgttatttaaaagtagagtatccctttgtttaaaatggacaataaaaaagtacagtaatgtctatattattttctgtttatttcggttctcatgttaatatttgatatttaaaagagagccttagtgttttagtgttcatatttatttctattgaaatactgttaaattgatcattttaattattgacttaaataatgttctgtgaaatgtagattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggtaggtactacggtaaaattaacatggcttaatttgtttgctgtttctatatttacagcttactatatagtctcattgttaagaagcactatctttttcaccctaattaaagtaattccagacttgctgtgtgattcttggtcactccccgccccccccttttttttttaaataagattaacttccttaatcaagagtgaaggatttaaatttattcagtacatgtttttgtgaaaacgattatttatgttgtgtgtgtattgtatgtctgtgtgggtataaaatctctcctaaattttaaataataatatatcaattgtatgtatacctcatatattcacatgtaaccactatgcacataaacatgtttttgttttatgtagtggtaatttcttttttctttcttctccaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttgggtaagaatctctattttttaaaataaataaattaatttcattgtttgactacctgctagagagttttcaattctttaggctctgaatcagtacatttgctgaaatattctcagagaaccattcctttttgagttaatctttaacttttatagttggtaatgtggggggcacaccggagataaaatgaagataattttattcattatggaaaatcagatgataatggttgaattttaaatctacttaactgagtattggaacacttaattagttttctattgttgctataacaatttaccacaaacttagtgcttaaaaacaacacaaatttattatcttagagttctgtatgacagaagtctgacacaagtctcactgggcaaaactcaaggtgtcagtaggacttccttttaggaggctctagaggagggtccatttcattgttcagtcaggtgttgacaaaattcatttacacatggtttaagtctatgtttccttgttgcctgttagcggatggctgcccttaggcctcagttgcttttttgcacgtagctgctaaccacaataaggcatcagatcctcctcatgttgccatatctctaacctcctcttctgtgttttgcttccactcttaaaactccagtgattagattggacacacctctataattcaggataatatacctttaaccttaaccttaatcccattttccaaggcccttttgccatatgagttaacatattctcagattccgggggattagagcgtaggtatctttgttgggggcagagggcagtattctccttactgcaaaccttttgtgttcgtaatggatatatgatccctaagaaactattctgtttcctatgttaggtaattaggagggttgtatttatatttcttcatttacattttttggatttttccttgaaagataattgtgaatagtagaggcaattattaggacaccagtttcattttattaaactcctttgtagcataataatattatgtatgagcagaggtggaaataaaattttttaaatagactattttttagagcagttttagatcatgggacaattgagcagaaggtacagagatttcccatatactccttgtacccacacctgcatagcctttttcattatcaacatcctccactagagtggtacatttgttacaactgatgaacctacactgacacatcgtaattaccaagagtccacaatttacattaaggttcactgttgctgttataccttctgtttggacatgtataatgacatgcatctaccattaccttctcatgtggagtagtttcactgccctaaaaatcctctgtgctccacctatttgtccctccctcccacttaacccctggcaactggtgatccttttagtgtctccatagttttaccagcatgtcacataattggaatcatatatatccttttcagattggcttctttcacttagtaatatatgctgaagttacctccatgtcttttcataactgggcagcccatttcttttttagcaatgaatgatattctcttgtctggatgcaccacagtttatttatccattcatgtactgaaggatatcttggttgcttccacggtttggcaattgttaataaagctgctgtgaacatttgaatgcaagtttttgtgtagacataaattttcagtttcactgggtaaataccaaggaacatgattgctaaatcatcaagaaacagtttgctctagtaattggaaagaaaagtaaaccaacgtgacagtgttccctagtaacccaggaactttatagcagttactaagttttttttattattattagttttatttatttttattttttgagatggagtctcgctctgttgcccaggctggagtgcagtggcatgatctcggctcactgcaagctccacctcctgggttcatgccattctcctgcctcagcctcctgagtagctgggactacaggcgcccgccaccacgcccagctaatttttttttttttttttttttgtatttttagtagagacggggtttcaccatagtctcaatctcctgacctcgtgatccgcccgccttggcctcccaaagtgctgggattacaggcgtgagccaccgcgcctggccacacttattaagttttatgtttattcttatgtttgctttgccaagaacaaaggattaaaaaacccttgcaaacagaaaaaagagtatacaattattattgcgcttatttctgtaatatttttgtttctgttttctcagagggagtgaatagcagtttcttgcacaaagtaaatgatcagtaaatggttcaatgaatgaataaatgtgtaaacaaagtgggaacttttttaaggcttcaagtgtggctagcacttggagtagaaaacaggtttatgtgctaagcattaggtttggagaactctgtgcaatttgtggcatttttttctcaggaattgtaggattagtttgtagtcctttcttccagtctttagatactaattttctagcaaccgtaagtcatttggtgatgagagttttaaaagctttctataaattctcttctacactggttttcttagtatagcacattttgagcagaagcagtaatattaaaatgggagagttcctttattcccctcgcaggacatgccacaggggtgtgtatttccctagagggagcatgcagatgggcaggtgcagaggctgtggggagtgcttttgggctccggccccaggacagcatctaggggtaggtgtctacaacccctgaagcccaaggggcatgtgttacagtatgctctttcaactttgccatctgcagacagcttttgttaatcacctcgatagaccgtcttccttatcgcaagggcagggggccattgtgactgcctgagttcttgcccagtgtaccagaagaattggatgacatgtgggctggaaggatgagtgcaaggttttattgagtggtggaggtggctctcagcaagacggatggagagccggaagtgggggatggagtgggaaggtggtcttcccctgaggttgggccacccagcagatggactcttcactgacagcccctagttgaactaccccagcgtccggacgtccacgtccttcctcttctctctttttctgccatgctgccctgccactctctgccactctccaccactcttttcctctgctcttctcaatgctcagctgcttgtatctgtgcccactaaggccttgggcttatatgggcacaggatggtgggtatggtgggccaaaaggcaacttttcaggtgcaaaaacagaaatgcttgttctcgtttagggcctccagtttttaggcttgagggtggggcctttgctggggaactgccctcttctacccagtatttccctgtctgctgtccatatcagtataactaataaagactgattacatggtaatagggtttattttaatctaaactaatatacagaaaacttaatgtttcatctcattcccggtctgtcttctgaacagctgggttttcaaggactctgatgatttcctttttagttatttcagtgatccagggccagaattctcttcctgccctttcattgttcctaaaaaccattctagtttctctttagttgattcctgttttttcttaccttacctcctatctaggtttagaagggtatgagacttcagtgttgtggcacatgaggaggtaagggaattgtgaggagaaattaaatttttagagtttaaagaacaaagaagtaacttgacttgggtgaggtagaatccaaggtccagaactcatataggaaagccttcttttgcaattacataattaataagattgcttgcatttattttcagttacctttccgatgaaaagataatttttaaaaaattatttttagatgaaaacaagaaaccagtttatttggttacaaccctggataacacaatggaagacctgttaacgctggaatatgtaaaggtaagcagtttcatttatatctgcttaatatggtaagtatgctgctgaaatgttaagttttgtaagtttggtattattcagtttatttaatcttcactgtaacataatctctttgtaactcctaatactaaggttttttttattttgtcatcttgtattaaatagttgtgatttataaatacttcatatagcaaaataagaagattgtgttctaagtagaaatgacctggagtttgattttttttttctcccaacaggggtactgagaaagaaacacactttttagtcttgttagagtgtattgttttatgtgatacaagatgatgctttcactttcttttccactgttttgtgaagttacttgatattcctagggtcaataactccattccttttttattgatttatgatattcattttatcgtttgttaagcttttctatgtactatggtctatttctaatttttccatgtttctgctgacttccgtgtttctgcgtcagactattttaataattactttataataagaataatgcagaaagcatttaatcactttaaaaccatttttgctatccattattgactagatgtcttaagatttttgttgtatatgcattatatagcttttatgtagcaaaagtattctagacctaaagaaaatggataaagaaaatgtggtatatatacaaaatgaaacactattcagctttaaaaaagggggggaatcctgtcacttatgtcgacatagatgaatgtggaggacattatgctaagcaaaataagccaagcacggaaagacaaatacctcatgatcttctttatgtgtggaatctaataaaactgaacttatagaagtagagagcacagtgatggttaccagagggtagcagggatgggagggagggaaggagagggaatagagagttgtcaatcaaatggtacaaagttccagatagacaggaagaataatttttgagatctgtatacagcaggggaactgtaatcaataataatgtgttgtttattttaaaacaaccaagaaagtgaatttcaaatgtctcaccacaaagaaagataggaaagcgaggtgacagatatgttagttagcttaatttaatcatttaacattgtgtacatatatcaaaacatcacattgtcctccataagtgtatataattatgatttgtcaatcaaaaatattaaattttttaaaaagaaaaagaaaacacagagtatttggatacttggtggacaattctgtcacaaattttgtttttaaatacaggaagaattaggaagaaccgtacagagttgttgatgaccgaatgattattctccacacttgataatatccaacatttcctctcttaataataagaatgatagtacgtaacatttattgaatacttgctatgtgccagagagtccaatacttacattttcttttgttctggtgaagcggttgcttatttaggtaattatatgtgtgtgtatatgtgtatatatatatatatatatgtatatgaacagctggaaaattatataaatgtgtattaggactataatgtgattgtatatgtatgtcttcctaacgtgttctaacagatttgttttctctttggataggctgaaaagaatgtacccgacttgaaaagtacctataacaatgttttacaattgattaaggtatgagtagataatttattttttaattatgtactatttcttatggaaattattttctaactggaattgtaagatccttaaagataagaaaatattataaattatatcctttatgccacaaagcatagtgccttgtagagagctggcaagcaaatatttattgacctatcactaaaatcagctttgttctttaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattaggtatgttttttaaaaatttagcatcaactttttttttttttaaccatgtaggtcaataaatctagaccctgactttattattaacttcaaatattggcttcagaattctgttgcctaggttaatatctagaaggattcattatatgccaggataattttagaaaataaaggaaactactggcgaagaaaatgttgcttttgtttatcgtatataataattgtttttagtttaagattatatagtaggagtattagattaaaaaattttttttcttccacctcccagtaggaggattagatttaaattaaaatttatgcatttcatgacattattttagattagacaaatatgactaacaaaatttgagtattgtcagctgggtgcggtggcttatgcctgtgatcccagtgacccagggaggtgagcgctgtggggattgaggctcaaggatcacttgaggccaggagttcaaaactagcctgggcaacatagcaagaccctgtctccaacaaaattttaaaaattagttgggcatggtggtgtttgtctgtagacccagtttacttgggaggctgacacattagaatcactggagcccaggaattcaaggttgcagcgatctttgagctacaattgcaccactgcactccatcctgggtaacagagagagactctgtttcgaaaaaaaaaaacaaaaaagagtatcagagcatattttaaaatcagagtatagtactttcgaagcagtgaaaagttgcaattttgataatgacaagtatcacctagtaattattggttctcaaaaaattttgaaatttatagctacagtgttttagtttcaaatgtttagtttcttcttgaaacagtgttgtctatttgcttttgtttttgttagattttattgttttttagaattttcaattcagtagggaatatcataccttgctttcaactgaattgcagatcaggttttctctgatatcactatttgtggtgatatttcagttactttataagtatagtgaggtaactactaaatgtttttcctcatgttttataatatgaatttttttttgcagctttaaaactatccacaaatgaagatatcattactttgcagattttagcagaattatcgtgtttacagatctttattcaagatcagaaatgtaacatttctgaaattaagattgaaggtaataaaatttcacaaaaagcaaattaaaagacattaaatgaaagaaaaggcagtcattcttttgttcccttagggcttgattctgagatgattatgaggccttcagaaactgaaataaacgcaaagctaaggaatataattgttttagattctgatataacagctatatacaaaaaggtaagaattcttttaattaaataatagtacatcattaaataggattgtcctttaagagtggtcataggtatcatttggacatttgtcagaatttagtagtatggcttattatgtgcatgggttttggagtcaggcataattgggttcttagctctactccttagtagctgtgtgaccattagcaggttacctaatcttggactctgtttctttatttgtaaaatgaggattacagtatctcataaatgagataagtacgaataatgctgcaggaacaaagttttgggagagaacctagtaaatacctttttcactttttttttttttttttggttcatgtactctgaatcttgtaatgcattttagatacatttgagggtctgaagtctgaggaagtgagattttttataaagcttattgtcatcagcgatcactagtatcgttgttgtaataatgataagagagtcctttgaactggatgattagttgttgaaggttaggtaatttgttactggttataaaacagtgaggttcctgctgcagagttgaacaggcaacatcctacctgaagcaggcaggattatgtatttaaggaggttaaaggaatatcagatagtaggatcaggaaaaactgaagtacttgttgagtcaggaagtcagcatttggaatatgttgagaagaaaggaaatagataaatagattttgccagtaatactgtagtgatgaactgatttttatgtttaaaaaattcttatttctaatatcttcttgttatggcttatttagtgggatagaaaaacagttccaacatcaaaaagaagtgactcatagcaataaggaacaagaaattttccagaagccgtggttttatttgcttctattgcttttattttaaaaatcataagtatcagagtatttaagaaataggttatccattttattttccctatctagaaagtaaagctcacagaaataaagtatctacgaaaagttatacagaactgagagcatgatccaacccattgatttttttctctgtaattttattttattttatttttttattttttttgagacagtcttgctctatcacccaggctggagtgcagtggcgcagtcttggctcactgaaacctccacctcctgggtttcagtgattctcgtgcctcagcctcgtgagtggctgggattacaggtgcgcacaaccacacccaactaatttttatatttttagtagagacagggtttcactgtgtttggccaggctcatctcaaactcctggcctcaagtggtctgcctgtcccggcctcccaaaatgctggtattacaagcatgagccactgtgcccggcctgtaattttatttttaatatatctacaaggttaaaaattcagtttacagaaagttacaaaataaaaaaaatctttctccttgtcttcttgcacgattttcatttccctttccctgtttctttgattccattgtacatggtttttaaacaaactgccttgtttagtaactttccacgtgtcaaagaaccagagaggcataaggtttttgcccttatgaaatcagacctgattatgaatcagtttcataagccttgtacagcgatatatattattgtgccagttttaagtgtactgagacattgaggccctcaactttaagggtgggagcccccagaccatttgtttgactctgtcttggagcagcatcctccatttactgtagcaccattggacaaatactgtttttatttatatatgccataaggtaaaaaggattcttgctgacctgatagtctcatgaaaaacatatcatagtaaattagtttctgatatcttcttcataaaaaatattttgaaagtaaaggcttaaaaaaatccaatttttaatgcttaattcttggtgatgggtacacaagtctttctaattattctcaacttttctggccttgttattaggccaacacttgcttcatgaaatgagttgggaaatgctttcttcctgttttctgaaaaatttgtatagaatttgcattattccttaaatgtttgatggaattatcagtgcaaatattttttgtgtatagttgagtctgggattcactttattttattttccatatggcattcagtatccaaaggagatccacacactgcatttgattgatataccacttaagtctgttatagtttatgaatttcctttagtttcttctctgcccttgtgttagccatttgttgctatcttatttattctgtacaattttccatagcctgtatcttgctgattatgttttcatgctatttaacatgttactgtatcctgtgtttccttaaatcggtatttaaatctcagggcacagtgagattcagggtttgggagtaggggttggcaagatacttcatagttggtagtgtgtgttttcataggaggcacatagtgtgtagctgtcttttttttcttttctgttttgcactgtcttggaatattttcttttttttatgttagaagctatttgttgttatttcctgtaatttggtcttgaagtctgtgtctggagagtggccataagccaaaatagccactttctagcttgcaggcatgttggtcagatgggacatcggggaggcaacacaacaaaacaccctcgaggggtgcccaccagggaggctgacaggaagtctggaggcagtagggacgtttcttcatttattaaatgggagagttcaccagtctttatgctggtatcaccaatcattttggcttttcaaaagtttattctccagtagatttcttaggcagggctcataggaacaataatccttatttatatttgcagggtagtttgactggattttaaattcttgccttgaattttcttttctagatgatcttaaaacatattactccatgtcttatggcctagtattggtgttgacagttctgatgacagtttgactttctttcgcttctaagaactttgccattttccccagacattcagagctaatttgaagctttatgtagggactttggacaggtagacatcacagttgatggtcaggaactggtctagcaattttatgggttctcagattgagagtatctcttgttcttaggctagttagtttccgttgagaaaaatactattaagtataagcctggcagcctacattccagaagccaattggttgaaagaagtggaggcctcatcatttagtttatagatttttgcttaaaataaccactttttaacatggtgttttattaaccgtctttctgtacctgaagtctcctagaccacagcctttctgctctaaactctgtcgagcaaatctgttctgttgaactcggagaggaacagtcatatagtcctactcatgtgacatgcagaggctattcggtttattctaaactaatttaccagtatttatataattatatagatacaatttatacattaatatatatgtaaattatatatgtataaatactggtaaataaattaagaaaaaactaattatatatattatataataatatattttatatatacataaaattctctctctctctctctctctctctgtctccaatcacacaatcacagctcactgcagcctcgaccttccctggcccaggtgatcctcccacctcagcctcctgagtagctaggactgcaggtgtgtgccaccaggcccagctgatttttgtagagatggggtttcaacattttgctcaggctgccctcaaactcctgagctcaggcgatctacctgcctcggtctcccaaagtgctgtgattacagacatgagctgagccacagcgcctggcctatttgagatactatagtcagcaaaagataaaaagcccttctccacgtggaataaatagtagttaatcagtaatataaaacaatattagagagtgatatgtgctttgaaaaccaagaaagcagggtaatgtgacaggtaataattcacgtggcgtattaggattatcaagaaatgcttttttacagtagaaacatttgacagaaatctgagctgtggatttgagccctgttgaaagagctttccaggtggaggaaagagcaactataaaagccttgtagcaggaaggtgcttgctatattctgggaggttttagggccctcagtaacctttgggtagaattatttattagtttctgttttggtttagtttttactttttaaagtaagatttattgagacaatttacctatagtaaaacttacctcttttagttataattctgtgagttttgacgaacatatactgttgtgtaacttaccttcagcatatacaatgggtctgtcaaccctaaatattcactactgccctttgaggttagcccttctccccatcctagcaccttagaatcactgcactgtttttcgttcctgtagttttgcagtttccaaagtatcaaataaatggaatcatgcagttatgtagtctttcacgtttttttttcttagcatgtgagattataatttttgtctttttatgtcttgatcagcctggttaacgatgtatcgattttattgatactttgaaagaactggcatttgtttcaattgaatgttctctgtttttaattttatttatttatgctcttttaagattccttccttctgcctgctttggatttaatatgctcttcttaaggtggaagtttaaattattgatttgagaatgtctttctgttgtaagcatttgctgctataaattttcctttaagcactgctttagctgcttcctgtaagttttgatatgtcatatttttattttcattcaattcaaagtattttctaatttctcttctgactttcttttacccattgtttatttagaaatatgttatttaacttctaaatattttgagattttcagatccctttctgttactgatttctagtttaaattcattatggtcaggggagaaaccgtttcagttcgtttaaatttgttgatgtttgttttatggcccagaacatatatgattaatcttggtgaatgtttcaagtgtacttgaaattaatatgtgttttgctgggttgaatgttccatttgggcaagtaggttggtggatagaattattcaggctactgattttctgtttactggttgtgttgaagcctctgattataaccattgatttgcctgtttctcctttcagttctttaagttttttgctttgtatgttttggagatctcttgttaggtacatataaatgtgtatgaattttatgccccttttgtgattatgtgatgtgtctttttatctgtggtaactgtgcttgttctgaagtctactttggtagtaatatagccattccaggtttcttcggttaggtttgaatggtctatctttttctgtcctttagcttttaatggatgttttcttgtttaaagtgggtttctgttttttgatgcaaagtctcactgtgttgcccagggtggtcttgaactcctgtgtttaagctcgcctcagcctaagtagtaagtagctgggattatatgtgcatgccaccacatctggcttaaaatgggtttcttacagtcagtgtatatttagatctttcttttttatctaatctgacaatctcttggcttttaatttgtgtttagactattttataaaactaattattgatatgattggattgtaatctgatatctctaattgttttctgttctctaattttgtttatcctattgtattcctccttttggcctgatttttgattaattatcatttattttatggtttctctagggtttacaatgtatatatctttaatcatagtctatcttccaataatattttattgttgtacatatagtgtaagaatcttacaataccatgcttccaattcccatttcctatctttcttggtatcatcataatttgctttactttggtgcatgttgaaaactcacaatgtgtacctattgaatttggtttagtcagttttctttggagcaattagttttctaaagatgttttatatttttcttcattgcaactctttctgtaactacttcatgtagtttctgtctattgtttgtatttctctctgaaatactttctcatttcttttttttttttttgagacagagtcttgctctgtcgcccaggctggagtgcagtggtgcaatctcagctcactgcaacctctgcctccggggttcaagtgattcttctgcctcagcctcccaaatagctgagattacagatgtgtgccaccacacctggctaatttttgtatttttagtagagatggggtttcaccatgttggccaggctggtcttgaactctttgacctcaggtgattcacccacctaggccccccagagtgctgggattacaggcgtgagccaccgcatctggcactttctcattttttataatgcaggtctgccagtaatgacttctctcagttttttgggtatagatgagaagggagctgggaaaaacctttatttcaccctaatttttctgagtgacatttttgctgggttgtgttttccccctttccaactgttaaaagatgtgatttcattgttctttgttacacatacttttgatgagaaatctatgacatttcttatttttgttcctctgtacataattggtcatcttttttgactgctttcaggatttatatatggtgtgactagatgagtttaattgtgttttgatatttgtcctgtttgggcttttctgagctacttggatggatctgtctttcaatatttttcatttttttcttcaaatagtttctttgcctctgtctccctttctctcccccaccccctggctcccctgttttctcctcctccactttttccctgttcctcttcttgaattcctgaaattcttgctggatttctgtttatagtcccacagcctttggatgttctgttcaagttttttccccattgttttcttagtgccttttaattcaaataatttatcttgacctattttcaaatctactgattttgtccttggctctgatgagtgtactgacaaacccactgaaggtattttcatttatgttaccatgttttttaatctttaatatatccctttgactcttcttttttccattttctctgctataataatattcaccatctattcatgcatatgttccactagaagcctttaccatattaatcatagtaattaaaattaaaaattttagtttcaacattgatgttatagatgagtctgattctgttgattcctttattatttgcttgaattttttcccttgcttttatagggcatctcataattattgatcgaatgtcagacatcatatcatgcatagcaggagtccccaacccccgggctgtagaacggtaccggtctgtgacctgttaggaactgggccggacagcaggagttgagtggtgggcgagggagcattattgcctgagctccgcctcctgtcagatcagtgggggcattagattctcatagtagggtgaaccctattgtgaactgtgcatacgcaggatctaggttgcatgctccttgtgagaatctaaagcctgatgctctgaagtggaacaatttaatccccaagccatctccccaccctccaaccccccagccccacttttgtggaaaaattgtcttccacaaaacagctccctgttaccaaaaaggctggggaccacagatgcatagcataatagagactgaggtaaatatcatagtatttatgtctggaaacggggatgcctcttttctgctaagctattagcttggggtggggggttgagcttaggttggtttgaattccagattaatacgatttccttcactacattactgcttcagtttcctttagttgtaccttgtgcttagggtggctggaggctgtgttgctcagattttgctccgtgctgagcctttgacctttcttctactcttgtacctcagaaaattctctttccacattcttagctctttcctagatgttagaggctcctgctgcttgtttcttagtgcttgtgagcttgatgtatttggggagaaggcaaggtggtttggataggcttgttagtgttcttgtccattttcactcctagccagggctgtttctgtgagtctcagaaatggagtattcttggccatcctgcccctcctcctcatggcatctgattgatatctctcgtatttcctatgtgggattgactatccttcccttccccagcagagggagacctctaatcatctggccccaggagagttcttgttcttcccctagagttttattttattcttgtccctaggatactgtatcttcacctgtgccctgagggaaacaaggtttactgcccttcccctagtttcttatggctattgttttgagtagttgataatcttggtggtgctttgggccttttctgcagtggaggctcctcaccttttccagggtcataccaaggaaagccttctcttgtttcccacttgcacccatctcccgtctttctcaagagctcctcacgtgtgtggctctcagggattctgcatctcacattagtccacacttatcctttatcattttagctgaattattcttacctatattgtatagtatctgacatctctttctcctctctaccacaagtgagctggtgcttattttctctctctccctgaaggtacctgtttgtccttagatttttagggatctttgttgtcctgtgacctcagattgctaatggttttaagaaagttatgatatcatagtttatcgggttttttttccttttcttaaggtttggaggggccctcactccagctttgtgcaccctaggcagaagcaggactgtagacttcttttcagccctgtcttgtacctcagccttcggaggtcacttatacctctggttctggaggattctttgttctgtagttgtaactgatttgcttgttgatggctcttcagctccctgttcttgcttgcttctagcatttaggagaattgagaaagttatgagcttagtgctctgtccctcttccaaaattttttttaacattttacatctcctgttgtcgccaccatttttaactgttattgcagagcttgagatttttaaccactgtaggtaatttctggttggcaattaagatggccctttacaatctgataaggaacagaagtatagcaataggaggagactcctttgaagaatccagaaaaatctattcacatacctcaaatcaggaatagatttcagtaaggtgtagatatacagtgtttttcaaatttttgtcagtcaatcaagaaatacatggttactctcattacgaaagtatacttgcaaaatgaaaatgcatattcagatatttcctcttctccattaaaaaaaaaagaaaaaaagctggagccacacctactaccttgattttatgacccacaaaggaaattgccaccaccaatttgtaaaagtttgtagtgtaggttccaataaaccagttacagtagaattgttgcctcatttgtacttggcttgtgaatacttgggagattttctaactatgttttgttattttttactgttttatttttgtactgaaaatacatcatttcaaaaatggattgtgataattaaattttctcttattaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggtaagtattttattaaattattatttattttatactaattggaaattgctatatgtcaaatatggatgaagactagtaagaattccttgcttgagattttttctgattttttaaatcttctgggtaccatttattatacataataaatgtgtagttccttatttatataacatcgttttgacataggaatattctaattaattgaaatatatatttcatatagtaacattaagtttatgtgcattatatatcataaatatgttatatattaattagaaccttcgttttatatgtcattggcttaagtcttcgttttacctgacttgcaactataatttaaaaatactgaatatataattgaagtttgttttggtctgaagtcatcattaagaaaaggttattttaattttctagagacaaggtcttgctctgtcacccaggctggagtgtagtggcatgatcgtagctcattgtaaccttgaactcctggattcaagtgatcctcccgccccaacctcctgagtagctgagactacaggcacatatcaccatgcacataccaccaagctaattttttttttcttcaagtttttatagagatggggtcttactctgttgcccagtctggtcttgaactcctggcctcaagtgatcctcctgctttggcctcccaaagcgctgagattacaggcattatgtctggcccaagaaaatcatattttcgattgcattgtcattctgtgaatatcagggactttaaggagttagatttaacccctatatgactccaccctaaggcatttcggttcttatttcggcttttcttgtttcattttgtttcggtttttgtttttcccttgctgtcagctgatattttttcctgtgggtgtcacacctatctccataacatcactattcattcttttaaaatgctgtctcagtgttttagtgtatgaactaggtaatcaaatctaaggctgtagtggaataaataggccaagtgtggcaattcttataagcaagaaaagtatttgcgtgttcatttgaatgtatttgggaatgtggagccctcttttgttatttcaaaattctaagttaattccatataatgttgctgttttgtgatcttttaagccataacatcattttgtacacaaaaatgtaaagataaacaagtattccttgttgaatttcttctcttttaaaaaaaattagagttgggttcttgctctgcagcccagactggagtgcagtggcgtgctcctagctcactgcagcctcaaactcatgggcacaagcaaatcccatctcagcctcccaagtagattaaattagtagggacaacaggccctgctaattttttatttttaattttttttttaagacacgatctcgctgtattgcccaaactggtctagaactactggccccatgttatcctactacctcagcctcttaagtagctaatttatttttataaccaaaaaaatcatgtcacttgagccctcttgtacttatacttagaaattactaaaatgttaattttttctttgaacatgaaaattaggtataagagtataaatatagataattatattttatgtcattgaagtttttttttggaatttggaaattggaaaattattttgaaacttcttaaacatattttatttatttatttaccttacaaatataaataagctctctgtccactgaggttgtatagagaaatagggttgtttttcattagggaaagtgagataagggaagtagatatctgtaagacattccagtgatcccatttagctttgttctgaggactagatttttattttatctgtgtctttgtgtttctcagtttttgtggcagaaaattaagatttaatatagacagtaagattttgaataaataatgcttggttgtatcaagtaaaagtttttttttaaatggaggtaaaaccataaatatcaatatatatttaataagtcgtatttattaataaccttaagaatataattctgttatcttacaggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacaggtaagcttttcacaagtatatttgtgtggaatgcaatatttttctaactttttaaagactttgatgtcttgagtagtctgtttacagtgagattttattttattaattatacataacttagtgattctctcttccttaagtatattttggcaaaatcaattatagtctttgcattttaaaaaacctagaaagtgtttgaaaatttctccttaggtaattaggaaaactataaaatttattatctgaggaagtatatttgtgcttttttgtggttcattataaattacatggctatggaaaaaatgaggaatttctaatgtaatatgtttattcactttgcaaatacattatcatcttatcttctctgtcggttgttgctgtggctctgatgctgtaatttaaacgaacatgcagtagcatacaaccttattcgttaacctgtattcgttaagcatagggttaggaattaggcggataaccaaatgttcaaatagttcgagagcttttatactgtgtcctctgtgtttctgtgctatttctaattgcccattctgaatttatgccctattttccaacttgaatccttctctatttatacttctcaactgccctcttccttctttctgtcatttttctttgatataattctcttgcttgtctcttcaccttatttttgtctcattttttacttaactaactcccattctctacttctctttagcttcctatgagtctgtctttccctcctgtgctttctttgatcaattgtatatttttaaagcagctttattgagacataattgacacagaataagttgcatatctttaatgttataccattttataagttttgatatgcatacatttctgacagtttatgtacagttgtattacttcttccttaagtattaggtagaatttaccagcgaagccatctcgtcttagagtttgcttgtgggagatttttaaatgatagttttcatttctttaataaatttggggctattcaagttattttttcttgagcgatcctccctaatttcttaaaagaatttatccatttcatctaagttgtaaaatttaatggcataaagattttcataatgctccttatttattaatatctgtaatgatgtgtcctccctcattcctgatatttataatttctgcctttgtactgatcaatctggttagcgatttatccgttttattgatcttaagcagtttttggttttatttttttttctttttttgttttctcattcattgatttctgattcaatatttattattctgcttactttaggttcaattttgctctttttataagtttttttaggtgatagctaagattattgatttgaaacatttcttcttttctaatatatgacgtgctataaattggagtactttataatattgtgctatgaattttaagttactctataagtctgtgtagctctcttctctctggtattttatcatataaactagctaccttggtttctcttggactctcagctcttatcttctctactctggggctttcctggccttcccctgggtcccccctccctgtaccatggcctgttaattatggtaaaacaatagtaaactgggacaatcgtagggctcacctcatttttttttccaactctttggaatcactatccatttttgatgtcttgtgtcttgaaaactatttttaagtcaattttgtctgtcttttttttgggggggcagggttgtttcaagcaggagtgttaaaccattcatgttactccatcctagatggaaggagaaatttctgtcacttgagcatttattaagcaccaaatctatcccaggcattgtgctaagaataagaaatataatagtgagcaatctttataagggattaataagtaatccctacctcattgggttgttgtggtaggtactgtttaataaatatagtgggctggtgcataaaatgggatcacattttgaaaaggttctagaaattaggtcaaaaggagacaaaactagaggttggaaggataatttggtaactattgcagtaattcacataagaattataggtgacttagtctaaggtaagggagtgaagtagtggagagctaaccagaatttatagtaactgatggttgaatgggtgtgggagttaaaggagaagagaaattaaaattcactttaggttacaggcttggaaatcagcgtttgatgatgatacacttcactgagataagacagaacaatgcagaaaaacccagtagaatagagatagtaattatttctctaatgggcaaagtagcctgaaagtggttgcatgacttctacatggagagatcttgaaagaaatccagaaggcagtggaatatatgtgcctaggtgatgcacataggtgatgttgtttagacttctaggtttaggagttcttagtaataatttgtgctagtcactgaagcctttggaatgagcacagtcacaaagaaagcttgtagagtgggacatatgaagaagaatgctgaggaataccagtgtttaaataattgacagaaagaggaaccctcaaaagagacgaagtaggagcagacagagagatgagaagccaggaaaatgtatttgaggcagcagtgagggtcctgctgatattgttaaccatgaattaatagtgtatcatttttttttcatgcagtacttggtattttgtatttggaatccaacagtcagttggattgagacaaaactgaattttttgccaagcaagtgtgaccgaaggtagtggaacaggattttaatgattgagaatcatgttgatggataatagagaggtgatatagtttggccatgtccccacccaaatctcatcttgaattgcagctcccataattcccacatgttgtgggagggacctggtgggagataattgaatcatgagggtggttcccccatactgttctcatgatagttaataagtctcacgaactctgatggttttaaaaggggaaacccctttgacttggctctcatcctctttttgcctgccgctgtgtaagatgtgccgctgtgtctcctttactttctgccatgcttgtgaggaaggggtccagtttcagttttctgcaaatggctagccagttttcccaacactatttattaaatagggaatcctttccccattgcttgttttttcaggtttgtcaaagatcagatggttgtagatgcgtggtgttatttctgaggcctctgttcttttccattggtctatatatccgttttggtaacagtactatgctgttttggttactgtagccttgtagtatagtttgaagtcaggtagtgtgatgcctccagctttgttctttttgcttaggattgtcttggctatacgggctcttttttggttccatatgaaatttgaagtagttttttctaattctgtgaagaaagtcagtggtagcttgatgtgaatagcattgaatctataaattactttgggcagtatggccatttaccacagtgagataccatctcacaccagttagaatggcaatcattaaaaagtcaggaaacaacagatgctggagaggatgtggagaaataggaacacttttacactgttggtgtgcgtgtaaattagtgcaaccattgtggaaaacagtgtggcgattcctcaaggatctagaaccagaaataccatttgacccagccatcccattattgggtatatacccaacggattatgaatcattctcctgtaaagacacatgcacacgtatgtttattgcaatactgttcacaatagcaaatgcttggaaccaacccaaatgctcatcaatgacagcatgaataaagaaaatgtggcacatatacaccatggaatgctatgcagccataaaaaagaatgagttcatgtcctttgttgggacatggatgaagctggaaaccatcattctcaacaaactaacacgggaacagaaaaccaaataccaccacatgttctcactcataagtgggagttgaacagtgagaacatatggacacaggagggggaacatcacacagcggggcctgttggggtgggaggcaaggggaaggatagcattaggacaaataattaatgtatgtggagcttaaaatctagatgacgggttgatgggtgcagcaaaccaccatgccacatgtgtaacaatgtaacaaacctgcacattctgcacatgtatcccagaactagtataaaaaaaattagaattatattgttttgtgctgtaaatagcttttttcttaataatatgctgtaagttttcatgtcattattttgagtgcataaatttttccaaatattcctgtttttagaaaatctaaatctgccttttgttagaaatttgattctaatatatatacagttttgctattataaataacactatattgatgattgatatctttattacatcagtacttttgtaattgtctactcatttctttgggataattcatttcctgaggatgagttcctagaaatagaattactcagttatagagtgtagccagtttttcctgaaataattttaaaataattgataattgaaaatgcagttgctgggcacgttggcttacgcctgtaaacccagcactttgggaggttgaggatggcagattgcttgagctcaggagtctgagaccagcctgggaaacacggtgaaaccccatctccacaaaaaatacaaaaattagctgtgtgtggtggcatatgcctgtcatcccagatacttatgggactgaggcaggagaatcacttgagcctggaagattgagactgcagtgacctgtgttaatgccactgcattccggcctggatgacaaaatgagactgtctcaaaaaaacaaaccaaaccccagaaaatgcagtttagttacaacttcttagaaagtgcataaagaaaaataggaattcatgtttgtgactaggttctttatacattaatccaacttgactgcaatttagcaaatatttattcattatatggcacatgccaatcatctaagtactgacaaaaagcaaagaataagatgaacatagttcctgccctcatgaagctttcattctaattaaaaatatagaggacataataaactattaaaatgcaatatattaaatgcagtgatggaaaaagtataaggtgcatgtgggagcacgtaggaaaggtgtattttatccatatattgggtagtactgataagaaaagtttttccagagaaagtaatcttttgacataacagttttctttctcatagtttgtccaaaggacagaaatttactcaaagatatatagatgaagatatagatatagatatataaaatacaagtatttattatggtgaagaattggaaaatatgaaattttaatcatagaaggttaattaaaatactagtatagccatttattctgatatggctattaaaattatatatgcatcctagcctaactgaaaaaaagaaaagaaaacctatgtgtgcagcattccctatggggcttttagattccttaacctattaccattaagcggagactgcaagcatgcaggcatatgtaagtttggtgtcactctatcattcattcattaaatggcttggtacaaggcattttgggagatccctgatgaactctcatatttctctcctattgattaaatgattgccaaaattctacagtcatggtgttatatcttagtttaaggatttgctgctaattaaaatataagtacattattgaggagtaacactttgagattgtcactttgaggtacaatgggaggcttctatggtcacattgttacttgaaggggttcaattgacctacatttttcttcattcctgagcatcagtcttacctttataagtgcttggaaaggcaaatatagttcaatttaaattgtatgtattcagctattttaactcatagaaataaaaattgcatatggtgctacttattttttataaagtaagggaatatgtgatattctgttacttacctaaatcagtgagttaaaatgtttttataatgatgtcttatataatgtttgtttacaaattacatagagatattttttttttttttcccgagacagtgttttactcttgttgcccaggctggagagcaatggcatgatcttggttcaatgcaacctccgcctcctgggttcaagtgattcttctgcctcagcctctcaagtagctgggattacaggtgcccaccaccacgcctggttactttttgtatttttagtagagatgggatttcaccatgttggccaggctgatctcgaactcctgacctcaggtgatccacccgctttggcctcccaaagtgctgggattacaagcatgagccaccactcctggcctacatagagataattcttattttaatggtttactatacaacttacaacttatatacttttgcactttttaccatattccaaaattgtatcgaaaaatacatatttttcccctttttttttttttttttttttggagacagagtcttgctctgttgaccaggctggagtgcagtggtgcgatctcggctcactgcaacctccacctcccaggttcaagcaattctcccacctcagcctcctaagaagctgggactacaggcgcatgccaccacggccagctaatttttgtatttttagtagagatggggtttcaccatgttggccaggctggtctcaaactcctaacctcaagtgatctgcccgcctcagcctctcaaaagtgctgggattacaggtgtaagctactgtgcgtagctctatttctgtataatatagaacactcagctcagtgtaagtcacccaggtttctagtgggatagaacatcactcaactcattttgacagataaaaaaaaagtctgatagatattttccctttatacccaacaaattattgatttctgctatttgcatataaaaggataaatttaagttaatctttttttaactacctgaatgtatatgaaacaatttaaaagaatgttatctctacttatagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggaggtaactttttttggatacttatcaatttttgttttgcttgttgaaaaatactgcttggggacataaggcatcatttgagtggaatttgtatatacataatcaccttggtcagaattgaaatagtgattatattaaactagaattcattttaaaatggtcttgatttattcttttaacaaatattactggagataaagtggcaaggaagcaatgacattgtctctgacttcatggaacttgccagtctaatgcaggggttggtggtgatggtgatctggaaggtatagtagtagttagatagtaaaaaagtaatcagacacataattaaaatagttataaattgtggtaaatttaatgaagtgaaggggtggcctgcacctccacacctgtgggtatttctagtcgggtgggatgagagactgagaaaagaaataagacacagagacaaagtatagagaaacaacagtggacccaggggaccagcactcagcacaccaaggacctgcactggcaccggcctctgagttccgtcagtttttattgattattattttcattatttcagcaaaaaggaatgtagtaggaaagcagggtggtaataaggagaaggtcagcaaaaaacgtgtgagcaaaagaatctatgtcataattaagttcaagggaaggtaccatgagtggacgtgcacgtaagccagatttatgtttctctccacccaaacatctcagtggagtaaagaataacaaagcagcattactgcaaacatgtctcgcctcccaccatagggcggtttttctcctatctcagaattgaacaaatgtacaattgggttttataccgagacattcagttaccaggggcaggcaggagacagtggccttcctctatctcaactgcaagaggctttcctcttttactaatccacctcagcacagaccctttacgagtgtcggactgggggacggtcaggtctttctcatcccacgaggccatatttcagactatcatatggggagaaaccttggacaatacccggctttcaagggcagaggtccctgcggctttccacagtgcattgtgccccaggtttattgagactagagaatggcaatgacttttaccaagtatactgcttgtaaacattttgttaacaaggcacgtcctgcacagccctagatcccttaaaccttgatttcatacaacacatgtttttgtgagctccaggttgggtcaaagtggctgggtcaaagtggctggggcaaagctacaaattaacaacatctctgcaaagtaattgtttaaagtacaggtctttttcaaaatggagtctcttatgtcttccctttctacataggcacagtaacagtctgatctctctttcttttccctacaatgaaggacacaaataataggcatggtgctgtagtcaattagatatattaatatagaatttattggaaagatctaggttagaaatactaattttggtgtcaccagcatatagatggcatttaaagccatggaaatatatgaaataatctatacaaaggaagagaaagtattagaagaattcataagttgaaaatgaaaatggcaaatgtgtcaccaccttagttttactttcttattggttgacattgcttcaaagatctctcatggaactgcccacaagttcatatttttttcccttgactggatgaaagtcaaaagtgtgtcataggctttgctgaagtgatagcaacatatgctctgggaggtttctttaagaaacctacttaacaaatccttctccccacctcacagtttccctttctatttctttctgtaaaaattttattgattatgagaaaaccatcattttagagatttcagactttttttcttttttttttttttgagatggagtctcgctctgttgcccaggctggagtgcagtggtgcaatctcagctcactgcaagctccgcctctggggttcacgccattctcctgcctcagcctcccgaatagctgggactacaggcatccgccaccgcgcccggctaattttttgtgtttgtagtagagacgggatttcaccgtgttagccaggatggtcttgatctcctgacctcgtgatccaccccccttggcctcccaaagtgctgggattacaggcgtgagccatcacgcctggccgagatttcagacttttaagtcaaacgtatattcagagcataaaacatgatggcattatgaaaatcttagtgtgtaagataataatggctgctttaacttacagggtaggagatggaagttatctttttaagataaatatttgaagtctatttatattggtaagataacagatagaaactcataaaacatatagaaacttataaaacataaatattatgttccacccaacatgctggggcagttgctatcccactgggcccagttattaggcatatttgtgtggggcagcaaagacactgctttctcatgctcttcccaggtagaatccatacagaatgtcctggtgatgctgccaacaatctgcaagtgcccagctgccttttgaggccaaccctctagggtaaagttggggcttcccttactctaattcacctgagtagttggttagctgctgttgcagctcaccccagagcccagatatttgttctctcctgggcctcatcttctgtgccagggagaggctagaattggttgtgaaatcatttagtctaatgcatccagaccaagtggagcagcttgtgatttctgacttgtcagattttcagtggttgcatacacagcctgtcctgacatgtagatactgcagatcagcagccccaggatccttacagttctttgaacttcctccactgagctcctggcaaaagtgaaggaagagtgccaattaataatcagtatttgaggtgcatgcgatagacagatactaactggaagacatggtttagaagttgtaatatttattttcatcttattatatgaactctttttgcagtgtctgctacatagttacaaactaagtgtcatgaataaagaatgaaggaatgaaagcttaaaaaaaaccccaaacattagtagtatgtataaggtacacatggacttaattttaaaacactaaattagtgtgtcatctttgaaatgcagtcaaagaaagcttggttacaagtaaaacttgttaaatattgtgggattcaaattatctccttggggtcataacagctaaaaattctttttgttgttttgacaaacttagaagtgagccaaactcaaagatcttttttacattatttctgttgtgttagggttctccagagagagagagagagagtgtgtgtgtgtttgtgtgtgtgtgtgtgtgtgtgtgtgtgtgtgtgtaaagagagggaaaagggagagacttattttaaggaattggtgtacatgattgcggatgccaccaagttcaaagtcagtctacagggtaggccagcaggaaggatatccagggaagaggtagtgttggagctcgagtctgaaggcagtctgctggcagaattcttgcttagaggaggtcagtctttttttattgaaggcctccaacttcaatacaaagcaattggatgaggtccacctacattatggagtgtaatctgatttacctagagtctagagatttaaatattaatttcatctaaaaaatattttcacggaaacattttatgtttgaccacatacctaggtactgtgactgagccaaagtgacatacaaaattaaccatcacagctattaaggcaggtcttatgctgttgatttgggactaaatttgtaacagctaggatttgaaattggctctttattttttttttttttttttgagacagagtctctgttgcccaggctggagggcagtggcgcgatctcggctcactgcactctctgcttcccaggttcaaacaattctcctgcttcagccacctgagtagctgggattacaggtgtgcactatgcctggctaatttttgtattttcggtagagtcggggtttcaccgtgttggctgggctgttctcttaactcctggcctcaagtgatctgcctgcctcagcctcccagagtgctgggcttacaggcgtgacccatcacacctggcctgaaattattagctctttgagttagttcctagtttatgtgtggacctaagcatattaaccatttagcttcagtgtcttataaatataaatatcaggattgcattagctgggcatgttggtacatgattgtaatcccagtttcttgggaggctgaggtcagaggttgagcccaggagtttgaggctgcagtgagctaggattgcaccactgcatgccagcctgggtgacagaatgagacccattcactaactacctaactaaataaatacatttcaggatcatattccatagacctaggactttttcgaggttcaaataaaatagttcatgtaaaacacattgtgaactctaaaatttttggtaaaccaaatgtatcattttttattctacatttgtaaaatgaggtgcttactaaccaaaaaaatccaaagtagacagataactactgaaagttcattttaaaggtttaaaattactatattatttggtacattaataacaaatagttctttattcataacttcattggtattaacacctaatttagttctatatttcacaagctactaaagagcacatggtcatttagaaaactgaatattcagtttgtaaaaatgtttaattggtgtggtagaggattgaaacagtctttcatttttctcctctgagaattttaactgcagttaaattctgcaatgaagtagcagtgctaaaaagaacaaatcttttttttttaacagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggtatgtttttaacttcaaatttctttctgctttcctctttctctcttttttcttctatcttcttccctccccttccttctgtcttttccctccttcctcccctctttctccctcctttccttctttctttccttctttttgtttagtttgggcaaaataagatttgtaaatctgtttctaatcagctaattccattcagacatctctaaattgtctatgttattagtcgttgtgttgattttttttctttgaatgaaagttcctagttctgttgtaacaaaattcctcagtatatattcatgttttcctgacttccctgtagctcctcattttccatttttctccctttcccccatcttctccctatccctagtgtggcatatatcccaaatgaatcttttatattgatattaggaatatcaaagtattagaggtgcaaagagaggatgatcattagtagatggtggagtttaacaaatatttgggagatggatggaacagagtagaaggaagcagaacttagaaagagccttcatctaatgttggatccagtgtgctctgtggaatgtggctggtttctgagctcagcaccagcgcatacagagggtcagttagtgctgggatgacattgctgcataagcataaagttctcattctggcattataggggatcctcagacctacctacctcaaaatgaaacctactagttcacaagactcacctttgcaaagccctgaggtgttacacagcatttttactcagggagaatcctaacagaaaaccagctttacatttacagcattgtaggaaaccccacccttactagctggaataatcaaactagtcctttattgttaaatatgaatggtcagatatgaagaaaattgtaaaaaccccaagcatgaatgaaattaagataaatagaatcatgttttctgaaggaaacagacaattgaggtgacagaaaaggaagtagacaaacaaaaaagaagctctgacattctaagaggattttgagaagataatataagaaatggatcccaccaccaccagctcacccaaggataggagagttgctggaaatccaaatattattgctgaaaatttgaaacaaaaacactgaacatgtaattagaagtattgagttggaatatttggttgaggcaatctcccaggacggagaataaaaaagcacagggatggaaaatgtgataaaacttaagagtgatgttttagttcagaaggtccaattccagaatgagtgttacagaagaaataattgaggaaatggaaggcaattctttaaagaagtatagtactctccttttatctgcagggaatatgttccaagacccgtcgatgcctgaaactttgggtattaccaaacctatgtttggatagtacccaaactatattttttcctatacatacatatgtatcataaagatgaatttataaattaggcacagtaagagttgaacaactaataaaatagaacaattataacaatatactgtcataaaagttacgtgaatgtggtctgtctctccaagtatcttaatattttcagacaccagttgacctgaccacaggtaattgaaagtgcaggtaagggtgagctgctgtaaactgtccagacctaagtaaatattgaaggaagctcttagctataatgaatctactgagtttccagcagattgggtaaactaagattccacatacaaacacattttcatgagatgtcagaatggtaaagctaagattttctgaagtttcagaaaaaaaaaaggctgcctgtcagggacttagaaaaaaaatgattgcatgattgatttttgttgttttttatttatcatcaataaaacatgatgaaatagaatccctggatggtagaagacaatggaggaatctattcagaattctaaggaaagtggtttttgaagctcagattctatacacagccaagccatcacccaaaatgtgaaaagaaaataattctcagatttcctgtgactcagttttcttagacttcttcatacccattcgtaaaagaaattagtttgaaagtgtatttcagaaagtcaggaaatctaggaaacagaaaaatatggggttaaaaaaacctaggcctactcaggagtgcactgaaaaggaatctccaaattatctatgtgaataggctagaaattaactggctttcattaaaaagtaaatgagaatgctttaaggaaagaaaaaaaaagccatatggaagaatgtcttatagaagaaaaatagcatgaattccacatagtatgtaggatacagagttagctatattatataactgatacagacaggaaagtgttttctgcgcttaagaaagaaatttctataccatggtgcagaagtgaagtggactaaattttgcataattttgagccattgttagaatgtgagaagagaacctcttatttttcagagatgcactcatcgtgacagtgtagcagcagaggcagtattactgtaaatctcattgaaaaatactacatggtcatagttaaacaacacatggaatacttcttatgtaaataaaaaagtaaatgttatgaactatgataacttagaagtaaagacattactaaccaaagctgtaaagaggaagatggatcaggggaaacaaatagtaaagccttaaagagtgagagaaaatgtctgcaattgatgtaacaagaaatagatgtttgaatatgtcattttaatcgttttcttctggaaatttttacacatataccaaagtagaaggaataaggtaatgaacccacatgtactcatcacccactttcactaattttttttttttttgagacagagtctcgctatgtcacccaggctggagtgtagtggtgcaatctcggctactgcaagctctgcctcccgggttcacgccattctcctgcctcagcctcctgagtagctgggactacaggtgcccaccaccacacccagctacttttttgtatttttagtagagatggggtttcactgtgttacccaggatggtctcgatctcctgacctcgtgatccccctgcctcggtctcccaaagtgctgggattacaggcgtgagccaccatgcctggcccactttcactaattaatatcatatggctactttgttactgcccacactctgctcttcccccttcttcctccagcccataagattattttaaagcaaatcccagatactataccattaattgctatttttccataagcaataaggacattactttttaaatatagtaacatcatcaccctaaatattagcagtgcttccttaagaccatgaaaatatccagttagggttcatctttctcctaaatgtctcattacaaggcctggttttttttaaataatgataaaagtgtcaattcacaaagaagatgcaacaatcctaaatgtgtgtatacctaataacagaactttaaaatatatgcagcaaaattgacagaactaaagaagaaaatacacatatacagaatcatagttggggatttgaacacaccactcttggtaaatgataagatatgaacaaaaaaatcggaaagaatatagaagatttgaacacagtcaacaaaattgacataattaatgtaatacaatgttacactcagttgcagaatacctttttgtttttaaacacttcctggaatgtttacaaagatgcaccattttgtggaccattaaattttctgaccacattggattaaattagaaggtagtaacaataggatgtgaaaaagcttgaacaatttctaaataacccatagatcaaaaagaaatgacaagggaaattaagaagttgtttgaactgaatgatcatgaaaataaaatatatcagaatttgtggaatgcaactaaaacagtggtgaaagaaatttgtaactgtagagtaagatattagaaatgaataagttttaaaatcaaagattaaatcttctaccaccagaaactagaaaaagaataggaaattaaacccaaagtaaatgaaaagaagacagtaataaaaataatagaatccaacaaaagaaaaacagagaaaatgtttaaatgtatattttttcaaaattttagatttctgttcattaaagatacagtaacaagataggagaaacccaagcctcagacttgatgtatgtatcttttatccagagtacattagcacttttataaattaatagcaactttttaaaagcaaaataatgaccaaaagatttggatacttgagagaggatgctatgtaaatgggcagtgaacacatgaaaacttgttcatataattttttttttttttcttttttgagatggagtctcgctttgtcacccaggctggagtgcagtggtgtggtctcagctcactgcaagctccgcctcccgggttcacaccattctcctgcctcagcctcccaagtagctgggattacaggtgcccgccaccatgcctggctaattttttgtacttttagtagagacgggttagccaggatggtctcgatcgcctgacctcgtgatccgcctgccttggcctcccaaagtgctgggattacaggtgtgagccaccatgcccagccgttcatataattatttatcaggaaaacttcacagttcaccagatgagataagttgtagaagactgacaacatcaaaggttgacaagaatgtggaacagctgcaattctcacatacgactgataggaatgtgaaatagtattaccactttggcaaagaatttgaaagttaatatgtacctacctttaacagagcaattccagacctaggtatctactcccaccccaccccaaaataagtgcatatatacacaaaatgactcatttaggaatacgtatagcagacttatttatagtagcccaaatctggaaacaactcaaatgttcatcaataggaggataaactatttcattccatagagtgcatgactagctataagagtgaactacttgtacatgcagcaacatggttgaatctcagaaacattattttgactgaaagaagccacacacaaaatagtacaatctgtattactccatttatatggaatttaaaaaatatacaaaattcgtctatgatgattgaaattagaatggtagagaggttgggaattggctagcaagtgttaagagggaactttctggagggatataagtgttcagtatcttaattgaagtagtgactatgtggaaatatacacttatcaaatttcatcaaatagttcatataagatacatgtatttcattgtatgtaaatttttatcacaattgaaaatacattacctggcataatggtacttttctctgaagttagatataatgagaattagaaagtgctgcgttttcattttaagctcatttaatatgtgcatataatgccttgattcaaaattcaaatgtagaaaacaaattttgaattcttctgattagtagaaaaattttaaaaatgtctcttggttttagttttttaaagtaaaatttgaatactgaattatgtgccagttactgtaatatgcattttacatgtgctattttacttaatctccaaacatactcagtgattagttctatttttccttggaacagaacagaagtaggaacagaagcatcaagaggaaatagaaacaccaagtgttcaattaatattcccaaattattatggaaagagtcctaagccagaagttactgagttttacatctgaattttctaatattttattttcttgaatgtcattttactatacctgtttaataattctattaaatctatttcaagggtattttaatgagctacttttcatgatattttcttttattaaataactttaattttttcaaggagcaactgtggtgacagctgctgtggtagaagtacattcacgtgccttactagttaagacaacactaaacataagcttcaaaactgatgatctcaccatggtgctgtatagtccaggtcctaaacaggtaagtccaggaagaaaagaaaatgtattttcacatgtgaaatttgcataggttgatgtttttaaagtaacaaatgttaatatttaacatttattttgtagtatctgtccctctgagaaaaatgatctttttactttaataataattataactatttcccttttaaatgagttatctatcatatagctaatgtgaaaaataaattgtaaaattaaagtgatatgtatatatttttagcctttcattagagcccttcggagacagaattttgatgtttgttataagcagaggcaataatttgtagtagttcatatcatgaaatacactttagacttgtgtttctttgtaattttgtgttggtttctcctttcataggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcggtatgtattgtaatgatgttctaaggttttacttgagaaatcgttgatatattttacagaattcatctccagaattgcacgttcattttctgagtgcatcctaggttctttaaagcttcaattcagtcagctcgtagtactcggttaacatttaaaatgtcctggttctgttatgtactattcttactggataattgatagattggttgagtaactagaaataatcagtgcaattaaattggtttttacattctttaaattacattctctaatataaatctaatataagttattgttaatccatgctaattgcaatgggaagtacataaaaaattgaaaagaaaaaatatcctgagattcaaactcttataatttattgaacatacacttcctcatttatgatacatttgtgttccagaagtttgtaagtttgttatttggaacactttatggatcttcccaagagacatgacttcagaatgcttttttttgtcagtaaaagagataagaggtctttgagttttactcatatgtttgattacttctaagttactcatacataggaattgttgttattgtgttttccagaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaaggttagttattggctaaaatatttaatatttgttttattgaagtgctacaacaggacttaaccttgattagccttttagatcatcaaagtaaatgctttaagaaattaaaattttatttttcagagtagaaggaaaaccttaatgtgttttcttggaggatgtatagtttgcattttttaaaggtgtcagtatatattgcatttaaaaattatgaaacctatgttagaataagtaattgtacttctcttcaggcagtaatttgaaggaatttgtctagtggaaaaaaacaagcagagcaaataatgaaccaaccataccttttcacaattaagataatatttcaatttaaagcactcatttatttttgttgtatttattcctagcttttaacgtacggtttctctattatctttttataatatgtgatttactgtggtatagtagaaagagtatcaagttgagagttagaaactagattagtttctaggctttccaattaaatagtggagatttcccctcatttaaaaatgttcttatgcctatagcttcttcaagtctttactaagggttgtagttgattcctttgggatctaagattcttttgttttactttttactattatttcattttaatattttcttataaataataaattattcataatatatagcaaatattttaatctatttttatttgttttagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgtgagttaactatttgatcatctgcttaattgtaactattttggatgtagtgtataccattttaggaaacaaaaactacctacatgctttccaaccttgctctgtaaaatgtctttctctctgcttagagagcttaatttagaatattatttaccagctttgaaactctttcattcttccagatgctgctcattattgttagtatttgtgggaatattgtcactaagaagttgggttcatcttgacagttttcagttaagatctactttgactttctaaccatgtcaattccaaattgctctttggacttttaagactttctgccagttgtttgctgtgttgtttcaattttattgtttcaacttttttctcccgtttggatgtttttgctcaaataatgagtttttccttgtctccatgtaacttcatttgaaccttcagccatttgctttgacatacttcacattgatattttactctctagtaacctcttggccttcctcctcttcataactctacttaaaattcattcctttacagacatcttttcaagttaactggctgacttccagcgaatacttacaaaaatatttgagcttctgaaggagtaatagaagcataagtttttgtttgtttctttgtatttttttcctgatgcttggtatgcatctatagaagcataaatgttctaaacattgtcaccatagaaatataagatgtaattttgatacaatgaatacatatatattaggatataagataaactgttgcccaaatttgcaagacagttggccctccactaagcaaagagagagaatagaaaatggagggtataccaattctctcttagtttttgacttagaagttttaaatatatatttcttctattcacatcttttttggcttgaatatagctgtatgaccacactttacttcagtaaaggttggagactgtggtatttttttctgagctaccttgtgctcagataaaacttctattactgtggaagaatagaacagatattaggttctagatgtcctttatatgggataattaaggagtgtattattaagtcactttttaaatagttgtttttattaacttgtttatttgacatacctattactaggaaagtctttaaatagaaatatttttatatttaaacattaatttagtggtattgatttttctctcataggttttgcagccctgtgacttgttttatcaaactactcagaaaggtacagatccacaagtgatcgatatgtcagtaaaatccctgacactaaaggtaaattaaaatataatcatttgaatatttagtgcacttaaaaaaagtagtaaagcctagaaagttattatagcaagtcttttaattgttatgcaaacaaaataggtgtgtttttgaaaatacgtttttatgagatatttacaaagtaatattatttaatacacattttatgaatgttattctatattttattatttacatttgtgtggttaacatctaatatccctaataaatattattgaaattactttatacttcatcagtttaataatatctgcaattcatgtatattaataatatcatgtaattcatggaataatatctgcaagattcatgtaaatatctgcaagattcatgtaaacacataacaagaattatggtaatttaaaaaattttataaacaataaattgtatcttctattttgtggtagtaatgttaattcagtatttaatttctcataatatatatttaatatttcttgacgtagtatgtttgaaagtgttttgtatagacttattaatttttttccatttaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtaagcatatttttccagttttataacagataatgatacgtatggaatattatgacagataatgatacatatggaatattatggaatcttgtgtagctatttaagcttattgtaaatatgatattgggtcaaaaacttttagaaaaaagttttcaaattttgcccttgaataattgcttttatgtatacattccttttacttttaaagtacatgtccacattaagtttatatttcaactgattttatcaacttaaagataatatattattcgacagttgttgattagattcagaatattttttttaaagagttaaattgaggccaggcccagtggctcacctgtaatcccagcacgttgggaggccaaagcagaaggatcgcttgagcccaggagttcaagatcagcctgggcaacatggtgaaaccttgtctctactaaaaatacaaaaaattagccagtggtggtggctcacacctgtagtcttagttattcgagagactgaggtggacgatcacttgagaatacctgggaagtcgaggctgtggtgagctgagatcttaccactgcactccagcctggggttcaaagtgagacccagactcaaaaaaaaaaaaaagaaaagaaaagagttaaagttgaatacccttttttttttaaggatatagacagaatttctgaatatgtggataataatctcttctaatagaaatatgaagaattagaaatatatgccttatacttttatgtaatgtagaatcaaggaaagatgcttaaaaaggggttttatctggactaaattgtgaagagcgaatatgtactatgaagttagccaggtgaggaaaatgctgagggagtgcttataggaagctactgaatggcatgtagactggtttttatatagaagaaataacagggctaaaaaacatggtgggaaacaggatggaagatcatttttaatttaaaaaattctctctgtaggtgcattattataatgaaatgtttggtgtatgggagcctttgcttgaacccttagaaattgatcagactgaggattttagaccatggaatcttggtatcaaggtatatctatatatgtctatgtgtgtatatatatatatatgtattttaaaagactttatttttttaagaacagatttaggttcacagcaaaattgagaagaaggaacagagatttcccgtataccacctacttctgcacatgtatagcctccccctttattaacattccctcatcaacgtatatttgaagactgaaaaaattttccaaaattgagaatgtttataccacactcgacactttattttaatcacaacaaggttcaggttgtctcatcatgagccttgcccacatgcttccttgtttgccctctgaatataattttcaaatctaaggccaatgttgcctatgcttctaatacaattatgtaacaagtattatgttacttgttacataatttagaacaatttagaacataatttagaacacagtttagacattgttctaaatattttaatccttacaacaactcttggaggtagatacagtttttatttaacatgtgaagggactgagaccagggaggttaagagacttcttgaagtaataatagctacaaagtggaaaagatgggatgcaaatccagctgcagaggcgttaaatccactctaaaccactatgctataatgcctgtgtcatcatcttgtaggttgttgtctatcctgagtttccttcatcctttggatgtttgcatgtgtgcaggaatgtatattatttgtttgaaatatattgtggatttatataatcatgagaatcggggcctttaggtggatgaaattttgcttctgaagcaagagactgcagaattactcacgtgtttcctacctaataatgacttggtcaacctgcagacagattttcagtggcttaaagccagttaaagtaacaacagaggtgactagcttagcatgttgagctcttttcatattagatcacttaattttattttccagatattttagatgaaggatatgaaaaggaattccttggtggtttttaggttagaatacacatggtcagcagatctgtgactcctaaaaaatggtaaagggtattgattcttatgagctctaggtttataacactgttctgctactattgtctgcctttgtaagtctctaggtttctgttctttattattagcatgaccaatacattaagttacttttttctgtctgagtttttatgttgctttgaagtatgtgcttttatattcagatcccgggtacacatagtaattttaggtttttatttttccttctaaattgtgtctgccattttactatcactgatgatgacatgatttattttctctaatacttctgtcctttatgaccttagttggctgatgtccaagtaatttcaataaggcaatagaacttactgaaattagaaaagataaaatgtactgacctttctaatgttggtattgggatttgtctagttatgttgtgttcttagaatttttccttatatttctatgatttatcattttagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggtaagaaaagaaatttgaaactttaaatattgagatacttgtctgattgatctgtctgttgaataagaagtttaataacttagttgtcatttgtcctttactgttctccttgtcatttaattttacacatttcattttatttagcataactctttcttattaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttagtaagtagttgaaaaattaccttcctggggctattttgttttaaattacaatttacatgttattttactcttttgtagaatcttagcaaggttttttttgtttttgtttttgtttttttaaaatatcctttctaataggtcaagaactgttttttgtctttgcagtgtcttggttactattgttactaaaactttgtattccaaactctttctttatcctctgcattatttagagcatggcaatttactgctttgttgttgggaggaaaaatattagatctcgccctcattctgcttttatagaccgtggatgtttagatgtttgtgggggttcttttattcacatttggtatccgttgatagtattccaccagttttgcaactgaaagaattctaagtgtgaattcatgcagatggcaatttttaatggctttaggatttataaatggtttttttttttttatgttctgcctgttgagatgaaggttttttcctttgtcttttctgcttcccaaaagtttttcatttttattggaggtgaaatatatacattcttaaagtatcataatatgtagtcattgtgaagttaaatagtcccagagcctcacctacaccactttttgatactctggcatttaagtaattattgaggagggcatcatttaaaagattaattagacataggggggtaggctactaaaatagcttgtgtttctagttagaaaataacatgtaacaggtgtttcaggtgttgtcatagcgttgtaattaatgttcttataaattttacgtctttttttttaacatttttatggatgggatggtaaatgaaatttatgcaagtaagtaattttatccccaatacaacatgtgttttaggtaaatatatataaaattttatttaatcaagtccaagatataaaggaaaagtgacacaagttgttggaaaaattaaaaacaaaaattgtagtcaccttgatatttaccaatgtctaccaaaaggtattatgctctggttattctgacagcaaaccagagatcagtattcttgtattttatagtacttgctctcattactcatttttgaaacgtttgctattgttgtcttgggttaaactcctgaatgggagttttttaattaatgctgtggaaatatatgctggcttcttaaaatatcccttttatggactatatccaaagactctagtgactattatttataagtttaagaatcatctgaaatttctaatatgtaacatatgtaaaattaatatgtaatgaattataataaaaacttttaaacatacttacttaatttagcacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcaggtatgaaatgatcaattttgggggatgtcctgttatgcatatctgtgtgctaataaaattaaaaacaacaacaacaaattattactgaaagaatataaaccgtaacagtaatacagctgatatcaaaaagaagactcactaccaccagttgcgctacttggttatgacgggtggtaggaatttgttcaatatacttcttataattttttaataggaatattttgtaaaatcttcttacggtattttttataaatagtcatcagtgttttgctttaggtctttgtaatgtatttatatcctttctatttgattagataatttttagagaaataaaaaaattttacagctttattgaggtatgtacaataaactgcatatatttaaagttgatgacttttgacacaaaaatgcacctttgaaactgtcatcacagtcacggtaatgaacatatttatttcttagaaaaattttctgtttccccactttcccattcccaggcatccactgatctgtcctcattgtacattagttatatggcctaggattttacataagtggaatacagtacagatggagtttgactttcattcagaaaaattttgtatgtatgtgtcaacttatgtgtatccatgttattacatgcagttacttgttgttgctcagtagtaatctattatatgtatatgccgcatagccattttgagtgaacctttgtatacagtgtgaagttaagaattgaggttttgctttttttttcaccatatggattttttttccagaggattttaggtccttctcatttttatataaatttgagaatcagattatcaattttataaaaaatctggataaaattggcttgtcctttaatttttaaattctgattactcattgatagtatttagaaatacaggttatattaacctctacttgcagatttaactagacttacatattctagtagatttgtgtagatttagatagttatgatagctgcaaatgaagacatttttactttttctttttcaatctggatgtgttttattttatcttgtttatattgcctatcacactggctagaatacaattcgagtagaagtggtgagagcatgtttttgccttgtccattctttcacctttaaacatgatttgtgttgttttgtagatgccttttcttaggttgtaaacgttcccttctattcctagtgtgctgagagtttttatcagagttgattttggattttgtcagatgctttttctgtacaagaggaggatatattttttaatttgttagtatgatgaattacattcactgattctttttaaatattagatcaaccttgcattcctaggattaatctcacataatcatgacgtcttactaaccttttagtatattgttggattttgcatttatattcatgagggatattggtctagagtttcaatgtctgtctttctgtctttcttttcttgaatcttgctctgtgtccaggctggagggcagtggtgccatcatggctcactggagccgcatctcctgggtttaagcaatcctcctatctcaacctcccgagcagcaaggactgtaggtgcacaccaccacacctattctcccatcttgctccgcctctcattgtttaactttttaactcattaaagcagcagtacccaacctttttgacaccagggacctgtttcatggaagacaatttttccacgggtggggggctggggcatatagtctcaggattcctttcttaggaatagaaagctccacccatgtgtgttcccatcccctgcagggacaccaagttaacaactatctacacagaaaaaacaccttcataagaaccaaaaatcaggcaagtactcacagtacctggatttaaccacagatcatcaggcattagttaaattctcataaggagcatgcaacctagatcccttgcatgcgcagttcacgctcctatgagaatctaatgctctggctgatctgacaggaggcagagctcaggtggtaatgctctcaagcctgctgcttgcttcctgccgtgcagcccacttcttaacaggccacagaccggtacagcccatggctcaagggctggggacccatgcattaaagtatatttaacgtggggtttctgtagccaccatgtagttagaccttgttttttttttttttttttaacataatctgaaaatctgtgccttttaacagggataattaaaccacttatatttaaagttgttgttgatatggttgggcttaaacttgctattttttttttctatttgtctcatttgttctttgcttccatcttccctttgttttctctttttttttattaattgagcatttttgttatggattcattttatttccttgttggcttattggctgtatctctttatacttccttgtctttttgttgttgttgttgatactttagggctttattacatacatattgtattagtctaccttcaagtagtattttgccccttcacatacagaatcaaaactttagaccagtatacttccacttctcatctcccacattcgtataattatgttcatacatttttgtgtctatgtatgctagccaccccataatacaagttactatttttcttaaatgaattatttatgttttaaataggtttaaaatacaaactgtatttgatatttattatcactttttcttctttcagtaatctcacagtgtggatctgctggtgatgaattctttcagttttttcacatatatgtattacagatattttcactgggcatagaaatctagattggcagggtttttccccccatactttaaaaatgttgttctgctgtctgctgtattgcattgtttctgatcagaagtctgctttttttcctatatttgcttttctacaaaatgtgtcaatcttttcttcagcagcttttgagattttttttctttatcattggttttgagcaatttggttatgatgaatcttactgtagttttttttatgttccttgtatttggggtttactgaccttaaaaatgtggatttatagttttgatcaactttagaaaactttttgccattgtttctaaaattttttctgtctttgccctctcttctctcctttaggtaccagttagatatacgttagggtgtttgaacttgccccacagctcagtaatgctctgttcatttttacttttagctttttcctcgtttcttttttcatagtttctcttgctgtgtcttcaatttcccttctctttttcagtggccaatctgctattgaccccatctgatatatttttctcaatagtagtctggatttttttgtttttttattttccattgtctctttttaacatccttagtcttctaactttttagtgatattggatataattttaataaatgttttaatgtccttgtctaccaattctattacatgtcatttctggtttgttttattgatgtttcttttcattatggtaattttttcattcctttaatgtacctgataattttttattggttacctaaaactactgtatatatcagaaccagacttcattcttcctgtttcttttagacggatctttactgagccttagataatctacacatgtcctgatcattactcagctgaagttttgacagggaggggacactcagttttccagaattctgtccgtacagctcttgcctctccatgcaggtctctcccctcaagtacaacatgctgtgaatttcagtcacgttggcttccccagattttcagatcttgtctcttcaacttggctgcctgctcctcacacagcagactagaaactcactctccagacagcaagctgggtagtcatagggcttatgtagtttttttgtttttgtttttcccttgtgccgcctcttgccccgtatcggaaactgtggtttgatgtttgttgtttttcttcctgctttttagttgattagggtgggaagctatatctggtccccgttattctagcatggctgaaaacagatatcccttctctttcactttttatttagttaactattttaaaaggtgactaacagctgcactcattactgctgattattttgccatttaaatagttgaacatgaattttgaatttcttacaggtactatgtgtagaaatatttctgttgcttcaaatgtatagagcaaatagtttttctagaattaaaaatatagtacagttaagattattcatttatgaaattcttagttctcatgttttatatgctgctatgaagtttttaaagtagattttggtaagatatagaaagattataagataattgttttactaaacaacttgttattatctattccaaagataaatatgagtatttggaggttttctgatattattattattattattatatattaatcagaataatacatttttgcctgaccattatttgctacttactggatgagataatcttcatacttttctctctaaagaaaattgcaacaattcagtcacctcttcaggctccaattctaattctagttctcttgctatatccaccatatctgcagtgacttgctccattgaagtcctgaattcctcaaagtcgtccatgagggttggaaccagctgttaattttgatattttgacctgttctcatgtatcacaaatgttattaatggcgtctagatgatgaatcctttccagaaggttttcaatttactttgcccagatccatcagaggaatcactatctatgggagctgttgccttaaaaaatgtatttcttaaataatgagactaatattatttaagtcaaatatacaatgttacatataatattaagaagttgaaattactccttgatcaatttgctacagaatagatgttgtgttagcaggcatgaaagcaacattaagctcctgtacatctccatcagaactccagtgacaatgtgcatggccaatgagcagtagcattttgaaaggattttttttccctgagaataggtctcagtagtgggctttaaaaattcagtgaaccatgctgtaaacagatgtgctttcaaagtcagtctttgtttttccatttatagagcacagagtagagttagcatattcttaaaggccctgggattttcataatggtaaaagaacattggctaacttcaggtcactagcttcattatccctttaagaagagattcagactgtccttcgaagctttgaagctaagcattgacttcccttctctagctatgagagtcctaaatgtcatcttcttgcaacagaaggctgttttgtctagtttggaaatctgttgtttagtgtagccatcttcatcaatgatcttagctagaccttctggataacttgctgcagccacttgccacttcatcttgcacttgtgtgttatgcaggtggtttcttcccttaaacctcgtgaacaaacgtctgcttccaactttttttctgcaacttgctcatgtctctcagccttcatacaattgaagagagttagggcctatcttaggagaatgttatagctggtttgatcttctatcctgtattaggccgttttcatactgctgtaaagaactgcccaggacttagtaatttataaaggaaagaggtttaattaactcatagtgcagcatggctggagagacctcaggaaacttacaatcatggcagaaggcaaatgggaagcaaggcactttcttcacaaggcagcaggaaggagaagtgaatgcaggaagaactaccacacacttacaagaccatcagatctcgtgagaactcattcaccatcacgagaacagcatgcaggaaactgtccccatgatccagttacctccacctggtttctcccttgacacatggggattgtggggattacaattcaagatgagatttgggtgggggacctagccaaactgtatcatatccagaccactagagtattcttcctgtcagcaataaggctgtttcactttcttatcatttgtgtgttcactgggttaggacttttaattttattcaaaaacttttcctttgcattcacaacttggctgtttgatgcaagaggcctaccttttagcctatctctggttttgacatgcacttcttaacattaatcatttctagcttttgcttttgatttaaaagtgacagacatgtgcctcttctttttatttgaaagaggccattggagggttattaattgtcctaatttcagtattgttgtgtttcagagaatagggaggtccgaagaagagggagaaagtggggagaatgtccaatttgtggagcagtgagaacacacacatttattgattataacacatatagttaaaatgaaaagattgaaatattgtgagagttaccaaaatatgacagtgaggcacttagtgagcacatgctgttagaaaaatggcaccaatagacttgcttgatgcagggttgccacaaacctttaatttgtaaaaaatgaaatatctgcaattcacaataaagcaaaacattataaaacaaggtatgtgtatatatgaatttactacttttgatagtcaggagaaatggtattattcaaaataaaatttgcccacagttacacagctagtaatcagcactgccagtatttatctcaggtttttttcagtttaacatctatgttcatcctgctatcatattgctgttgtgtagtcataaactttaggaattgttccagcaggatagcttaccagcttacctgcaacacgcttctgtttctttcttacctttgtagtttttgagacacagggtcttgctctatcgcccaggagtgcagtggcatgatcagtgctcactgcaaccttgacctcccaggctcaataatcctctcacctcagcctctgcagtagctcggactacatgtctgcaccaccatacctggctaatcttttaatattttgtagagacagggtctcactatattgcctaggctgctcttgaactcctgaggtcaagtgatcctcctgcatcagcctcccaaagtgctggaattataataggtgtgagccactgcgcccacccacttttatacagacggatgcttccttttcctctgctcccttagacttttcaagcttatgctcattccgttttccagacttttgatctttccttgaaatttcaactactagttattctcagcttccaaccaactttttccgcactaaatttgaaagggaaaacaaaggaagcaatatcagactttggtaactaacttcacattccaaacaggcaccatttagaagcatgtgtttcttaataggctccatttacatcagtgataagttgaatgtgaagtttatttggaattatatttataatcagaaaatatgttggaaaacttgcagttaatgtctgttgtggaatgctctggatgttggttattggtttgatagtggactttgaagtttattgtaatacagatgtctccatccacaccatggaatttaaaaaatatagacatttaaaaatgtttccctcaaattaaaaaaaaaaatacatgaagttgaagtcagctgttttgtttccctcttagtccacattccctccttccttcttccttgaggtaatatcaatttggtgatacgttgtgtatatttccagtaccatattttaaaaactattattcctgtccagaaaatatatacttgtgtttttagtgtcttacagaaatgttacactgttcaccttgttttgctatgttctgttttcattcagatattcgaagtgtaaccatatactgatatataggtcattattttaatgatgttacatgattatatggatttgaagaaaattttcttatttttctattattgagattgttttcattttcatttttttttataatgaaagtggtgtggtgaacatcagtgtcttgaatgaatgtagtgaacctgaatgaatacacatgtgtaaacatttctctaggtatggaactaggagcagaattcctaagaagaaagtacattttcatttttactaagtttttgctgaattattcttcaaagttattttatcaatttacattctaccagtagtgtatgtgagttcctgttcacatcattttcaactgttgatatcaccatacttctgattttttttgcagtttgttggtattaaaagatactccatgaatataatttgtattttcttgattactaggaatgtcaagtatcttttcatctgtttattggtcagtttttccattctgtgaatcatgtttacattctgttcctgttttcctcttgattgcaacttttttaatgatttttaggctttttgagtgtggtggttataaaccctttgtcaagtatattacagatatttcccagcctgtagattgtcacttttatcatataaatatttaaaattttgatttttttctgtgaatttttttctactatttttatctaaacaaaaacttatctttaaacaaattagtccctatcctaaaatcaaaaagatattatcttattcccctgtaggatgcttaaagtctgtttttgagattcctattatataaaactatagagatttttcttgtatgttttaggataaataatatgtttgtttcttttctaatttatataagcaagatgaatattgcctgatagttcctttgttaagatagttacatggacatattttttttacacatctttagattcttagattaatgatactaaatattatttgtttttctttcccagataagaaatcatttttcagtcccactgtctgtttacgaaggggataccttattgggaactgcctcacctgaaaatgaattcaacataccattaggatcttaccggtattttgtctttatcattttatttactctaaaatctcttgtagaatttttagtttctgatttcacatggataactttgatcaaatccatcctgctaatagcttatctaacgtatttaggtttcagtgcacttagatcttaaaaaagaagtattatttaatttattgtaataacttataccaagcacactatatatgcttttctcttaaatataattatattttgattgcaatataaccgtcataagcatagtcatatgattatgagttttaaaaatgtctaatagatcatgcctggtggtttctgaatttatatatactattatgaagtaatttgtacttctcaaaggttttataatacaatttttttgaaattcctttagtaaacaatattttatccttttcttttcatatttgttcattgttcagggttggagttgtaatataaatagaagtatatactatattaattttaaatttttaaagtaattaaatttgatacaatatgttttaagaaaatattaaaattataacaaaatatgagctagtcttatagattttatatcataacaagtaagtattagtcaagatatgtaatctggaattgaaaataatctcttatgtggaaattgaaccttattggagaataaaactgttctcagaattaagcattgtagtttgtttaaataccattttagaatacacactagaaataggtacttacctcaatgctacagaaggacagaggcaaaactgcaaacagtgcttacctgttctcttgtccagaagttcagaatgggatcctcaatgctccgaagacaatctagcagttttaggcacctattttcacatagatcgacctgctaaacctaaagagtgttttattgcttagttcagacttgctgagggaaagaattgtattgttgagagaacaacaaaatagtcatttacagtatctgaccttgctctagagaggatttggggtgggttacaagactagattaaatatggcatgtaagatatatttaaaaatttctgtgaagaactttcattttcttcttggataataaaagttaatgatattctactttttaatacatttctgctatatattttgtatctctgtccatagtagagaaaacagtacctttatactttttccaaggctgaatattaatttgttacatgatagttaatccatcttaatgagaattagtagtgattaattcatcttaatgagaattgttactgactaagtacttcatcttaagtagaattattagtgactaaccagcttggatttctcattaggcattttttttttttttttttttttgagatggagtttcgctcttgttgcccaggctggagtgcaatggcgggatctcagctcccaggttcaagcgagtctcctgcctcagcctcctaagtagctgggattacaggcatgtgccaccatgcgcagctaattttgtatttttagcagagacagggtttgtccattttggtcaggctggtctcgaactcataatctaggtattcttttaatctagtacttcagtataggtgcacttatatttaagatgtgaggttttaaattaacaaatggctatctttctctattctatttctattcttagattaatgatacagataaatatagatgcagataaacacaggaaaacaatttatattttattaaaatatttaagtagaatttaaatatactgattcttttattcatttaacaaatatttatcaaggttttctgtgggtgagacactcaataccaagatgaattgcatgtggctattgccatcaaaagatggatatattacataaatgtataaagtaggaaacagtgggttatagagagttatagaaagtgttagagttgccaaaaactgtggaaaacataaaagggattaatgactgactcctgggcaagatacatgaagtacggtaacatctgtaatatagtaatatggagattagaaggaaaaggctatctaagaggaaggcatgcatgaacaaagataaggaagcatgaaagcatagtgttaaaaggaatagttgggaatttgttggaatgtagagtgcatgttggaagataaaatttgaaagataagttcacagttagatggttgctccctcattttcttgctccatttttataaattttatctccatctattagtttgatctgtttttttcttcttgtctcagataatttgatgttctgtttcaagaccattcacactaccatatcttctcatttaaaacctcctgtcattgattatctttctttcctgttttccttattcattccttgaactttcctttgacgttttatatttctcttactcagattttctcttcagaacaccctttttgggaaaattgtcacttggcaaataccttgcagtctgtctagaaagagccaaccactctgccctcagtctactctaaacatatgttttttggtacctatcacaatgcagtagttatcttttaacattttaacatttcccacctgattatgatcttactcatttgtttgttttcaattttgccttcttgttggtacataataggtccaataaatgttttgataaactggataagtgtattacgattagtttaatttggaaaaaattaaggttttgtctttaagtattagaagtaagagtggaaaatagaatgaaaattatagaaggaatgtagaagtagaataggctatatctgttaactgttttgacaaataatttatatgcttcagtcaggtaagaaggaagtctaattgtttcacagtccagggtgccagtagctggaagtcactgaaaaaggacatgcagaaaagtgggtagagtgggttcagtgttcagtctagcaaatttaaggtgccatcagaaattactacagaaatacatcatagatatttgacattttaggagtagagcttaggaaaataatcagggttgaagatagttttgaccattgttcatctataaaggacagtgttgtctcataactatagctaattagttttacaaatataaaaatatttatgaaatgtttattcttggctacagtgtgggttcaaaaattaagtataaaatattgctgaaatgtaaacaatgtaatattcaaatataaagattaaccatgtgacaaccaataattttgtcaccattttcttaaaactactcttctgcaatggcaaaaaaatccaaaattgacaaatgggatctaattaaactaaagagcttctgcacagcaaaagaaactatcatcagagggaacaggtaacctgcagaatggggagaaatttttgcagtctatccatctgacaaaggactaatatccagaatctacaaagaactgaaaaaaatttacaagaaaaaaacaacccatcaaaaagtaggtgaaggatatgaatagacacttctcaaaagaagacatttatgtggccaacaaatgtatgaaaaaaagctcatcattactggtcattagagaaatgcaaatcaaaacaacaacaagataccatctcacgccagttagaatggcaatcgttaaaaagtcaggacacaacagatgttggagaggatgtggagaaataggaatgcttttacacttttggtggtagtgtaaattagttcaagcattgtggaagacaatgtggtgattcctcaaggatctagaaccagaaataccatttgacccagcaatcccattactgggtatatacccaaagaactataataaatcattgtactataaagacagatacacacatatgtttattgcagcactgttcacaatagcaaagacttggaaccaacccaaatgcccatcaatgatagactggataaaggaaatgtggcacgtatacagcatgaaatactacgcagccatagaaaagaatgagttcatgtcctttgcagggacatgggtgaagctggaaaccattctcagcaaactagcacaggaacaaaaaaccaaacaccgcatgttctcactcataagtgggagttgaacaaggagaacacatggacacagggaggggaacatcactccctggggcctgttgtggggtgaggcgctaggggagggagagcattaggagaaatacctaatgtagatgatcgattgatggctgcagcaaaccactatggcatgtgtatacctctgtaacaaacctgcactttctgcatatgtatcccagaacctaaagtataattaaaacaaaaacactaaagcagaaaaaaaaataataaagtaaaatatcatactgatgtttaaaaaaaaacagcactgttccgcatctattgactacgttttaataacattaaatattgattgaaaactttcatttgattaatgttggaaagcttgcgattattttttcaatagtaattttttttagtttatgaattcagtcatggcatttatttccttttaggcccatgtatccagaaaagccaaattctttcagttatatatgcaagtcacagatgattctatgtggttttctttgcatatataactgatacgattcatgtatttttatatgaaaccatttataagtgtacttttaagatagtaagtttgtaagaaaaatattctcctcttaaaagtcaaacaacttgatgagcttccagaaagttaagatgatatctatttatctatcttttttttttttttttttttttgaggctctgtcgcccaggctggagtgcagtggcgcaatctcggctcactgtaagctctgcctcccgggttctctccattctcctgcctcagcctcctgagtagctgggactacaggcgcccatcaccatgcccggctaatttttttgtatttttagtagagacggggtttcaccgtcttagccaggatggtctcaatctcctgacctcgtgatacgcccgtctcggcctcccaaagtgctgggattacaggcatgagccaccgcgcctggccttatctatcttacttatatcgtaaaaagtatatgaaaatataaaaatgtactacaatattatgaaaggaggtaagtttgttattctaaagctgtaattatatagtttaatatgttttcctttaaaacattttaaactgtatcatttaatctcatgcagatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagaggtatcggcaaactgatttagtgccttcctgtttttgattttgtagtttcagttttttaagattaagatcaataaaaactattttaaagatctaataaaaattagaatactagtaaagaataggtaatgcagatattcttttgcaacaagtatgagaattattattgaaataacatttaagaactagacttcagtgacaaaaaagcatgctacattatgttgtattcttttagtgctgattttcttaaaagattgtatactttgtgaagttgctttttttctttcatactctgtgtggtttcttcctgttgttataggaatccatacatcttaagattttatgtaaatatttcatttgcagtgcttatcaaatggaagaaagtagttcttcattgtcatctattataggtttattttacttttagaattaccatttgctttttaaaaaaatttttttgagactaggtttctctctgttgctcagactggagtgcaatgatgcgatcatagctcactgtagtctcaaacttctaggctcaagtgatccttccacctcagccccccgagtagctgggactacaggtgcatgccatgcctggataatattttttaatttttaattttgtagggacagggactcactatggcttgtcttgaactcttgggctcaagtgatcctcccgcttcggcctcccaaagtgctggaattacaggcatgagccagtacacccagccgtttacacttttctgatacatgtctcttttggaggaaaaagttaacatatttatggttttaaatgtgtatttccatattgaataacaaattatcatagtggttaagaatttgtactttgctgtcaggtagatttgaaattgcatcctagctctgtcatttgctagctgtatgttcttaagcaggctttattgcttttctaaatcttttgctgtggtctgtaaaatgagaataataataaaatttgcttggttaagacatgggggaaatcaaattagattgtgtatgtaaaggatttggtacagtgcctcccagacacagggttgccatttatttatcactctagcactaccaccaccattgttattttgtggaatattatttaacttgtaaagaatcaagaactccttacttttgctttaattaatttaaaatcatgagatgaagagattcctatattataataataggaaaagaataggatagagatgctggaaaaactggtgagatattcagatgtactgtcaatttatatttctgttctcatagaacttttaattggatgctgttagtgatcacattctgtctgccagtttccaaagggtgtgatcagtttttagaaagacaattgagccatggtgtggggaagggactagaggggacaagagcggttaggggactcttaaactgagacgtcatatagtgacatgaactaagataatagaagggagggtcgagggaaatgagcagtttggagagatacatatgacgtaataatataaacagtgattggaaatgggtgatgagggattgtggaggtagtagggattacttattttggattaccatcagtttttgcccacattttacgttgttttgtagttttcaaaataaaaatcacgagtggttaagattgtctttttgtcgttgttttaccaattatagtgttttatgtttataatttccaggggagtttcccattatgttatttaatcttcacagtttgtcctttgaagtaagtcatttagaccattttacaaatacagtagctcaaatctcagattaaataccgtgtagaggtttacacagttgacaaagttagaacttgaatgtaagtcttctgacttgttctgataggtatttcaaaagcattttttgcagcatttggaatacataaatagaattttgaggcatattattctgcaacattttaaattttgttttgttttttttttttttattacagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggtatgcgatgtttattctgtttttcccttgtctttagctacttgtcactttttagtttttaaagttctgagtaataaatattatgaaacttggatagaaataacttgttaaatatttgaggccaaaaagattagaatttaatattataaaggtttagtgcattaacaatataatattttgtttatgctaaaaagtaatttatcagtttaagcaggaatttttaaaggtacctaaattgtgatgtatttggaatatttttttcctaggttcaacttatggtaactgatagtgagttgtccaatcagttttcaattgatactgttggtagtcatggagctgttaaatgtaaaggcctgaaaatggactatcaagtgagttcattctatgcttatcaagaaacttttattttaaatgtttctattaactacttaattaaattttataaagatgttatacataacagtttttgagctgttaatttttttttcttaggttggtgtcactatagacctgagcagttttaacattactagaattgtgacatttacccctttttatatgattaaaaacaaaagcaaataccatatatcagtggctgaagaaggaaatgataaatggctctctcttgatttggagcaggtgggtagatgaatttcaaaaatatacctctttggattctattttctccttgaagttagatacctaaagtcaccatgtaatgttttaactctccccttactccaattttgttttagtttcatgaatctttattgaatatttgtgccctgctctagatagatgggaaggttcaatttttaataattaggtaactaggaatgcccagcttgttaagggaggtagacgtttaacaattactaaccactttggttaaataaagcagccaaagactagataagatgtaaatgcaccaaagagaaggaaattacttattctctctaggaagctattaggaatgctttcagagagtagggtaagccagactcttcttcaagttatttgaggagagtagtaacttagaagtgaaattttgattttgtgccatcattaaatctttgaataagagttttctgaatgactgacagaggttgatggaatattttatttttgaagaacttttattctaaaagttaggattagagaagtttttgctgtttctattcattattcctttttgcatacaaaaccgtccttgttgggattattcttgaagtatattctttagaatttcttttagagctggttttgaaggtaaataccatcagtgtctctagaaaaatctctctggcgggagggacaatgatcgggatataaacccaggcgttccagggggcaacggcaaccccctttaggtcccctcccatttatgggagctctgttttcactgtattaaatcttgcaattgcaaaaaagaaaaaaaagaaagaaaaatctctctggctgccttcagtcttctctttgtctttgatgttctgcagtcacactgctatatgtctatatgtggtttactttttatttacccttcttgaggtgctttacccctagatctgtggattaatgtatttcatgctttctgtaaaatttgctactattgtttctttaaatattgcctctcctccattcttccgtttttttccatctaagccgttaaatcagacatgttggacattcatactctatcctccatgtctcttaatagctcttttatattttccaactctctttgcttcattctgagtaagttctacatggacatctttcctttttttttttttttttttttttttttttgcttttgctgtgtctgaactactatttaagtcttcaactgagtatttgaataattatagttcttattcccagaaatttcaccttttttcaagtatattcattctttcaacaaatattgtttattttttatgtgacttgcaatataatagttaaagccacagtagttaaagcccatctttatgtagtttacgttttagtgggtataaggggaaacattaataataccgtaatcaattagtatatagtatgtttcaaagtgacaagtctaatgtgggaaagtctgatgtaggataagggacattgagagttcaagagccaggggtggtctctaattttatgtaaggtagttaggatgggactcattggagtgacatttgaacagtgccttcgaggaaatgagaaagttagcaattgtcgagagctcagctgaggaggagagagctgagctgccaggtgtcggaatagctgattaacacaaaccacaatgaaagtaacagtcaaacctttaatcacttactgtgatagtacagattgagcatccttaatctgaaaatacgaaatcaaaaatgctccaaaattcgaaatattccaaaatccagaacttttcaagtgccaccatgatgccacaagtgaaaaattctacacctgacactttatgtttttcactttcttaactgtcatttttttttttttactgttaagtacttatgtgtgaataagtgtaagaaaatgattgtttattggtaacacaaattgagagtcagaaatgatggtgatgccacacaaccacagattgtcaacatgggtggttgagatagtgacacattctctttctgatggtccaatatgtacaagttttgtttcatgcacaaaattatttaaatattgtataaaattacttttgggctatgtgtataaggtgtatgtgaaacataaatgaattttatgtttagagttagataccatccccaagatatctcatcatatatatgcaaatattccaaaatccaaaagaagtccagaatgtgaaacacttctggtaccaagcatctcgaataggggatactcaacctgtgtaagcaggaggctaaatcagagaaagcacaattaccacctgtgctggaatggcactggacaagggttaggtggatcagcacaaacatggggattgtctcaccgtctaggaaaccttgaacaaagtgtccggcagttttatggacctgggggatggagtaggacaaagcggaggagctaggaatggaaatatgctgagcactgagagtagacaaaaagtgtcttcactttttgtgaagtgactatacccttgttttaaactgatcatctgtgttccagttctcagctcaggcgctccctttcccccgataaagaggtcctgcaggagctctcaaggaaggcctctgccaaaaagctctcataaagagcttccgaatgaagtgcctgggctaggaatgcagacatggataaaagctttgggacagggttgcttgaatccttaagactgcagtgccctggctgtgcgcaaagtcaggttatattcctaagcatgtctcatatctagttccattaattccattttatggttgaataaaactgtctttaacaagctaagacacttagctctaacaaccaggttctgctacattgtcctcaagtcatgtgatgatgatcaggtatcacacatgagcagtctcactgaaatatatgaagggatcagtctggtcagggcctaagatggagttgacttaatagcttacagacaaggctggttcttcattctttttcttttagctctgtttccagattcttttgtccagtcttctctgtagtaccttgactatctcctattcttttagtttggtttccagatcactcacgttgaagttatttcgtacaattctgagcttctttcctactctgaactttgaatactacttttacttttttacccttatttgacaaccagatgctagatttaatacttgttttgcgtactttgatttctgcctaatttccagataatgttcatacctgattttgatttttagtaactgaatgtacacttgttttaagcctgatcatctgtgtcccagttctcagctcaggtttcttgctgatttttcaacccttctctgtaagatcatgaccacattaaagtctcttttctcgccagcagttcacttaccatagctcttcaatttgctatccactgcttcttgaatgcatagtgctgacaagtgacaatccatcttcaagttgaaagtttacagctgtttaaacaacccaataactagagcagtgttaaaacaggtttttttatagtttaagtctattctgatgggaatattaagatgatttatatatttatggtgaaatctgtttatttttataaacatatataatgtatattttagtgtatccccttttggcctgagtatgcttctagtaaacttcttattcaagtcgaaaggagtgaagatcctcccaaaaggatatattttaacaagcaggaaaattgtattctattgcgtctagataacgaggtaagtttttttttcttttttgcatgtgtcattaggaaagctaaaatatactgactagtattgtatttattttttgtatcaaataattacttctgttgatttttcccctttccccaaaaacgaacaaacatttctttttgtagaaggaaacagagatctaagataatttaattgttaaataaaaagttagttggggccgggtgcggtggctcacgcctgtaacaccagcactttgggaggccgaggcaggcggatcaggaggtcaggagattgagaccatcctggctaacacggtgaaaccctgtctctactaaagaaatagaaaaaattagccgggcgtggtggcgggtgcctgtagtcccagctactcgggaggctgaggcaggagaatggtgtgaacccgggaggtggagcttgcagtgagccgagatcgcgccactgcactccagcctaggcgacagagcaagactccgtctcaagaaaaaaaaaaaaaagttagttggaatgcctggaatactagaatataccacatctggaatgtcacctatctgtaatacagtgattgagattatagatttccagaaatgcagtacaaaattctgaattgttttctcagtcatcccaaaaattaaattatcaagttatgaatagtctgttcttaaatgttattagttaatattcttgggaaaatgattacattaaaatgttttctttttctttcttctagcttggaggtattatagcagaagtgaatttggccgagcattctacagttattacatttttagattatcatgatggagcagctacattcctcttaataaatcacacaaagaatgaacttgttcaatacaatcaaaggtaagattatcacaaatacagtaactcttgatggtgtaagtctagatgatgaggcacagttttttttgataatttcttaagagtataaacactgataatagcattgtagctgtgtaaaacagtgttccattaaaaaatgtacttgaagcatgtaggggtaaaactgacttgatgtctacaatttattttgaaatgcttcaaagaaagaaaaatggaagagctgaagcaagtgtggcaaaagcttgttcattgttgactctgatgaggagtctgtcagagtttgttaggagtctctgaattttgtctatttttgaattttttcatgtgtttaatatagtgtaaatatgtaaaatttcagatttttttttcaaacagtaggtaccctcttgttgagctgtcttggggaaaggactgcttccttaaaggctataattgaatcttcatggtttaggactactcttcaacattattcattttatttgctgttatatcttcttagtgccactacaggttatgcaagtttctgatcctctacttagtagttccaggctgtcttgaatttattttgtttcctttctttctttcttttcacctgttacttttcaacaagcacatatttatcattgcacttccactttccttccactgctaactgtacaacttctaatcattgattaaaatcaaacagacattgagtagggaccacagggctggactagcaagtacctaaaactcgtttggggtagcattctctcatctatttaagatgttaagaaagagggatgcctgttttttttaattatccatattataaaaataataagttgtttctaaacatgtgtgcaagtgtctttttaatataatgacttctcttcctttgagaagatacccagtactgggattgctggatcaaatgatagttctgcttttagttctttaaggaatctccatactgtttttcatagtgtttgtactagtttacattcccaccagcagtgtgaaagtgttcccttttcaccacatccatgttaacatctatttttttttaatttaaattatgatcatttttgcaggagtaaggtggtatctcattgtggttttaatttgcatttccctcataattagtgatgctgagcttctttttatatgtttcttggccacttgtatatcttcttttgagaattgtctattcatgtccttagcccacttttgatgggattattgtgtttttgtttttgttttcttgctgatttgtttgagatccttacagattctggatattagtcctttgtcggatgcatagtttgcaaatattttctcccattctgtgcgttgtctctttactctgctgattattccttttgctgtgcagtagctttttagtttaattaggtcccatctatttttattttgttgcatttgcttttgggttcttggtcatgaactctttgccaaagccagtgtctagaagagtttttccagtattatcttctagaatttttatggtttcaggttctacatttaagtctttgatcgatcttgagttgatttttgtataaggtgagagatgagaatccaattttattcttctacatgtggcttgcccacgatcccagtaccatttgaataggagatagtcaaagtaccagaaagaagactggacaaaagaatctggaaacaaaagagctaaaagaacaagagtgaagaaccagccttgtctgtaaaccattaagtcaactctatcttaggccctggccagactggtctcttcacatctagtcccttcactagaataaggtgtcctttccctacttcatgtttttgtttgttttgttgaagataattggctgtaagtatttggctttatttctggtttctctattctgttccattggtctgcatgcctatttttataccagtaccatgctgttttggtgactataggcattgtagtatactttgaagtaggataacgtgatgcccccaggtttgttctttttgcttagtattgctttggctatgagggctccttttatggttccatataaatttcaggattttttttctagttctgtgaagaatgttgatggtatttttatgggaattgcattgaatctgtagattgcttatggcagtatggtcattttcataatattgaatctaccatccatgagcatgagatgtgtttccatttgtttgttaaatttaaacttttaaataaatattcccttcttatgtaatctcccctgccattatcctagttcagtaaccctccatttcttatctatttgagtagatttttatgcgttgttttgttttatttgagtagatttttcttttttgttttgttttgagacagtgtctcaatctgttgcccaggctggagtgcagtggtgcgatccaggctcactgcagcctccaccttccaggctcaagtgattctcatgcctcagccttccaagtagctgggtttacaggcatgtgccaccatgcctaactacatttgagtagattttttatctatctctatatatctagtcttatctttagtaaatctcccattttccactagaatgagttttctaaaataagaaatataatcatatctctctagtttaaagtttttctttttttacccatttctttaaaaatatacttctaggctgcctttctaaacatttatctttccgtggcctaaatcttaccctatacaaagtgaagtttttttttttcctgaatgctctgggtctttccatgtgtttttacctgaataggtgtttctttcagctagaaaaatgccattctgtaattattaaaaaatcaagaaacaacagatgatggcaaggctgtggagaaataggaacgcttttacactgttgctggaagtgttaattagttcaaccattgtggaagacagtgtggtgattcctcaaagacctagaacccaaaataccatttgacccagcagtccccttcctgggtatgtactcaaaggaatagaaatcattctcttataaagatagatgcacacacatgttcaccgcagcactattcacaatagcaaagacatggaatcaacccaaatgcccatcaacgatagactggatgaagaaaatgtggtacatatacaccatggatactatgcagccgtaaaaaggaacgagatcattcctttgcaaggacatggatggagctagaagctattatcctcagcaacaagaacagaaaaccaaacaccgcatgtccctgcttataagtgggagctgaacaatgagaacacatggacacagggaggggaacaacgcacactggggcctgttgggggcatggtggcagggagaacatcaggataaatagctaatgcatgtggggcttaatacttaggtgtaggttggtaggtgcagcaaaccaccatggaatacatttacctatgtaacaaatctgcacgttctgcacgtgtattctggaacttaaatttaggaaaaaaaaaaagaaaaatgccattctatgtgatcccttcccttgccaccttaatctatgtaccccagtttttgatagcacctttacatatgtagattgcagcattcgtcacattgtgttactttcttgtgagtttgagacatgtacacacagatagtgaatagtctgaggactatggttagtttcccttttcttggaattttcattgcctgtcccaggtagtccagtacgtttttgcataaggaatactctgcaatgaattaaacagattaaaatttgtatgaattaagagcatttttaaatatttttaaaccaaatttatttgataatcaacacatttacatttgattttttttttcatggaaaaatgaagagtatgattttgttttctcctccacatttccttctcttggcttttaaaaaaatatggatgttatttcctgcatataaaagtaatagttgttaaattactgttttaaaaaatactacagaaaaaatgtgaaagaggaccataatccctgtaatccaaatactgtcaacattttggttcattgcttttcctttcctttcctccctcctttgttctctccctccctccctttcttccttccttatgtatctctcacatttgacagctattgtgagcatatcaatttgcttcaaagcacaatttttttttctttctaacttttattataggttcaggggttacatgtgcaggtttgttacatgggtaaattgcatgtcacggggttttggtatacagattgtttcattacccaggtaataagcatgatacccaataggtagtttttcgattctcaccctccttttactctccacccccaaataggttcccgatgtcagttgttccttctttgtgtccctgcaaagcatgatttttactgaatgcgtgatattctatcatttagatgctctacaattaaataaatacttaattgttcagaatttttatttcaacttttataattttagaatcagtttatcttctttttttgttgttgtttatttgttttttgagatggaattttgttgttttgcccaggctggagtgcagaggcgcgatctcagctcactgaaacctctgcctcccaggttcaagcgattctactgcctcagcctcctgaatagctgggattacaggtgcgcgccactatgcccggctaattttcatatttatagtagagacagggtttcaccatgttggccaggctggtctcaaactgctgacctcaggtgatccacctgcctcgacctccgaaagtgctgggattacaggcatgaaccaccgcgcccagcccagtttatcttctaataacgatcctcaacccatttgtaatcattgtaataactagtttataattccttaccatatttttttgtagtatattgtcttctaatgattttttggaaaatacatattctgtttcggttatggataattccttttttgttattgaaggtttcgatacatttaaaatcaattttaagattgaaacagtatctgctagcttacccataaaaaattgtaatgcttttttaccttttcttcaacctctttccaaattcttactttcttgtgaatataatttggtatgttttcaaacagattaatataaaatggttagcttttcaaaatatgtattatttcattcaaggcccttttggtatttgcattgattttaatgttttaacaaaaaaatgactttcttaaactggtttaattgttcactacaggttcctcaatatttctatatcctagttgttaaaatgttgttctgagttcatctctagcttggttggaaaaagtctgagttatttttttagtaaagatttgtggatagtgttatgctattgcttgttcgaaatgtcttattcttacaaatttatgacaatttgacataaaattttaagtgataacgtttttctcaaaattgtataggtattgtgccattgttttttgatattaaacatcattgaactgtgagagtaacatttttattttcttgcgagtgactatgattttcctagatatgtgttagggttttttcccccctattttcttacaaagatatgtctagaatgatactgttttcatttatgtctgatacccagtgaagtcttttaaatctgcagagttaattccttcttctactcagaagagctatattttattacttgtttggtttataacttttgtaatgtttttttctttctgagcatctttttgtgagtcaactgaatttcttagatgtgtatttcatgttttgtgattttaaagaataatttagttactttgtttttgctctagtaagaccaatacttaggaaagagttaccaattaaattatcttagaattggtataaatagggtaaaatagttggaataattttccataattaatttgtattaaaaaattgacaaaacagttttaaagacttgaagacctttatttcctaagtagaacatgtattttctaagtgggaaaataatgagaaatattcattagtgaacccttttttaattgtataaggtaagaatttcagccttgttttaatcagaacgatcacagatctcagtgaactaagaattaatgaagtattattttagtttttttttaatctcttcgtgtacttgcatttaatttaacgcgtatttttgctactgtgtcagttctctcagtgaaatagaagattccctccctcctggtaaagccgtgttttatacatgggctgatccggtgggctctagaaggctgaagtggagatgtagaaaaagccatggtgaagtaacacagaaggatgtaagtattgggttattatggtgttcccagcagccttttttaaaaaaggtatttgggccgggtgcggtggctcacgcctgtaatcccagcacttttgggaggctgaggtgggccatgagttggagatcagcctggccaataaggtgaaaccctgtctctcctaaaaatacaaaattcactttgggaggccaaggcaggcggatcaccaggtcaggagtttgtgaccagcctggccaatatggtgaaactccgtctctactaaaaatacaaaaattagcctcgcatggtggcgggtgcctgtagtcctagctactaaggaggctgaggcagaagaatcgcttgaacccgggaggcagcgattgcagtgagccaagatcacgccactgcactccagcctggcgacagagcaagactccgtctcaaaaaaaacaaacaaaaaacaacagtatttgattttcagccttcctagttttaaggactttttgtggccacacttctgaaaaactgccaaacgtcttcaaaatagtattcaagtatttacttaaccaaaaatgtttaaaaccaaaagtagtcttattttgtttacatcatttgcttctactgtgttataaagaataaagttgtgtttagagaagtgctttcagcattcacctgaaaaacaaatatgttctctgcattgacaatcatactaggtagatttagcttctgtaaggaacatttaaggatccactgagtgaactaaaacaaacttatttctgagtggcaagctatgatgataaagttatgcacatatattttctggtaacattttaaatactttcagaaaatttttaaaagtttttaatccttcaagattcatcttaatttgactcctgatgtttttttttcttaccactggtgattttttcttcctgcttatcagtaggtggtattttctcattgtctttcagtgctgctgttgaggagtctgctgtgggtattgtttacattgtatttaagaggattgcctataagtggcctttcagttttaaaaattcattactattagatttattcaggaaaaaaaattgtactttgatataaaaagtcttattcatttgatctgttgattagtactttgcatatttatatcatagtgatagtttgaagcttataaagataaatcagacattcactgtaaaatattagaaagacttcagtgaaataagttagtcttcttgattctcaatgtggttttagtgatatacatatatatacttagaaagtattacaagtaaggtaagtatccccagataattattttatggtaacaactcacagtttttaatttctgtatattgcaacgtgaaggtatactatatagtaaaattttctgaaaatcagaatattaactagaaattaatggctgaatattaattatgagaatttgctatgtttatcttgtcattgaccctcaaaaccctgatatcagcacatttatgtgagattcctgcagaaatagcctcatgatgaatatacatgctttgtagaacatacaattgagatacaagatattttttatcctgtttgattcagctatgaaaggaaatgtgaatttcaaactgaaacaacttttaatacatatcacattgctgtagtcttagaataaagcagaaaaaaatactttgtgttacagattagcctacgtgggaaggttcaattttattaaaatgtttaaattaaaaaagtaaacaattggcctgtctttatgagtaataattttataacagataacatcaaatgatttcaataatgtaaatttgcaagtattctacaaatattaattcatttagttgccactaaccccatgaagtaggtgccattaatagtctcattttataaatgtgaaatctaaatttcatgttctttgggaccaaattctaattttttggtttttttttttttttggtggttttattctaggatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaaggttagatgcattaaattttggatacatttaaatgatcagtttctaattgttaagaaattgttattgtaaaatctcaaatgatttagtttcagttttgtgctttgactattcattgatactgtggtagtgctagttttaaatgtgcttgagggaattttttgccttttgaaataaagatatggcagaaatcaaatttataaactccttattatgttaatccttccacttatctaaaaagttatatttattcaacttgccaaaagtatgttttgcatatcatacaaaatgcttagttcattttccattaccatctagcacagttcagggtacatatgctgtagctgttggaggattaacatagacaatcactttctaatttgaccttggcactttaagatctaataagatctaataaggtgatcactgtatttatcatttctcgtataagacatcaccattaaatcttttatctctcccttatgtccttattattcctattcataaacagttgttttaatttacatatattagtgcttaatgtgagaatatttcttctgtataaccaggataatgtaattttaatccttttcttgaattaaattcttgaatatatataaaggtatatgatacagatgtaaatttagttttctatgtacattaatctatacgtgtccctgacctcttattgaattgaatcaatgccattttaaaaggaatattaaaatctatattcttaagaatttttattctcaaaaaatgtttttactatttaaatagatcaaatacaccatagatttttaagacctttagacctattatatgttatcttctaagctaagtgatgttaatgcaaagatgaataatacatggtctctacctttctgtttcttaaatgaatataagttctataaggaataaacaaatagaatgctttaataaaattaaacaacttaaatatttaagtaacatatgaaagtaacatatgaaagtgagaaagcagagttagcagagcaagaaattgcagtggcgcactctatatcctagataactattttatacttgtctccccttaaacccccattgtgtcagcttactaccttgcattccacttcactgaaaaaattgaacccatcaaaagcaaacttccagagacccatctcaccccccaatatcacagcttgctatctaccagcgtttgcatactacttgctgtactgacatactctcaacagtttacagtagatatatgtgctcctgtttaaacagatttttctctacttttgcactgtacttcatttcctcttacctacttgaggacattgttccagcagtcctcttcttcatctctcctaagtcaacagcttttgggtctctactgaattgtttcagtgttacttctctcaacataaaaaattctcttgagcctactttccttgctacctgttgctcatttctttctttgcatttataaccaaacacctcaaatgtactgtctgtttcaaaggaacttaacatatcctgtgttctccaactatttttcatccattttctctttaaccactccaaacagggttttgctttcaacacaccatgaaactggttttgtcagcattaccagtgacctccataatgccatatccagtgtagaattatcggtctttacttaataacatttaacacagatccctccttgatgtagtttctttcacgtgacttccagaatacctcaccatcttggtttttcttcctatccagtctcattcattggttccttgtcttctctcaactgcttacattggctaaatgccttgaggctcttagacctggtccttttctcttgtggatttcagttttatgatttcaaatactgcccagaatttctctcttaggtatgtcttctgtcacacctgtcatctgaccttaagacttcatatatccaactgtgcatgcaaaatctctattcagatatctaagagacttcttaaacttcatatgtgtacactaaaccttttatttcctccttctaccaaaactccagctttccaatcagagttaataaaaaatagctccttctagttatgcagcccaaaaatattgaaattgtcttcgattcctctctttatcttacaccccagacctaattcatcaagaagatctgtgctggttctaccttcaaagtgcacatagatctgaccacttttctagtatctcactgttaatagcctcatcagggccatcaccatttttcaactggcttactgtagtacactaacaagttttcctgcttctaatcttgactccactcttttttctttccatccacttcaacacagagtgtattcttaacgaaatgtaagtcagattatgttgttagttgtcttataaccgatcagtggtatctcatctcactcagaataaaactcagagtctacagtggtctacaatgctttacattatttggccccccactataagtcttactttattttctattcctaatgtgttcctgacatgccagcctccttgctcttcttcatatactgcaagtgtgcctcctgctttagctggcctctctacctgaaatgttttcctcctcttgtctgctggataattctctcagctcatttaaggttgccaaaatctcactttctcaatgaatcccccattgaccactctaatattgaagaccccaccactttacatattgcagttctccggatcccccttgccttgtctacattttcttctttcaaaagcattttcacctcctacatattaaattttactaatttattttgtttactatttattttcactcccccactaaaatgaagctccagaatgacagagatgttcactgataacggctgtaacacctagaatagtgcctcagtagtagcttaataggtagtagttgaatgaattcatgtttttaaatttgtaatatgctcacttgtaattgaggctgttctgaaattttagtgaaggtattgtaattcatgtaataaaccagttaaaataaatgttaataacttagtattaaatactatgatttttgctttcttaaataagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggtaatatttttaagtactgatgtgaagttttaattttttgcctgtcgtagtttggtgaatcactagtgaaatttaaggaaagtttggcttccttataaaacaaaataatcctgtcatacataccttgtataaaatgttttaaagaggtgtttatctatattaagaaatcaggctgggcgcagtggttcacacctgtaatcccagcactttgggaggctgaggcaggcggattacttgaggtcaggagttcgagaccagcctggccaacatggcaaaccctgtctctgctaaaaatacaaaaattagccaggcatggtggcaggcgcctgtaatccccgctattcaggaggctgaggcatgagaatgccttgaacccaggaggtggaggttgcagtgaaccaagatggccccactgcgctccagcctggctgacagcaagactctgtctcaaaaaaaaaaaaaaaaaaaaaaaaaagaaaagaaaactttcttttaagatactagatgctaatgatctgttctttgggttagcaggaaacttaaaaatgttttattttttcactgtactttctttaaatattttatttttcctttattcatttttattgtggtaaattttagtacatttatgtaaaaagtaatgcagtgaagctttgtaagaattatatgaatatgtgaattttatggacatgggatattaagatctaaatctaaactaatacaaatatgtagcttactgttttaaaaagtttttggcattaatttctaattctagtcatttatagataaattaattttttcatttggggggacatatttttcaggttcgcctaacccctactggtcataacatgaaaattctgcagccgcatgtaatagctctacgaagaaattatcttccagcattaaaagtggaatataacacatctgcacatcaatcatcatttagaattcagatttacagaatacaggtaagtctttctgaaaatataggcaaaattgtattctaaaggaatgcaataagaaaccagatctattcccatggtctgctttatctagtattcagtttcaatgttgtgctagcctttttttttttttttttttttgagacagagtctccctctgtcgcccaggctagagtgcagtggcggaatctcagctcactgcaaaccctgcctcccaggttcaagcgattctgctgcctcagcctcctgagtagctgggattacaggtgcccaccaccatggccacctaatttttgtatttttagtagagacggggtttcaccatgtgggccaggctggtctcaaactcctgaccccagatgatccacccgcctcggcctcccaaagtgctgggattacaggcgtgagccaccgtgcttggtcaccgctagactttttgattctttttgttcctcaaatcctgttattctggtcaggttgtataattgacatattaatatactgatgtgtttttattttcttagatccaaaatcagatacatggtgctgtatttccctttgtgttttatcctgttaaacctccaaagtcggtcaccatggattcaggtttgtttttatttttagatttccataaaagcagttgtattagctatttgatttactttactataaaaatatgaagtgaaaccattcttgggtttaatttttataggataattggaaaattaaactgcttgaaaaaggaccagcaagtactatacacaactaactttgataagattttgagtgaatcttgaagaaaagattgattagaaacatatattgaaatttttagaaatactaatttaaaaagcagataatctgtaaacctgcgatttaaaaacctttaaagcctttgaatgaacaataaggaagttcaaatctagagtgttttctaacagcagaaactgtcctatgttctccaaataagaataacggacaagtcctttctacccttttctttccctttgcctttcttgtttcctgcatatccctcttccccctactttctcttccctcctcactaccctacttaactttcttctccccttgctttcccacctccaccccacaccacttcttctaaactatcctggggggagtactctttataactcgctcagaagctttttggccagtataatgcgtaagcccttccacctagaggtctggagcaagtccccagaatctgttttcacaaagtttccctgatgattctaatgcatacttctaaactgctaattgtagaattagttatcttcagagtaactatagatagttttaaaaacaatgctagagtctgaaattaagattgtagtagattttgccaatatcagtaattttaactgatatttattatttagtaaatgatttaattttccattgtggtgtatattggaagaaaatgcctagcttttgcttaaagcatcatgggagtaattatatttataacctttacagcaccaaagccctttacagatgtcagtattgtcatgagatctgcaggacattcccagatatcacgtattaagtaagtgtcttaatacatttcttgtatatttatttaatgtttgatttaaatatatgaattgtttgtactctttaaatgttggacaagtcaaagatttaagcataaaatattaattataaacgtcaaataaaaaaatataatgttgtggctcacgcctgtaatgccagcactttgggagacctagacaggctgatcacttgaggtcgggagttcgagaccaacctggccaacacggtgaaaccccaactctactaaaaatacaaaaattagccaggcgtggtggcacgtgcccagagtcccaactactcaggaggctgaggcacgagaatcgcttgaacccaggaggcagagcttgcagttagctgagatcacaccactgcactccagcctgggtgacagagcaagactgtctcaaaaaaaaaaaaaaaaaggcggctctggatgaaatacatctaggtatttataatcattgtttctggattttggatattttattattctcttgtacttgtatttgttttttgtttggggttgtctataatcatatattgttttgaaaaaggaaaacaataatattttcgtcttcactcactacccattccaagaaacagaagatggactgaaacatctatgtaataatctcctgtctaatttcccttaccttgtcaccaagataacctatctttatttccttgctgtttaaaatatagttttattgttcatgtgtacctaaacattatgccttttagttttaatttttttctaatttttagaaaattgtttcaggccggaaatagatgttgggacttgcttttgttcattcaacatttttattaaaatttattcattttgttgtatgtagccatagtttattcattatcactaatatataatattctgttttatgactctgtatgacagtttacttatctggttcctctttatggccattttcatattttgactttgttgctgttattaacagtgttccatgattttttaaaatttagtcaactaaatagtcctaagtttcaaagttctaatattgatctcatacttttttctcatctaatttttgtaatacagttgttaattgatgatttttaaaaaatgttttctactttgtaatacaggtatttcaaagtattgattcaagaaatggatctcaggttagatcttgggtttatctatgctttaacagaccttatgacagaagctgaggtgactgaaaatacagaggtaagacttaaaataataacatttgatggaaaggattagggaaaagatattattataaatttttaaaggtattaaaatgactttgttgcattttaaaaatacaattaaataaattttattactctcttgtggtacatacctttttagaaatcttattttctgatgatagaaaattagcaaacaggaggaaaggcttggggtgaatagcagggagaaaaggataatttgtcatgttcacatcacttttttcctcttttattttcctggattactttggctttgctttcactttaataatttagaaatttagggtatgtccaggatatttaatgggagaaaggataggaaaattaaaaggtggtatcatctgggtgactggaagaccataaaatcatagttataaagtgggtcagatatagtctgtttttcacttgccctcatagattcatggatggagaaagagcaaattagtaacagtctattgaggtatagatcacataccatacatttcacccatttaaaagatagggttcaatgacttttaatgtattcacaaagttgtacaatcatcatcactctctaattccggaacattttcatcatccccaaaaggaactgcctgtgcagccactgatacactttgtgtctttaggtttgcctattctgaatatttcatacaaatagaatcatacactgtgtagtcttttgtgaagggcttctttgacttagaataatgctttcaaggtgcatctatgttgtagcatgtatcagtacttcattcctttttatggttaagtgatattccattatatggatgggccacattttgtttatccatatatctgttaatggacgtttgggttgtttacacattttggcttttatggataatgtaatgaatactggtgtacaagtttttattggacaaaaactttattaaaagtcttaaactatttaaacttaatcaccatgtgattaagcaattccaatcctaggtatatagccaaaagaaataaaattttattagaagtggaattgctcaatcacatagtaaccttatatttaatcatttgggactgttaggcagttgtgcaaagtgcctccaccattttacattcttaccagagcatatgagggctctgatttttccatattatccccaacacttgttactatctgtctttgattctagcaatcataatgggtgaatgtgaaatagtttgtcattgtggttttgacatgtaattacctgatgactaatgatgttgagcatctttgatatgttgattatcctttaatatgttaagtagttaatttgcatatcttatgtgaagaaatgtccattcagatcctttgcttattatttaatgagttatttgtcttttttcttataaaagttatttgcatattctcgatacaggtctcttatcagatacataattttcaaatattttctctcattctgtgtgttgctttttcactttcttgatgttgtctattgaaaatcaaaagttaaagttaatgaagttcaaattattttttattttgttgctcatgcttttggtgtcatttctaagaatccttagccaaatccaaggtcatgaatatcttacgttttacgaattttaaagatctagctcttatgattaggtctttgatcaatttttagttcatttttgtatatgatgtataaggatccaaattattctttggcatgttgctatccagttgtcctattaccatttctttaaaagactatttgttctttgaatggtcttgacaccctagttgaaaatcagttaacaacacacatgtgattttattccgtcgatctgtgcatctgcccttgtgcattgcacactgtcttagttattgttttgtattaagttttgaaattgggacatatgtatcttcctactttgtccttctttttcaagatgggtttggctgttctgagtcctttgaaatttcatatgaattttagaatcaacttgtcaggttcttcaaagaagtcagctggacatctgatagagactgcattgaatctgtaaatcaatttgggaagtattgccatcctaacagtattaggtctttcagtccttgcacatgacatgtttatccatttatgtagatttttaattttttttaacaatgttttgttgtttttcagagtgtaagttttacacatttttcattaaatttattcctatgtattatattcttcttatagtattatgaataaaattgattttttaattccatttttggattgttcattgctactgtataaaaatgcagttgatttttttatactgatcttgtattttgcacccctactgaattgttagctctatttgttgttccgtatattcttttgggatttctatacataagatcgtgtcatctgagaggagaggtagttttacttcattctttctgatctgaatgcctttgtttcttcttcttccctagttgttgtgtctagaaattggtgacacattaaacagaagtgccaagagcagacattcttcttttgcctctgatcttggagggtaaattttcagtctttgagtatgatattgaccctgggtttttcctagacatcctttttcaggttgaggaagttcttttcttagttggttgagtgtttttaatcatgattatatattttgtcattctttttctgcatctatggaaatgattgtacactttttgggttttgttctactgatatgttttattacattaatttttttttttttatttttttttttttttgagacctaggctcgctctgtctcccaggctggagtgcaatgctgcaaaagcaatctcagctcactacaacctccgcctcgtgggtttgtgcaattctcgtttttcagcctccctcccgagtagctgggattacaggcgtgtgccaaaatgcccagctaatttttgtaattttagtagagacagggtttcaccatgtttctgtgtttttttgttctgacctcaggaaaactcctatttgtcactttctctgattttctcctgcaaactattaggtctacaggttagccagtatcttctgtaaatcaatgactttccttttagttgtctttcaccacatctgctgtttctgagagcccttaggctcgaactgcactatatgttataagtgaaattagttcctttgggaagagattaatagttacctgttttaaaacctactttccccatcagcaaaaatccctaaaccaggcctctgaagctggcggtgggaacagttgtgacacccttctatttgagtaacaccccagtttaggagctgagcactatgtgtggtggggtaagaggggcagtggcctgagatgatctcagcttgcctttgctggcatggaaccaccacattacaggcctgggcaagagtgatcagaactctagtattctcagtggtactgtacccaaggcagagcttttttaccctgcacagaggctggacagagaaaggaagccctgccaagtacggtggctcacgcctgtaatcccagcactttgggaggccaaggtgggtagatcacttgaggtcaggagttcgagaccaccctggcaacatagtgaaaccccatctctactaaaaatacaaaaattagccaggcgtgttggcaggtgcctgtaatcccagctactcaggaggctgaggcaggagaattgcttgaacccaggaggcacaagttgcagtgagccgagatcgcgccactgcactccagcctaggtgaccagagcgagactccgtctcgaaaaaaacaaacaaacaaaaaaaaacccataaaggaagcccccgcctcacagttgcactcaaccataacttaacctcagcagcaggtagctgggaacaggatgagaaatgctgacgtcctgttcttcccaggaaggaagtcctccaattgaggactgggccaagaaggagctctgtgttcttgggtatactagtctagagtagaattctggctcattagtctgggagaggggacagagggaatggcctttgttaaaacaccacggattcgcttttcttaccaaattctttaggttttcttaaatagatgtttcttcatttgcttatgaccttaaaaccattcctagaggccttaaatttgttgttgttgttgtttaaattttatcagtttagctggggtgctggtttgaagagcttcccactgtcatttcagaaattgatttctaaatatactttttataaggctatcatttcttatgtttttatgaatatgttaaaatgtgaatcttggggctcatttttcaacacatagaagttacttccgtctgagcatttaaaggagaagtattgatgaatatcaagaatgaaaccaccaatcaattaatgcaaaattgttttcaacaccttctttattttattatattactgatctgtgtaggatgcattaaagcaattacaagtagactacaaaatacaagttgactgtatgattatgtttaaagaaacaaatatacccaagagagtgttgatggtatggattaatgtcattttgggataagatttatagtcacatggagaaaagcttagtgtcttttaatggtttggatagaaatatagaagataatgcttgttggtttgtcagtggcagacagaactgtcctatagatagagatgttactttcccttctgaggcaatcataagcaatgttgagtctggatcttatagaagagttttggcagtgtgtcttctatttgcttaaatatctcatgcaggtaggtccctttagttttaatattttgtgttccttttataggttgagctttttcataaagatatagaagctttcaaagaagaatataaaacagcctcattagtagatcaatcacaagtcagcctctatgaatattttcatatatctcctatcaaggtaggagaaagtcatttttattgtccttgataatctaggtaatagcaaattgatgtagcatttatattgtgttcttcagtaatatataaaatctgtaaatatacaattaaactaagtaacaaaggaattacccttttacatttttatttatttttaaataactttttatcatgtggagccacctatagcatgtatttatgtttataatttgacctaacattattttaccttgattttctgttaagctgttaggtgacaattttcaaaattttgcatatgatgatttgtgtattagttttaaagtaatttataaagtagccttaagaactgaagactgaatggtatcaaatctaagttagtttttagtgcaaaattcctataagctaattatacaataatagaagaaaattactaaacaaccatatatgtagagtatatatgcaatacaatacaaaagtgttttttaactggctattaacttctgaaataattgaaacatatacttttggagatacaaatacctttcagcttatgacagagttacatctcagtaaagccatcatgagttgaaaatcttgtaagtcagaaatgcattgaatacacctaacctactgaacattaaagcttagcctagcctgtcttaaacatgctcaaaacagctgggcaaaatcatctaacacaatgcctattttctaataaagttattataaagaattttgaatcaaaattcaaagtacagtttccactgaaggtgtattgcttttgcagcattgtaaagttgaaaaatcataagtgaaacataagtcatataagttggggaccatatgtatttgagtcattttcaacagcttcaacttttagatttttaatgttattaacaaatatataaaaattaatattttcttaggtttgccaaaagaatgggataggattaaatatcatgctatcttaaattgttgaattgaagatttaaatagagctatgttagattttaaatttcttcatatttctacttagtgattttaacataatccagataactttgaaatcttatttatggtgtagtgaatttaaaattaaactgattttttaagagttaaaattgtcaatatgaagaaaatacttttaaatatttatctctttatctttttagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagtatgtttagtattcaaatctgtaaattgatggaaatatttctattttatatgtccctaaaaatttcgtaaatgaaaaagtgtgtgaagtacgttgcagatcataggcaaaatgaggtttttgcattcaagtgaagtgcaatctgaataacaccaacgtatgatttgctaacccctaattgctaaattacagaattattaaacaatttccttaagaaaaagagtcataggccatgcaagtttcacattttaaaagatctttctggcttagggaaggataggatgtgtatgcccaaagatatggtgcctgaaatgtatggatttgaagctaataggaataagactcttcaaagcatttgcaactagaacagaatgaatgcgataataggggaaatgaaaggatcaactttaagtgttgtaatcaggaatttatattttaatatgagtcataatgaagcttatagagtatctgaccaaagagattcagaatgtctgagttgagactttagaagagaataaccctttcaagtagcatctagaattgattattaagaacagtcgtaagaatcaataagtccaacacgaggtaacactgaacctgaagttaggtaagtgtcaaataaaagtacacaggtatgatgttagcagaaatagtattctacttagcaacaagaagcatagagcttttcagttactgtatcaggtatatgctatggatgggttataagtaagctaatcttagtatatattctgtgaatggagttataagtaagcaggcaaaacctgctgcagctgaacctggccattcgtgagcaacctctttatcagtgtgtcagacattttctatgtgggccatgataggacagaattgggaaataaagttctagtggtacatgaatgggattcacaggatctcagaactctcgaatttacatgaaaatttatgtgtactggtgacttgtctgaagataagatccatgtcttttatcagattcttagaaggttctttgattaggatatgcagagatgtatgtaaaaagtaaatttcctgattggcatgggaaaatgtactagaaggaaaggtttggagaaaagattctaaagaaaataaagccactcattaatattaaaaatactttcttcatacacatgtacagacaatatatttttacgcttttttcaggcttgcattttttgaactcaactatcagttccatacaacatccgatctacagtctgaagtcataagacactattcaaaacaggtttgtctaagattatattacagagggacagagtgatacagactggtaaaaccttttgtgtctatacatatataatgtggaactattgaggaactaaatagccattttcaaattattaaagcatgggtattttcctcagaattataaaaagaaattaagctcaatcactatttgaattttttgtccttatattttttagccactgagagaaattttttgtggatcagcaggactggaaataaataaatctttaaataaaatattaactaatttatcacacttaattaaaaaatgggttcatggaaactattagtaactaactgatgaacacgggatatttttagtgtaactagttgttaagtcagccagatgtatttttttaacagatgtttttccacttctagagagactcttgggttttaggatataacttagagtatctgatatagctgtggtatgacagatcactgagcatgactcaggagatttggatttctcccacttttgccatatacccactatgtgaccctgagtatcatctgacttatatgtttctccaatctataaaacggtggtggtaatgacagtggtcacagataattgtaaaagtgaaagtattttaaatattctagagctttacatgaatataatgtcatattatttttaatactataataccaaattactttttaaaagctaagaatagcgatcaataagcctggcatggtggctaacgcctgtaatcccaacactttgggaggctgaggctggtggatcacttgaggccaggagttcgagaccaccctggccaacatggcgaaaccccatctctactaaaatcacaaaaattagccaggcatggtggtgcatgcctgtagtcccagcttgggaggaggaggcacaataattgcttgaacccgtgaggcagaggttgcagtgagccgagatggcgccaccgcattccagcctgggcaacagagcaggactgtctcaaaaagaaaaagaaaaaaaagagtagtgattaataaaatgagatggtttaggagttgaaattggcattaaaggtgttggcctgagaaaactgggcgtgtgttttaaataatgtataagaaaaaatagatctaattatctgaattgattaatgttcatattttatttttaggccattaagcagatgtatgtactcattcttggacttgatgttttgggaaatccatttggcttaattagagaattttctgaaggtgtagaagcatttttttatgaaccttaccaggtaaaatagttatttttgtggttgtgcaatatgtcactaatacttttgaatagataatacttttctattgttaagttgagttaataagtgcaaacagattttggaacacacacaaaaggacatcattttgcagcaaacaatggtaagaggttttgggggacatttttacccttttcctcaaaatttaaacttaagattttgttaagctacgctgaattgtaagtgttctcttggaatataaaaggtggataaagtagaaagaagatcaccacatcttgctttgcacagtagtgtggaactataaaaataatcatgcaaactgacacctggccaagcaatcttaaaaatcagtgggaaaaattatgattgttctatgtcctttaaaactttttcccaaaagactcctacttccacgtataaatgtatagggaaataaaaaataaagttaacattaattttgcacattgtaattaaaaacattaaaagcattaagaattttaaagtgtttatttgaaatttttattaaagacttatcaagagtagtttgaactgtgcttgcattttgctcataaacttacaatatggaccaagcacctttctgtactttggtgagttgccgtactcctttctaagggtcagcgtctaacattatatccttcacactttcagcgtccagaaatatccctaggaattcttttaatgtgaaactttttgctgatattacttcctctgggacaacattatccatttttgttactacctctttcgtcgtatatatccgtaagctcatctttaaaagtgaatataactcactcactcatttatttactatttggccctttagggagccatccagggtcctgaagagtttgtggaaggaatggcactaggacttaaggcactagttggtggagctgttggtaagaaacagaatatctaccaagtatttttgtgctagaaagtaatggcatcattacttttactaaagataatttctgtcaggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctgtaagaaatttcacagggttgtgaagattttgggaaatatcttttaaacaaacctacatttgcgaataaggaaatagacatgattctcactccttaaattattatttggatattttaagagcagtgggtggtagcatataaaacatgtcagtagcctctaaaacattctgtttaaataaaatacttaggagatctgttaattcttatgctatataaaaagcagaactctgtattttttgtgtaatccaaacttggttcttctaggcatcataaaaaagtattgtaaattttcagttgtgttttccttctagggatttgttagtggcataacaggaattgttacaaaaccaatcaaaggcaagtatagtagttcctttgcaagtctttctaagttgattctgttttcattcttggatgcaattgtcaaaaactcttttttctttccaggagctcaaaaaggaggagcagctggtttctttaaaggtgttgggaaaggtttagtaggagcggtagcaaggccaactggaggcatcatagacatggctagcagtacatttcagggaataaaaaggtaaatcctctttggtgtaagatatgagttaaaatgctgaagccatgagaaatggaatttatctgctctttggcttcaggcatttagttattgtctttgttttgtgctgctataacataccacataataccacagactgggtaatttataatgaacagaaatttattggctcacggttctgaaagttaagaagtccaagattgagaggcaacatctggctagggcctttttgcggtgtcatcccatggcagaaggacaaaaagagggcaagagaagaaaaaagggaaccaaagtcacccttttataaggaacccactcccacagcaacagtattaatgcattcatgggggcagatcctcatggcctaattacctctaattaggccccacctcctggctggggataaagtttccaacacatgctcttggagggacacattcaaaccatagcagttaccagcactacaatatggcaggttgcatatggtcttcctaattcattttgattttttttttttattattatactttaagttttagggtacatgtgcacattgcgcaggttagttacatatgtatacatgtgccatgctggtgcgctgcacccactaactcgtcatctagcattaggtatatctcccaatgctatccctcccccctcccccctccccccaccccacctgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccgcaataaacatacgtgtgcgtgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctgttgtttcctgactttttaatgattgccattctaactggtgtgagatggtatctcatagtggttttgatttgcatttctcggatggccagtgatgattagcatttttgacaaaattcaacaacccttcatgctaaaaactctcaataaattaggtattgatgggacgtatttcaaaataataagagctatctatgacaaacccacagccaatatcatactaaatgggcaaaaactggaagcattccctttgaaaactggcacaagacagggatgccctctctcaccactcctattcaacatagtgtcggaagttctggccagggcaattaggcaggagaaggaaataaagggtattcagttaggaaaagaggaagtcaaattgtccctgtttgcagacgacatgattgtatatctagaaaaccccactgtctcagcccaaaatctccttaagctaagaagcaacttcagcaaagtcttaggatacaaaatcaatgtacaaaaatcacaagcattcttatacaccaacaacagacaaacagagagccaaatcataagtgaactcccattcacaattgcttcaaagagaataaaatacctaggaatccaacttacaagggatgtgaaggacctcttcaaggagaactacaaaccactgctcaaggaaataaaagaggatacaaacgaatggaagaacattccatgctcatgggtaggaagaatcaatatcgtgaaaatggccatactgcccaaggtaatttacagattcagtgctatccccatcaagctaccaatgactttcttcacagaattggaaaaaactactttaaagttcatatggaaccaaaaaagagcccgcatcgccaaggcaatcctaagccaaaagaacgaagctggaggcatcacactacctgacttcaaactatactacaaggctacagtaaccaaaagagcatggtactggtaccaaaacagagatatacatcaatggaacagaacagagccctcagaaataacgccgcatatctacaactatctgatctttgacaaacctgacaaaaacaagcaatggggaaaggattccctatttaataaatggtgctgggaaaactagctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaaacaatggcaacaaaagccaaaattgacaaatgggatctaattaaactaaagagcttctgcacagcaaaagaaactaccatcagagtggacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaactcattttgatattttttaagttgctgccattgcattgtttcaactttatgaagttcccctttatttttcattcattcctagcaggcttgcaggagcagtttggcaagttaagcaagcttttcagttatcttagtttaaatacattaatgctatatatcaattataaaattagcaaatataatctgtatcctttttatgaaatgaagaatggcattttgtatttcttggttcaaactcagtttgtcttcacccttcctttattatcttattttgttataagttgttatagtagtccctcttgatctgcagggatctgcagtggatgcctgaaaccttggacagtacttagccctatatatactgtgttttctcctgtacatacatatccgtgatgaagtttaattttaaattaggctcagtaagatattaacaataataataaaataagacaattataacaatatactgtaatgaaagtaaaataaacgttacttgaacacaagcactgtaataccgcaatagtcaggatgataactgagacagctactatgtcactaatggactggtgatgtataaagcatggatatgctggacagagggatgattcatatcccaggaaggacaaagcagggtggcaagaaattttatcatactactcagaatggcatgcaatttaaaatgtagggattgtttatttctggaattttccatttaatatttttggaccacagttgactgtggataactgacactgcagaaagcagaactgtggataagcggatactagtgtatatgcatatcctttctcttcctttatgcaggtaattttaatacacattgttttttactccaaatgaaatttagtgtaagggtgaaatttagtagtttctttattgttacctgtgtcttagaaatttgtaacacatataacagatgataaaattaatgttaattagacccatcttagaaagttaggtgggtggctgtcttcctaatctttttcctttgtgttttctcttgctttctgctctatagggatatgtattgtcatcatatgagctattcctcttaagccagtatttcatactggttaccataattgggtgtttctggtttcggcatttagaattaaggtgggggaaaaaggaatcattctcctctacctgtaactttaagtttcataaatataatgtgttgagtcgtagtcatcagagaagctcaaaagtcaatgaaacgtaaggaatttgaaacatatgaaggcttctttcaaaagctgctagaattaccttctgtttatctaaaaccttataattctgtacccaggtatattacctttagggattgagggcacaatgaaacatttttagaaaaaataataaagactaagaactattgaaggatgtacctgtgaaaaaagacactgaaagtaaaaggaggaatgggttacaagattcaaagataaaaatataaattggataaatctaattgagctacatgaaagcaacattggaaacattattaaaacataataaaatgcaatttggggagagaatgattggcattaaatattgtcctatttgtaaagaggatgtatttactaatattaggtgaaacagacattaaggcaataaaagcattatttgggataaataaggtaattaggtaatgataaaaagaactaagtaggaagatagtaacaatttcaaacttctactcagttcataaaatagccttaatttttaaaagcacaacttgacaaaactgtaagaacttttcaaatgtacaacaaaggtggaagaacttaatatttttctcaataattgatagatcaggaagacaaaataaaagtaagtaaataattatctgaatagagttaacaagctacctaatacaaacataaataattattcagcacattttagggagcattgtctatgatctagacacttctctaatcacttgagggaccagcaatgaacacaattggcaatggtcctgtgttcatacagcttacattctagtgggagagtaatagacaaaaataagtaactgataaatatatgatatgctaaatggtgaaaaatgccatgaagaaaaataaagcagattaaaggaggtaaggagatgcaaaatggtagggaggagggttgctattttacatattcagtgatcagggatgcttaactcataagattatatttgaggagagacctgaaagaagtaaagggtgagccatgtgagaagaatgtcccaggcagaaggaacagcagttaaaaagccctgatgcaagaatgtgcttggcctatttgagaaacagcaagactagtttgcctggagtagagtgaggaacggggaaagttgaagaagatgttaccagggaacatgcggggaatcacatctcgtagaactcggcaagcccctgtaaggacttaggcttttgcttaagatgagaggccattgaaaggtttcaagccagagaaatgatgtgagctggctgctgcattgaggcgtaaccacaggggattagggcagaaacaacacttaaaaggcttttgcagtaatccaagtgagtgacaatggtgattcgactattagagtactagagattatgtcctgcatgtattttaaagatagtggcaatagcattagttgataaattggatgcaggatatgaaagaaagagaatcgtgaagaataattctaaagtttttatgtgtagtactggaagggtgaggttgtcgttctttttagggaaagggtattagacatttccttttgaatatattaagcttaaaatatctcttagacatccaaatggagacatcacgttattgttgagtagaggagtttgaagtatagagaaaggtccaagctagaggtaaaaattcaagatttgtgagcctataataaggtatttgaaaccatgagattggatgagatcaccaagggaatgagactgaaaagagaaaaataaggtccaaggacttggctttcaggcacaccaactcttagaagttggggaaatgaggaagacccagaaaaggaggctaaaaagaaatggtcattaagttacctaaaaaattttagggtcagtttgtcaatttctacaaaaaaggtagctaggattttgatgcagatggcattgaatctgtagttcaatttggggagtgtagccatcttaacagtattatcttttaacctgtgaaaatgcaacgtctttccatttatttaggtcttcttgaattgctttcaataatgttttatagtttgtaatgtacgagtcttatacttctttttaaaaacttattcctaagtatttttgatgctgtttttttttttttttttttttttttttgagacggagtctcgctctgtcgcccaggccagactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtcccgatctcctgacctcatgatccacccgcctcggcctcccaaagtgctggtatgctgttttaaatggaattgttttcttaattttattgttggattgtttattgctggtgtgttgaatacaactgtttttctttatatttgagtttctgcaatcttactgaacttgtttattagctctaatggttttgtggattcttttgggttttctatatgtaagagtatatcatctgagaactgaggtaactttacttcttcctttctgatctggatgctttttttcttgcctagttgtcctggctagaacctctagtacaatgtgaagtagaagtgctgagagaatagacatgcctatattgcttttaatcttagggggaaagctttcagatgttcaccattaaatgtgatgttagctataggtttttgtgtctttatcatgaaaacatgttagattttatgaaacgctttttctgtataattaagttgatagttggtttttcctttgtttcactaatgtagtatattacattaattgagtcagatcttaaactaatattgcatacctgggataaatcccatttggacataatgtgtaatcgtttttatattttactggatttggtttgatagtattttgttgaggatttttgcatgtatatttataagggatattggtctgtggttttcttgtgatgtctttgcctggtatgggtatcagggtaatattgtcctcacagaatgatttaggaagtgttccctcctcttcaaatttttggaagactttgtggagcgttgatgttaattaaaaaaaaaatttggagaattgatcagtgaaaccgtctgattcttacttttatttctggtgagttttaaaatgacaaattcactctctttacttggtaaaggtctagttaggctgtttcttgagtcattgtcagtagtttttataggaatttgttcaattcatctagatgttctaatttgttgatatatatttattgatcatagtaaatatttactagtattctcatataattatttttcccttatatagtatttattcctagtattcccttataattattttttgtttccataagattggtagtagtgttccctctttaattcctgttattcataatttgggtcttcttttttttcttggtcagtttagtgatggcgtgtcatttttgttgtccttttcaaagaaccagtttttagtttcattgattctattttttctattctctatttcttttatctctgctctaatttttattattttcttccttctgctagctttgggattagtttgctttttctactttctcaacttgtgaagttatattattgatttcagaccttcttttttaatgtagacattcacatctataaatttccctctgagcactgtctttgctgcatcttataagttttggtgtgttgtatttttgcttttatttgtttcaaagtagtgaatttcttttgtgatttttttctttgacattttgttatttatgcttctatgttttaatttccacacacttgtaaatttcataaatttctcttatttacacatttctagttttcttccatgtggtcaggtatcatacttgtatattttcagtccttttttttttttttttttttttttgtgagatagagtctcactcttgtcacccaggctggagcagtggcgtgattttggctcactgcaacctctgcctcccaggttcaagagattcccctgcctcagcctcctgagtagctgggattacaggcacacaccaccatacccagctaattttttttttttttttttgagacagagtttcactcttgttgcccaggctggagtgcaatggcgctatctcagctcaccgcaacctccgcctcccaagttcaagctattctcctgcctcagcctccctagtaactgggattacaggcatgtgccaccacacccggctaattttgtatttttagtagagacagggtttctccatgttggtcaggctgatctcgaacttccgacctcaggtgatctgcccgccttggcctcccgaagtgctgggattgcaggaatgagccaccacgcccggccatttttgtatttttagtagagatggggtttcaccatgttggccaggcttgtcttgaactcctgacctcaagtgatctgaccacctcggcctcgcaaagtgctgggattacaggcatgagccaccacgcctggcctattttcagtagttttatatttacattcaatgttagccaaaaggccaagaagcaaacagtaattttatattattgagacatgttttatgacctaatagatagctaatactgaataatgttccgttgcacttgagaagaatatatattctgttgttgttggtttgaacgttctatagacatctgttgggtctagtggattatagtgttattcaagttctcttttttccttgctgatcttttatctagttggtatccatttttgaaagtaggttgctgaaatcttcaactattatggtggtattgcctttttgtcttttaaattcttagtttttgttttgtgtatttggggcttcttttattagctgcttatatgtttataattttttatctttttgatggattgacccttttttccttataaaatgcccttctttgtgtctaataagaatttttttaaaggctgtttttttctgacattagcatggccactttagctttcttttagttactgttcactttgcatatattttctcctttttagttgcaaccagtttgtgtctttgactctaaatcaggtctcctgtggatagtatattgttagatcatattttttttatctattctgtttttatttttttacttatgtatttattttttgagatggagtctcgctgtgtcgcccaggctggagtgcagtggcatgatctcggctcactgcaacctccacctcccaggttcaagtgattcttctgcctcagcctcccaagtactgggactacatgcacatgccaccacgcccggctaatttttgtatttttagtagagacagggtttcaccatattggccaggctgatctcgaactcctgacctcatgatccgcccgcctcgggctcccaaagtgctgggattacagacatgagccaccacacccggccctattctgttttcagttggagaatttattcatatgtatatgcccatgcatgtgtatacattatgttagcggtccccagccttttaggcatcaaggtctggtttcatggaagacaatttttccacagaccagacaggagggataatttcaggatggaactgttccacctcagatcatcaggctttagttatattctcataaggagtgtgctacctagatcccttgcatgtgcagttgacaatagggttcgccttcttatgagaatctgatgccgctgctgatatgacaggaggtggagctcaggcagtgaaacttgcttgccactactcacctcctgctgcacgactcagttcctaacaggctatggaccggtactggttcaagtcccatgggttggggacctcttaataaatatttgttgaatatgtgatacttgttgagtgaacaaattgagtggtcacttatgaccaaataagcaaaaatgttaaatataatactaccatacacaatttagccgtatgtggtatgtgttttttggttttttgtttgtttttagacagggtctcactctggcatcctgattggagtgcagtggcatggggctcaaactatcctcccacctcagccttctgagtgtctgggacttctgctgcataccaccatgtctgactagtttttttatttttttgtagagcagtgtatgctgcccaggattggggtatgtgtttacagtaatacacatcaagcccagtaagaatgtgaggactgtgagagtatttgaatattagaaaactatataatgtgatttataacattaatagattaaggaaaatataccatgtgatcaaaacaatgccagaaaagaaattcttatttaaaattcattgcctatttaagattttcaaaaacagtaacaaaaaagaactgttggtaaactaaaagtagcaatgaactttcttgacttgttaaggggtgctttaaaaaaaaaaagttgctgataactatacttcacagaaaactcttagaagctttccgtagggtcaggaatgagacaaggatgcttgcaatccctttttgtttatagcattatactaaagaaactagacaacgtaataggaaaagaaaaagcaacaattgctaatattgtgattattatcacaaagaaagttctagagacttaaacttctctatagttctgtatttttctagagaacttacactgtttatgttacaaaaacaatttaaaattagagaatgttgtaatatttttaatctgaaataagattgtttttagtaattgcattttatagtttatttacaagtttttgaataatttttaaaataaagttatattttttttcctctagagctacagagacttctgaagtggagagtctgcgacctcctcggttcttcaatgaagatggagttatcagaccgtacaggttgagggatgggactggaaatcaaatgttacaggtaaattaagagctatcttataaattaagattaatttagtcaagttagattttttttaagtagccatttaatatatattaaattatttgggcttttatctattttgcttaattccacttataagtttcttatatttacttagattttaaagtacatttatttactataagatttttttttcttttttacaggcatcaaaaagtttgatatgaaaagttaatgcatgactttgcaagtgaaagccaacagtagattttagtcttaaaatttacaaactacgtacagctgtttcagtattttgaatacaaagaaaaccttttgtattggtaacttttaataggaattttaatgaatctggtttttttatagggtgttcttagttctgcactggatttgctagatttgttggaagcctttgtaccttatgtatcctcgtcattggtggtacttacttaaccaattaaaccatttctgttgtggggttattaaaccactggtagcttttataccagatatataatccttatatccaattacacatgaagaaggaaaagcaaaactcaggaacactgctattgtgaattactcttggattcttgtgctttgcctttgaaaatgcttaaatggccatgaccctcttcctgctttattctagtgtagtctttataaaacttgtgggatttgataagcagttcacatgcaaaccagtatcttttaataatacaaagtagcatctggaacaatagacagtttgaagttagaatctgcttagacaactttcttacttggtaaattcgactttttaaaacctggattatgctgtaggtaactagtaatcatatataggctataccagtgtcatgttgtttctgtggtttagaggtggaatactaaattaaatcatttgtttgaaaacaaacaaggaatcattatgttatgtaggcttgcagatactcatggtagcaataaactgttggaatatgaagcttcctttatggctttaatattttaaatattgtgatatttaatgtgatcagagtaaagatttaaacttcagtattttacctattgcagggcatatagtattgcataaaatatacttctaactctttctctgaggcttctaatatacaaaaatgtaaccatagagttaatatgcaatatttagttaagtgattttatactgtatttaaaatgtttttgaagcatcaaaatcattgtatattgggatagaactggtaatctattaagaggttgtgctctaatggacagattgtgcagtctctacaatgacagtgtatcgttctttggaagatagtaaatttgcagaagtcacccatggctgatacagtcaaaacatgtatttctacccaatacctgccttcccttgttagaacgcatttaacaagttactaacattttactagactaaaaatcaaatatagtacgaagtaaggatgagtgttgaggagagtttaggaatatatcctcattataagtgagcacgttatgatacccacaaggaagccatgagataccaataatttctcatggttgataatttgattttagtgaagcttctcattgttttctgaagctttaaactttgagatgtaaaaacatgacttttgactgtgtacttttaaagatacatatttatttttaataggtcagtctcatcattaatcactaaaagagctatttaaatgactaaaaaccacagcacttgtcagccattacttgtttttcagcaagcatttacacagtattagctgaaatatttgtagggattcaccaagtaccttgggatgttgcagttagcatttttttcttacaggtataaaaagtggattgttgttttgatggtggtgggttttgtttttttttttttaatcaaagctctagtgtattattagcaaacacttaaaaaatatgtaaataccagtactgtggaaaataattagatgacacataaactggatttaaaatccatctcatctgcctagattttatgtaagtgatataatgaaggtgccttaaaatatttgatactttcaaatgtttctcatgttattttcttattttctaaaaaagatgtattcactaaattatatacactcatataataattaaatataaaatacattcttttattgtgtacctttctatctagaaggtagcacattattacagtgtttcctgctggtcaaagttgcctattagagaaatagaatggtaattttaatatattcacaaaataccttattgatatcatcaaaccaatttatacattgagtttgtaccaactagtggaattgtcttaggtctattaagttatggaatattatatccataattacagtctgagtcatagctgaaaaaatctgctttaaaattattctcactctttgaacatttcataatcttacatgttttcaagcaatttgccatactctactaacctttgtgcttcttttttcctttgccatgcttacagaaaattcaattctacagggagtggattatgactcacagtagcagtagtgatgatgatgatgatgatgatgatgatgatgagtcagatctaaaccattaaaattcatatgttctttattttacttggaatgtttcattaacatgttttgtatgacttataccataatgcccatatgtccatttatagggaggtaaaacacattttcttttaaaatgttttcctacacattttcataaagcaaaataattgtattatttaagcacagaaaaaaatgtatcttacatccaaagtagggagggcatccaacatattatagatttgcttttatatattttatagctttgtattgcatagtttgtctttaagagttcaagttagacttaaatataattttgatgttcactggttttattttaaattgccttcttatttgttagcaaaatgcctttttttaatggtctctgtaaattttctgggctttaatgtaatgccactgtgtaaaaaaaaaggaagaaaatagtaatagccatttaatgttttatatttatcattttaaagatatttttgtcaaatttcttttaataataataaacatatgtaatctaa

SEQ ID NO: 1485 - DNA, 240039 bp, Homo sapiens; identical to SEQ ID NO: 1482

SEQ ID NO: 1486 - DNA, 27086 bp, Homo sapiens
tggtggcattattcaatcaaatatacagagtgcttcctttaatatgtacacatttacaaaaatgcactttcacgaggaggggcggccggggccggcaggtgggcagcgcctggtgccacggcacgcgtggacagttgcgaggggtctgtgtgaaggcacttgtcacgagcttcaatactgccgccgtcccaggatgggagaactgcgcagcaggaagggcacttctgaaagcacagtggagagatcgctggagcgggcgttctgggcaggaggaagcacagacggcaggcagggtggactggccagcaagcgcgaggttgacctgccagccttgggccacgccgatgacctcaggccccactaacaaccacaggtgcgtcaacagccacgggccgtgccggcagccagggccacatcaataaccagggtcccaccgaccaccgtaggtcccaccgacagccacaggtcccattgacagccacgagtcccaccgacagccacaggccacaccatcagccacgggtcccaccaacagccatgggccacaccaacacagccatgggtctcaccggcactttggcctggagccacagagaaacccgagtgaggaataaaaggaagattctgtaaacagtgcacaacctctggtaacaaacgctacgatttggtgacgacgcagacaccctttgctctctcctttcatacagcgagtgccacgcacggaaactttacaaaaatagcaactatccgagaatactccattgttttcagcctgacagttactgaataatttatacaaggttaaagaaacgtagaaaataaacatttggtttttgtttttggtggtttttttacacaaaataaagaaactatgcacatggcctcggcctccgggtccggcagacggcatggctcccaccgagggccctgggtcccggcccagctggcagccgcccctactccttgccggcgtagcgggcctcattgatgctcctgaccgcgcggttgtccactttggggcctgaggcccagtgggccggcctccccggcgagcggccaggatctttggtgaatttgtgtgagaggaacttctccgcctccagggagtcctcctcaccgcggcccagatcctcgtcctcctcatcctccctgacggccgcgtggccggccggcccgggcagcgcctcgtccgccctgcgcggcggcggcgtgaagttcttgcactggtagagcacgtccttgtggccccccggccgctcaatggggttgcggatggggttgagcggggcccactggttgttggcgctctcctcccgcggcagccggctcctctcccgctctttcctgcgcttgcgtgtccaccacacgcacaggaccacgcacgccagccacagcacgctgaaggcaccacacagcacaggcaccagcagacctggggaccggggagaagagccggtgggcaatgaggcctgggcacctgcggggcactagccacacacccaggcctgggagggccctgcgggccaggcggccgggccccaccctccggttgctggctcgtggggagggtcccaggacgggggctgggaaggtcaggttgtggggctgggcggctggggcagcaggtgccagggacttctgtgttcctggtggctggcaggatcggcaggatcggccggctctgtgcccaatgcctgagttgcctgcctggtgccttcccaggggcccacctcccgcgcttacctgtggaagagccgcccgtaacaaccgtctccaccttgacctcggtgacagccaggagcagtgagctgttcccccgctgggtgatggcggccacgatggcgtgggccgcgccctggatcaggctgctgtcaggcaggtccctggcagggctgaaggactgcggcaaagaacggcattgtggggatggctcgagggctccaggctcccagcagcctgcccccaacactgaggccctggccacactggagcaaggtgggcgcacgggagacgagagcccggggtcctgcagtggcgacttcaccaccaggcagtgagtggggagtagcggggggaggagtggaggggtggaggctgtccccatccgggcacacaggagagcccagggtcctgaggtgtggggacctcaccaccaggcagcgagcagtggggggaaggggaggggtggaggatgtccccatccgggcgcacgggacagcccagggtcctgcggtggggacctcaccagcaggcagtgaggggtggggggaagtggaggggtggagggtgtccccgtccgggcacacaggagagcccggggtcctgcggtggggacctcgccaccaggcagtgagttggggaggtgtgtggccccattcgctgacacctgctccgtgatggccatcccttcttgtcagttcccagcccccacccccacctatgggccacaccccaggggcaccacaaacctagtgccttcacgaggccacagcaacccggggctgtgcccctgcctccaccacatccctgatggcgccctgacctgtgctggcacacttcttacatcttcccctgcccctactgcccttccatcacccagcagcacccatccatgtcccccaccccctctgcggcctcagggcaccaaaacactgcacgtccttcctgtgcctggccatggcctccaccagccacactgtgccatggccacacccactgctctgcacacccacccaccatgttccagaacattccctcccctctccgggcatgtctccaccccagtctcacccgacccccttggtatccattcacatctgacaccccccaggtccagggcaggtgccagtcccaaagcaggcctcccagggcagactaagcccacggactctcctgctgcctgtgacgtagggacacagagacaaaaacagagcaggggaccgggcgaggatgcagctgcaggggaagcgggctccacaccacagccctgcatctccctcatgctggccaggcccagggagcagttccacgggtctgcggcatggacagcgaggggccgcagggagacaggcctgcccgcagtccttccgcaccaggactagcctcgccagagcctctgtccagcatagccaggacctgcatagtacgggacccagggcccacccaggtgctgctccccactgggcactcaccacggccacctccacagcactggcccccgaggacgcccggtcgcaaagcaacaccagcaggcggtcccgtgccacagcccttgtggctggcagggagcggatcccggagcaaatggcgcccaccgtggtgccctgggcagagacaggcagtgcgtgggcagggcagggccgtgaacctgacacctacatccctggactggcgctgtgggtacacgtgggacacaccctacagcccgcccaggagagcacagcaaggatgccaagggcctgggggggcagcttcccacccggctgtgccctataccaggaggcaggagtgacggtgcccacccgcccatcctcagggcggacccagctccacctgcaggccagtgggggaaggagaggcagggcggggtacagtgggtctcctccagttctgagcccctcctgggagacaggggcccagctccaagcacacagcaggcaaaggtggctcctaggccagggcaaaactgcccacggagctacagcccaagagctggggccaggcagccatggcgccgtcagtccaggccctcagggcagctggacaaacaggcacccccagctggctgctctcccagcctcctctgccacctccacccagcaccaggcccaatgcccctctcatctgaccccacagggccactctctgtgaccaagagtgactctgctcagccaaccagggcctccctgccctgcggggctaggctttcgccatgccacgagcagatgccggcgtgtggcctctgcaagctcagatgccaccaggcccctcacctggggcacgtggtcacggttgaaatgcaaggtgaggcgggcacagttattgtccaggtggccggagcgtggcaggcagggggtgctcggtggctcttctgcgccgcactccccccaggcctcacagggtggtcgcagacactggcctggggccttctccaggcacctttgccccagtgggcactgggcgctcagggcctcgggctggccggccagcagacaaggcttccatccgcaccacacctgggcaggcacgcacaggagggtcaggcgcaggcgcacaggagggtcagatgcaggcacacagatgagaacccacaggcaggcacgggccccatgccaaggagggacaccgcccaagtctgtgagccccagggcccagcccaccccctacccagggctcccagggaggcaggccaagctcgacatcagaaagggcaggcggagcaaggcaggacccagaccaggcctgttttcccaactgcacatcgaagcatggggcctggctgagctctcgcctccctgggtgtccctgagggcagacggctctcagtccatccggaccccagcacccgcctcctgatctcacagagtggccagggtcagcgtgcaccagcctcgggtagggcagggcggctcacgggctgccctcaccttgctgcagtcacggcggccatccaggcagcggcagctgttgcagtcttccacccaggagcttccgtgtgggaacggagtgccccgggaccagcaggatctcccgaacccgatcactgtggggagaaggggctcgagggtcagcagtgggcatctggccctcggggctgggtgtcacccatgccccccaacccgccccaacccagggcaatcacacggggcctaccttcctggcaccgggggccggctcggccgggtgggcagctacagcgatacccgttgatctcatccacacacgtggccccgtaggcacagggcgaggactggcactcgtcgatgtctgcagggagagccaccgctgctcagtgcagtgaggccaacgcccaccgcaggaccggcatggcctagggcagcggggagccagtggcacacaggcgcaagccccaggacaatgaggagcagcccctgcccccgagcccaagctgctgcctgcctgaggccttcctgagcccagcctgaccctggcccaacagcaccctcctccgtctgcttctgcagtgggcctgtcccatcctggattagccccagctgctgcgtcggaccagccaaggggtgctggacagacagctgggccaacacccagggacaacagccctgcggccacagaggagcccacgtcaggctgcacgctccaacccccacagctccctgggccccggactggtcccccaggctggggctccccacttaatcacttggcagggtatacagcaggaaccccacagggcacagacatgtggggaaactgaggctcagaagagaggcaggaagtagttgtggccacactgcccttcaagggacgtggacgttgatgtccccagactcctgacaccgcggctgggctgaggggctcccagggctggggctgtctggccactcactgatgcggcagtcaggccccgcgaagccaggtgcacactcgcagcggaaccagttgacgccgtcaacacagatgccaccattgtagctgcagagcagagggtgggcatcaggtggccccccgtggtatgccaagtcccacccacccctgctgtggcccccagggtgccactcaccaaggcagagggttgcagtcgttggtatctggtttgggagaagagaacgcaggggatcagtacccaccccccaagcgtgccaggcactgtccaggctggcttggcgtgatcaggctgtggggctggggagggtcatcaaggagggtgccttttgctgggggcaggggcagcagggggaggggctggcagaagggactggggggcgagtcgggggcagggatgtcatctgggtggaggaaagcggcccccgcccacacccctcccacactcactgtgagtgcaagtacgaccctcccagccgtcccggcagatgcaggagaaggaggccccgctgcccacgcaggtgccaccattcacacaggggttgggcaggcagctgctgttcttggctgtaaggagaggaggaggagggagcgtctcacctggccctgggctggccctgggtctccataccgcgcccccaacccagacagggcagacagacccgggggcagggggcagggggcaggtggcaggtgtggccctcaaaaaagacccctcggcccatcgcgcccgagggagcggtgcctgggagggcatatgcccggcggtcgcagaggcagcgggggctcctcaccgacggcgcaggtgctgcccttccagccgggggggcaggcgcagcggaaggtgtcgccgctgtcgtagcaggtgccaccgttgctgcaggtgtaggcatcgcactggaactcgcctgttggcacatgggccgctcagcaggcaggccccagaccgccagggccagggtcctgggggcagccccaggcggccagggcctgcggacactcacgtgagtggcaggtcttgcccttccagccgtcgtcgcacgcacagtagaagtcattgaccaggtcgtagcagcggccgcggctgtggcagggatcgggaaggcagtcgttgggatctgggggcgaggacgccggtcagcgggcggggggtcaccggcgctcagggagggcttcccgggggaggaagcactggagctgggccaggtgaggacagagaggggcgggggaggagcgtcgggccgggggagctggcctcgggcatgggggcagcctgggactccaccccatggtggcagcaccccctggccaggcctttctgggtacggggcctgccgcacccagacagcggtccatctcagggtgataaggggcccacaggggtggaggcacaggccgtgtgggcgggtgctggaacactcactggtgtcgcagagctcgccctcccagccgctggggcagaagcagcggaaggcgtccacctcatcgatgcatgtgcccccattgcggcagggctggcccaggcagtcgtcaatgtctgcagaggcgagcggggtgagccagggcctcaggccagcccagccccaccaccagcccgccgttcgtggccactcactctcatggcagtaggtgccagtaaagccactgtcacagatgcaggaaaagttgccccctggctggctgacgcagcgtccatgggggccacacacgccggaggctgctgtgccaggcatcccaggccccgcgtctgacccgcagccatcgatcactatggcaggcagtacagtcaggagtcaggcccgcccctgccccaccacctcccccaccaccccatgccgcacccagcacctctgcaggccccgccagggcacggctcgcggggcacggagcagttcttgccaccaaagtcatcagggcaggcgcagtaatagtcaccctccaggttatagcagcgagcgccgttccggcaggggcttggctcacaaaggtcgacatccacctgcagggtggggggtgcctgtgagagcctaggcccaggcccaggccgggaacacaggccaggcctctgtccatacgaaggtagatccctggggacccccaggcccctccgccctgggcctaacagtgccagccagagcccaagacccctgcccacctgagactgcccaggccttagctgaacgcagatacctgtgggcccccacccccacctccactgcagcccagcttcctcactgtccctcgggaggagtgtggccttggcccctgctgctggcaggaaggacagctcctgagcccctcacacactgcctggccaccctcagagccaagactgtgggtcttttccagggccagccactgccatgcttgcaggtcctgaggtcagacccctgccctgggccccaagaagccctctggacaggaggcccatcctctgcaccaaggccagggcaggatcgtgggcggccgagggtggtagggaggtgggtggggggaggcagggaaaaaggggaagtaaggggagggggtggtagggaggcaggtaatggggaggcagggttgggggaggtggggaagggggtggtagggaggtgggtggggggaggcagggttgggggaggtggggaagggggtggtagggaggtgggtggggggaggcagggttgggggaggtaggggaggggtgatagtgaggtgggtggggggaggcagggttgggggaggtggggaagggggaggtggggaagggggtggtaggggtggtggggaagggggaaggcaggttactttggaggcaggggggaaggggaggttgggggagggggtccagtaccaacagatggtcagagggaggcgagagcatcagccctgagagagatgcccactccgacccaggactcacctatgacaggtgtatacctctccaccatcaggcacccaccctaccccatgtgctctgcccaccagagccccctgccctccagtcccgagggagtgcacagatggacagataggcctgggcagccagcagcccgggggctcctagcccaggccaccaggaaacccatcacaacaagcaatggccacagggggccaagcctggtgacctgtgacagccccgcctgcccacctggcacccagtggagagctgagcctgggacgccttggggacaacttcccctgcagcacccctgggtcactcaggccccatggtcaggggacgaggcctgccctacagctcccagagcagcaggtggggcagggtgaccaggcagacctcacctcacagagaggcccggagaagccctgggggcagtggcagtggaagccgtcggccaggtcctcgcagaggccgccgctgtggcaggggctgctggcacactcgtctcgttccagctcgcaatgccggcctccgaagccccgtgggcacacacactggtacccgttcaccaggtcctgggcgggccagccaggtgagcgtcccgcaggcaccctgacggccccgcagcacccacgccacacaccctcctggccccgcctcaccttgcaggtgcccccatgctgacactgcccgcgacagtcgttgacgtctgggggcagaggagcagggtcagaggcggggtcccatgtgcctcggcccacccgccggcgcccaccccccatactgactgatatggcagttgatgcccttccagcccgggatgcaatcacagtaatagccgccaatcaggtttttgcaagaaaaagcgttaaggcatggcttcccttcacactcattggcgtctgtgaaagagacaaggtgggagccgtggggctcgggccctgcctgccccctgcagcacgggcacctggcacccgcagcccagcagccccagcagccccagcagcccccgcagccccagcagcccccgcagcccgcatgcgcggcccacgttcccatgcactcgctcggagcccttacccagctggcaggtggcccccacccactgctcggggcagatgcactcaaagccgtccacctggtccacacaggtgccaccggccgcacacgggttcgaagcacactcatcgatgtctgcagagggtggagaaaggtggggccctggcagtgtgagccgtgggaataaggtccccatgggcaggtggcgctgcaagcctgggtcttcctgccatttgtcctcgccaagccagccgcagccacacgtgtggacttgaccactgcaccccatccccagcgagttgccccactcccagacccccactgatactaggcaggagtcccctactcacgtgcagacactcaccaagggcacaggtgggcccgctccagcccgatgggcagtggcattcgaagccggacggcacctcatggcaagagcccccgttggcacacgggttggaggtgcaggcgtgctcagctgtagaaccgcggggagggggcagagctggcagccaggcccccagctttccacaagcactcctccccaagcccacaggttcccaagctgggggtcaggggcccaccacacaggacgccagagggatggggcctgaccggctccccagggaaccagtccctgcctggccagaatttgggtggccagccccccacgtacccttctcacagttcctgcccgagtagccgtcagggcaggtgcagcggtactggtcaggctcggcgttgatgcacgtgcctccgttggtgcaggggtggtggctgccacagtagttcaggtctgggggcaggggtgggatgctcaggggaaaagccggccccccgctcccccacaacccacacttcgatggcagagcattaggcctgccgccccctaccactacctttgtcacagagcaggccgccccagttggtctcacagttgcactgccagggctccacacaactgccatgcacgcagccggggtaggggacacactcatcgcagaacctcccttgccagccgtagctgcacctgggggaaggaggaggggcgcaagacccagtgagctgtggtgcctgaaagggtggcaggggagccaggcacagtcacccacgccacacccagggccggcgggcggcctcaggcctttgaactggagcagccccagccaggcaggggttgcagccctgccggccagccccactgtcacgggcattcccggccgctggctgccgacggtcagccccagctgtcccgtcactcctccctgagctattttgggattcacccgtgagctgggccccgagagcaggcaccaggaaaggaaggccctgccgggaccccggggatgagaatgccggctcggactcacaaggtgctgccagggccgggaggcaccaggggctgggtaggccagcgggcagcaggggagcactcctggctctgcctcggccatgtggccctgggcacagcacgtgccctcgcccccacctcaaaggcagtcatttcgctcgctcccagtaaagtcccacaaggtacccatctcacagatggggctactgaggcccacaggctggcctgggccagccctgcccagggtagttcctgattctgcaggagctccagctgcacccccagctgcaccccccaggacacaaccaccaggactcgccctgccccaggctatcggccaacgtcctgtcttgggagtcccccaggagagggcaggtggccagggtagaacatggcctgacttgagggtgcctccgtcaggggagagagcctgcaacgaccccaaggctcagcaggctgccatccaggccctgccgggactcccggggggcccttcctagaactctccggtcctgcaggacgggaatgtcatccaggccacgtcacttccacaccggcacccgccacactttatttttgtaaaaggaaagaaccacggcccttcctgagccgccctcaagccacacagccagcaccgaaggcctatcagcccagttcagctgccacaaatggggaaactgaggccgggaagaacgtgtctccagtatccagcccagcatgcacagtggtccgcgtgggtggcctcacatcccgcctagaatccctcctccacagacacagagacccaggctcagggcggggctgtgacacaccttgggtcatcggccagagagcggccacagccgggctcagagcccagacctcgtgggtcccaagggcgtgctctcgaccctgggcagggcagcccacaccaggcccccacctcctggtttccccagccagcagccccagggccctggagaggcggcggcaggaaggcatggccatctccgcagcatccggtgggggggcgtcctgcactggaacctgagccgaggctgtcagcaacagctgggcctccccgacagggccagcaagaggggcaggcggagctcacctactgcccccacccaccaggccccccagactccggctcatcttcctgcgggtaaagggcagggatggccaacttctctgctgccttcctccagccttggtgtgacattcaagctgccagccagcagccatccagggagggtggcactgccatccaggttgtgtgatgcacactgggccaggcgagggtgagtggggccgactcccgtagatctacatctacatctgcccagaccaggtccaccttgttgcactttctgagctgacttgggactcgctcaacctgccgggaatccctgtgtgtgcaagtgaccgggtgggcggccccagccctgcttgcctccccgctctgggactggccgggaaagctcctcactgtaccctccaggccactcaaccgtggggcctgtggaagggtcacccacctccccaccttggctcccaactcagctggttcccaaactccccgactcctctccaaaacgccacgctgtgtgaccctggggaaatcagtaggctctctgtgccccagtgtcctcgtcccatggaggcaaacccactccacagagggaggtcctgggacccctgcaatccaaggctggctggagggcggtgctcacctccacctgctgtctctccacccgctcgcgcccctctctcgggctccccagcttgctcacgcacagtgagcgccacggctcgaagcccgtgcccaccccagaccctgggccccagcccctctggttgccctgctgacttctctgctccactctagggcaaagctgccagcccccctggctggatcccccacactctggtctgggtccagaggcctccaccatctggacttggctgtaagaccccggacactcccttgtggaggcccttgctgactcctcatccatccgccctgacctgtggcagccgggacttgctccttggcctccctcctctctgccttccccactttcccgtcaccgcctgaatgccaccccccacaggccccgcgtggcgcaggccaggcctctcccacgagctttctgggtgtctccagggacagggcaggcatcgcctctccacatccagctaaccccggccccgcctgctcctctgtggcattcctcctgccaccatggctctgctactcagcagcttggggttctccctgactccacacccttcctgcttgatcaaatccatccacaaacccctgggctccaccccaggatgtctgcaggacccgtgcgcctctcccccttccactgaccccctccccatcccgctggcccctcccccaccacccccacatgccccacagcggcctccccctcacagcctcccgtctggtgcttccccactcaacagctaccacagcccttccacccaccttgcccagctacaaacctgccagcagccccttcctctgtccctggtcctgcaggcctcagctcccaccactggtctgctctgccgcccctcgcctgctggtgtcacttgccggccgctcgccgcccaccccctccccatgggcagggttaccgtgtcctctgcccatgccccatctctgggtggcttgcagcctccgggtctctgcccctcggtgacgtgactgtccagccagcctccccagtctctcctcactgtcctcacatggctgccgccatcagacacatcccatgctcagacacgcacctactgcactaaggagcctcccgagctcagggcccggctctcacagctgtgtgcccaacctccagccagctccgggcgactcctgacagcaaggctgtgtgtgccagtgaggacgtgagggcaaaggttgggagggcaaagacgggccggcggcacactcacctgcactccccaggcacggtgcatcccccgtggagcaaattacacccttgtttacacacagctgcgaacagagaggagcgagaggcacagctgcagccagcctggccgcaaggcctgtgcccggggccctgcccgaggccctccctgccctccacgcagcccagcggccccctcaccttccttgcactccttgcccatccagccgtccatgcaggccttgttgccgtactggtcgcaggtgtagtggccgaaaaagtcgttgcggggccggcagaacttgttgcaagtggcgctgtagtagttctcgtcgcagcgcacgcggatctgcagctccaggtgcgccacgtggccgctgaagtgcaggctcttccagcggtcctccgggttgatcatgccggcatgcgacactcgctcgatcagcagctcctcttggggaggcggcagagtcagcacaggccagagaaaccagcccggccaggggtcctccaggaacaacggggacggggcagaagcctgcggctgctgcaaggccggggcacagcaggcagcagcacacggagggcagggcccccggccaggctgctacagaaagctcagggccccgagaggcctctccctcccgccaccaagcctgcgccccgctcccaccctaaacgcagagggtcggggggcccggctaggggctaggggccctgcagggagggctgctgagaccacaggctccacagagaaggcacggctgctgccagggcgtgagtctcacgtcccacacctgtgcccacccacctgcagccctgctccaacacctgcacccacctgcgccgtgtccagccctcgacagcacggacatggtgctcagttgccctcccctctcctgcgctgtgacttgctcccagaagtgccaaacaccactaccgtccccaccttaagacaagcctcccctcaggcccccaagacaggcataggtcccgtgacccgctgtctaagcctcactttaagtaagccaccaggagaccaggggccaggggcaccacagctgctggcgctggtatgcaaagtccgtgatgccggtccctgcgcttaggcacaggctcgacgttttgcacaataaaaggtgaacgggtcctccagaccccacctctcccgcctcgggccaaggcctgggaggacactgtgctggcccactccccaaggggcgtcccggccgccccagcctctccaggctcacgttgtcaagagccctgacgaccttgcttgggactcagcccacctgtctctctgccaccccctcaggaaacacccctgccctgagccgctggggtccccacaactgctgctccccacctgggcacccccaccgccgtccctgccctgaaaacagcccctccactctgctggcagccaggatgccctggccccgctctccctcctccaacccattggccaaccccatgcctccacttctgagagcccctctcacccccagactgcccctggtccaagtcaccctgacacgcccagattcacgtggcagctcctcctcggtctgtgtcctggccccacagcccaccctccataaggcagccacagcttgccaggcggagcccgtgtcctctcagtggcttgccagcctccatgatctgagcccagccccggctgctccccctgcacagccagcccgctcctgcccagaccttcacacgagctgctcccttggcctgtgggtgcttctgcattcacccatggaagtcatcccgttacccctgcagggccctgcagagcccctgcctcagggagagggccaccaaggctccatgctccagtacagacaagcagagggggccacaaagccagagacacactcaagggtgtcccctccactaagtcactgccatgggccccaaaagagcacacccaagaggagaacaacataggcaaagccaggactggggaagagagtgcatgcacagctctgcaagtcccaaacgtggcagagcttcctggcagccaaagcaaaaagggaaacagcacacatgatcctcagggtaaagcaaggctttgtcccaagcagacagaggagctgggccctgccacaggcacgctgaagctgagaggagctgccacctggcccagggctcactcaccattcggggtggtatcgttgtcccagtcccaggcctccacgatgagggtaaaggagcgctgcagacatggggaggcgggtcaggtacctgaggccacacctgcctgcctcgttcagggtgggacaaggcccagggctcagacgctgcccctgggtctgccaggctctggcccttcctccccagccagggacccaccaccctcctcatcctcaggccacatcctctgcagacccaaaaatgacccagctcaagggagggagactgcccctccaggccacgcgggctcaggggcctgggctccctaccgttggggtgccagaggcccagcctgccctgagctggctcaagtcagcacggagcacaggaagagcgaccggggggagaggtgggcaaagggcagcctggctggagtggccacagacaggggccccatgggcagccgggacccgagcgtttcctgtggaacgccccttggtgcctcactgggggtgaccacgggggagaacgtggggccccatcaccacgctggcggcctccaccaagtgcacggggtggccaagtacagggcgcccagccagaggccccaacaggccggagctcaggtcctgcaggcatacagcacacaggcaaacccacacctacctccaccctcacacagaacaggtggcaggaggggcccttgcggtacagttggggaaactgaggccaagaggtcctgggactgcccagcacagcctcagaccatggccactatgccccctctgcccccgggccacctggcccttgtaccccagccatggcgacaggcgatgctgtcagccaagcaaagagaccacagggctggccccctgctccgcctagtgcagcccacggagaccgtcactcacagacatgctcagacaggtgggacccccgggacatgccctgtactacccagcactgggtacccacattccacagcctctcagccctcactgcccaggaaccccccagtctacccctggtgtgctcttgacccctgagcccagccctggctccttccaggtggggcccagaggagggggctggggctgagtcacctcagggcctgctggcttcccaccccggggggatgctgcgttgggcagtgtccaggcaggccaggctcactccatccctcagcacaccccatccaaccagccccaaggcctggctaagctggggaaaaccacacttccccagcaaggcccaaccccacgcctgccagcccttccctggtcctcacccgccgcccaccccacgcacgtcccagtgcctcggcctcatccagctaaggacaggcctggcctcccaagatgtctcagaagactgcactcccacgtccagcccctcccctaaccaacgtgctaccagccacacccagcccagcctccaggacccccacccagtcccccgccccacacctccgactgtccctcaaatacagacaactagggcccaacatgactgctgaccctgggcctcactcacagctgggcaaccccggccccgcccccgagcccctgcctgcagaacacccggggacggcccgaggaggctcacccaggtaggagcacaggatggaagtggggggccatccccaacccgctcctagaaccctccctagccacgtcgagctgacaacagaccctcaatcccacctcttaagctccccttaaacccgttttcccacatccgccatggccccgccaggccacggggcccagtccccgcccatctccagggctccctgaggtcaccagggcccgcaaacctctgcctacaggcgccagacaatccccagagttccatccacatgcctcccaaggctccgtccacaccccccgccgagctctgtttacaccccccagagctccatccacacccccaaagaactcaatccacatcccccaacggggttccatccacaccccccaacaggctccatcacctccccagggctccatccacaccccgcaacatgctccatccacacccccccagagctccatccacacccccccagggctccatccacacccccccagagttccatccacacaccccaacatgctccgtccacacccccccccagagctctgtccacaccccccaacatgctccatccacaccccccagggctccatccataccccccagagctccatccacaccccccgagttccatccacaccccccaacatgctccatccacacaccccaacatgctccatccacaccccccaacagggctccgtccacaccccccccagagctctgtccaccccccccaacatgctccatccacacccccccagggctccatccatacccccccagagctccatccacaccccccaacatgctccatccatacccccccagggctccatccacaccccccaggactctgtccacaccacccccaggactgtgtccacaccccccaagggctctgtccacaaaccacccccgtcagctccatccacaccccccagggctccatccacacccccaccaggactctgtccacgccctctcagctcagagcacccttggggttcccaaggctcctgcccacccccacccacccaccccagcctatcaacccatctgcctggagcaccaccctcgcagctgcacctggccaagcccttccccacccccggtaacacctggagcacccagccgcttcccaggcgtctggcatttggctccttccttcgttccttccttccttcgttcacatcaagtgtacagcaggcatgcctctgccaccaaggacggcaacctatagccagcggggctcggggaaagcaacagggggcaggggctgttgttccaataaggccaggccaacgggtcacagtggctcacgcctgtaatcccaacactttaagaggctgaggcaggcagatcacctgaggtcaggagttcgagactagtctggtcaacacggttaatcctcatctctactaaaaatataaaaattagccagccatggtggcaggtgtctgtagtcccagctactctggaggctgaggcaggagaatcacctgaacccaggaggccgaggttgcagcgagccgagatcgcaccattgcactccagcctgggcaacgagggcaaaactccatctcaaaaaaaaaaaaaaaaggccaggccaggctttgaacaggtggcattgagattgaggctgcagggcatgaggaagtgaaggagctgcatggcagagcccacaagaaggcccaggggctgagaacgcatagcccacggggacagtggggtcataccacagatccagaccccaccacggacttccttcctgaggctaagcgaagtgggtgactgttgcgggtctgagtgaggtctgttcgggtgttgggggtccgagtgaggtctgttgggggtctgagtgaggtctgttgggggtctgagtgaggtctgttgttgggggtctgagtgaggtctgttgttgggggtctgagtgaggtctgttgttgggggtctgagtgaggactgggacccaccaggctttaacagtcactgtagccgctggacaggaaccagcaggaccaggaagcagcaatagtgaggtcagaggatggggccagcatgggtctgagagcagctctggccacggggcaggcagagaaaagccaggccacccggtctcccggcacagccacacctgggcttcagggccagcagggagttcctctcgactcccaggaaacctcatgccagccactcaggtaagattactgccaccttcgcctgagcccagggctccggttacctgctcccgcagggacgtgtgcctgcccgcccgccgagagggcctcaccgcccgccagctggggtccctacacctggatggcaggaagtcatccagagtgaacctgagctggctgacggggcggtacctgcctcaccccacctgccagctctcccagctccccttcttccctaggggccagcctccaggacttatttgcctcttctgtgaataacaacctctcacccccgtccttccaggactcagttgcctcctctgcgaatagcaacctctcatccctgtccttccaggactcagttgcctcctctgcgaatagcaacctctcacccctgtccttccaggactcagttgcctcctctgcgaatagcaacctctcacccctgtccttcctgcctggcgggccacgatctgggacagggttttgtcaacaccaaacccctagaacacaggagggactatagggcctggattgggcgggggttggcgggcatgttgcccttctaggaacggggctgggacatgtggggatgtgggcctggcgctggcaggggcaataggcgatgtgtgggctgggggtctggggacaggtgagagacccatcacctgcccaggttccccggcaagcagggagaggaacccaggccctccctcaaggccagcctagcagggctatgcccctgcccagtctctggaggccaagggggaagggcttcacccctgcaggcccagctaagcctctccctacaagcccggcctgacccacccccaccgcacaagcagacccgcagcccaacttcatctcccaccatctgattgcctcctccccagcccgaaccctcaaggctaagtctaaacccctcctcctgtccccaggcaggggcaacagcagtggcacaagccagaggacaggcagacaagacaatagatgttccaccccaggccagggcacctcaaagcccagggtaccccaggtccagggcaccccaaagcccagagtatcccacagcccagggcactgcatggcccagcatactccaagacccagggcaccccagttccagggcaccccaaagcccagggtaccccagagccccaaagcactgcatggcccagcacaccccaaggtccagggcaccttaaagcccaggacacctcaggtccaaggcacccaaagtacagagtaccctcctgcccagggcaccctagatccagtacaccccacagccttgtgcaccccatggcccagtgtacccacagtccagggcaccccaaagctcagggcactccaggtccagggcacccccagcccagggcactgcatggcccagcacacctcatggcccagggtactccaaatgccaagcaccctaagtccacggcaccccactgcccactgtaccccaatctacagcatcccaaaactcaggcaacccaagtctagggccctgcacggtcaaggccaacacagcctccctgctgccccgctaacggcccccccaggtccagggccctgcacggtccaggccaacacaacacagcctcctagacctgctgccccaccaacgccccgacttggtttcttctcctcggcctcccgcatcagcctcccgccccctacggagcacagcgcttggtgcaggcgccaggagctccaagcacagatacatttcctgaaacctgagcttctgagaggcccaggcctctgccaccattgtcacccgaggcagggaagaaggggtgggggcaaacaccatccccagggctctgggccccagggccgcagcaggaggagcagaccaaagcccatcccacgcaggaacacacacacccatgctccacaccagagaccagccagggccttgcctgggtgtacccccactccccagcacaccccctctaggtcccaggtcccccaccgtgaagacggtggcagccagggccggctagcacctgccacaaagcccagggtacaactgatgccagccacaccctgctcaggcctgggatgtggggataggaatcccgctcaggcctgtggtctggggacagggactccgctcaggcctgtggtctggggacagggcctccgctcaggcctgtggtcttgaggacagggactccgctcaggcctgtggtctggggacagtgacctcactcagatctggggtctggggacagggaccctgcttaggcctcaggtctgcagacagggaccctgctcagtcctgggacctggggacagggacccagctcaggcctggggcctgaggataggggccccactcaggcctggggtctagggacagggactccaatcaggcctagggtctggggacagggaccccgctcaggcctggggtctggggatagcgactgtggctggggcctgggattgcagatccttgtcttcctgcccccactccaccaccagcagcagctcaggccgaagcctggctccacaagcaccccttcactggcctagcttgctcccctcataaagacaccatggagcagcccaggagggcccctgagagcagcagtcccctcccacccaggcctgccgcctgctccccaacccgcccctccacctcccagccttcctatcgtgctgcggctttgacccttcagcccaccctcagggaccagcgacaaacccccagcccactctccaatcctccctggccaagggcagtcctccctggctccaatggtccccgtgttgcctgggcactgaatgccccaccctgcccccataccaaagctttgaaccagacccccaatgtacaaggcggacatgccctgagttctccccagggctctgggccccagggccatggcaggaggaacagaccgatgcccacccaacacaggaacccagatgcccacattccataccagaccagccagctctcctggtccctactgggaaggtgtgggaaggaggggggtggtccccagtgtgcagacaggatcccctgaaggtagggtggggaggccagggccctgtcatccccagcccaagctcagaaaaaacaggaagcagagtggtgctgaacctcacacctgccacgagcagcttaggtagctccaggcacagacctcagcctggcccaccttgagccctagggcggctggatgcagggggtgggctctgtaaaaaccttcctccctagggggcaaaggagagggtagggaaggctgggaaggggaggaactggacaggtctgggagccgggctgggggcacaagcagagcccgagctgggagtccagcagccccatctgacttcgtgagacctgcaatgaaaaagcggcagtgtgcccctttcacaggtgagaaaagctcagcccttctgatggcccaggacctcaggcctcctgagctgatagacgcagggtcagccccaggcccacctcctgtatctacagggccttcacccatcccgttctcctcataagcccagatctgtcacggggaccatgctccagccacaccaccccgcacagctgccctggagcccagcacacacatgccaagacagaacaagaaagaccctcgctggcaggcaggctcctgggctcctggctccagagatgggccagccaggcaggcacgacttccagctgcacctctgagggtggggccctggctgcccaggtcacggccaactgccaccaccctgctcctccctcagccagcaggtgtcccctgggcctgccacctaccaggccccagagcaaagctccctgctgcccccagcatgacactactcctccccaaacctccatcaccacctgccatgcctacagagcacccggggtgcgtgcacacacgcagctgggagaatgtggcctcaccctgccagctacaagccaggcaccagaaccaacccaggctgacaccggcctcctggggacgtctgggggtggagccaggagaggaggggcagccaggcagcctgctggcatgtggtccaccacctctccacattcaagaccctgggcccacccactgagggaagctgagcccgagaccagcacagatccatgactaatagcacacagaccccggccacaagaagccaggccagggggcagagggccacccagccaggcctgggtcaacagcagagaccacaaggtgggagagtcactcagggggcagggggtggagggagcgaatgcagagcccagactcccccactcctcttccacaaggccctctcattccctttactccaaggagcccaaaagccccacgggcctgggcaggatgccaccctagcctccaggctgaaacccctcctcaggtcccagggagcctgaactcggtccttgccttcccatcacagccaagtacacctcagctcaccgcacagagctggacctcagcaagccagggcagcatggccagggactgccgccgcccgagtgcaaataccagggtgctggcatcacggcacagctcccgcccggcagccaggccacatggcaggagaccagggctgcccccaaacacgcagctatgactctgccctggcccccaacccagagacaggccgcctgccccctcctggggcattcgaggaaccggctggaagcaagaggcagggaggtgagctggccccgaaacccagtgcccggactccaaggaaggcaagggcctacccggtcccatcccacacctgaccggctggcccgcggggcgaagagccagggcggacacgcgatagcccgccacattcctccaagacctccctgcccccacacccactgctgccaactcgagcagaaaacacatcctcaggtagcgatgtggggccacgctggctcaggcccaggtgcagatgacaggctgcgggccctgctcagacctgcctgctgcaccgccgtgggggcgaggggctgggcttctcacaactgcctgggccctcccatgcccgcccctgccttttccatctgggggacactttcccctctctggggcccccctggtcaagggatactcggcggggtgctcacgggttgaggacatggccagaggagactgtggccagcttccacgggtgggagctcaggaagcggtgaggatgggggcagcaggcaaggctgccagccagggctgcaaaggtacagcacaggactgggagccacacacggcaggcccaactggcgtgagctcggcagggattgccctcaactcacaatcacttcagggcccaggataccaggtgggcacactccggtgcctcctgctgactggagccacttcctggctcccagatccatctactccctgatcacaggtctgcatggtgctctcattcccgcactcacccagttccaggcccccagcacaatgaccaagcagggaaggacctctgggcaccagggcaaggccgtgctccaggcaatgaggtaaggcgcccgaggcctgggcctgcccacctaccactacccacctgccagcccactgggatgagtacctgtttcccagtgacactggacccctaccacccctcctcccagcacgcccaggccagggctcctgcctgactggccacctgccaggggagaccagacagccccgactcagcttctgcccctccagaataacaaaaccaaaaaaacccacaaacagggcagtgccacagaaggtcactgcaccaggatccactatctctgtctctgaacgatcttgggtcaccatcgggggcttctgccgacataagcgttaggcgttaggctctcccgggcctaggtcccacggcgcccgcccgtgccccccaggcatccaggaaactgcagggcaggcgcaggctggccacgggcccggggcggctcagtcagggcctgccctagaccagccccagcacgcgctgcgcacatgccaccgcggcctgcccgggaccggggcgcctcgcctcgcctccccacccagacagacacgcgcagggcgacgcaggcacacgccgcacaccgccgcgcacgcgggacgccgccgccccgcccccgccgcgaccccgctcccggtggccccggggccccggcgcgcccacgtggccaggcgcggaccaagtccccagagcacgcgccccctgccggccccgccccgcctgggcgcgcgcggctcgcacgcagacccggccgcaggtgttgggggtcgcgaagcgcgcggggccggggcgcggagagagagggaagggctggagcacgagggatggagcgcacgtaccggccaggcgaactggaaggggatgacgacgaggcccgggtcctggtcgccgccggcccgggcccgcgcccgcgctcggtcccccgcagcgcccgccggcggcaggtagaaggagttgccgcccagcacgggcgtggcgccgtggccgtagctgcagggccccgtgggcgtcaccttggcctggtactccttaaggcacacgcgcacgtacgtgtcgcactcgtcgtggccgcagccccccgcgcgcgttgtccggccgtcgccgtcacagcaggcgccgctcagcagctccccgttcacgttccgcagcgcgctcagctgcagctcgaaatagcccatgggccgcgccgcctaaaaataaggcagcgggagagcggagggaggcgcgggccggggtcggcgggccgggcgccaggggtgggggaacaggccccgccgccccgcccccacccagccgcgcccgcccggagccccagccgccgcgcgcagcctcgagggcttccgaaccacggcggccccaggcagtgcccgcccggcccctaggggcggcccggtgtgccccgtccgcgacccccgccgcccccgccgccccgctcacctgcacccagagcgccagcagcagcagcagccgccggggaaggcgcccccggccctgcgcccgcattgcccccgcgacccgcccgcccggccccgccgccgccgcccgcgcccggctcccagccgccgcgccggcctcccagcgcccgcccgccctccgagcgcccgcagaggcagcggcagcggcagaggcggcggcggcggcggcgcgggcggggtcgagcgcagcgccgcggcgcgcgggcctgggcggcgggcgtgcaggggcggcggcagctccggctcgctggcggccgcgctccggctgcccggcccggctcccacccggcggcgacggcggcggcggtgaaggcagcgggtcccggcctcggctctgcgcgcccgcgctcccggcaccgcagccaacaagttcggaacgagactgacagctcgctcgcccattcgtcacccgcgcacctgcatatgcatgag

SEQ ID NO: 1487 - DNA, 27086 bp, Homo sapiens; identical to SEQ ID NO: 1486

SEQ ID NO: 1488 - DNA, 83404 bp, Homo sapiens
ggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggtacgcgccgcccgccgcgctttgttcccgccgggcacctgctgggggtgtcctggccgcggcctctgcgcgccccatccccggcccgggtcccccagcggagcccaggtcgccccccgcgcccccgcccgccggttcgacgcgtgcagccgccgcccccccgcagctccggcaagcgcggccccagccccccaggtcccgagcaccgggggccgcgctcagcttccgaggacccggtgctgctcagacccggcgggaccttggggctcccgggcggcgctcacctggctcgccgcaaccgcacctgcacacctgcctcaatgcggtgccggccggggtgacgagggtgcttcctctctcgggtaccacacgcttcctttcgcgttcggcgacactgtcagacctcggcctgggagcgacccccggcgcacggggcgcgcaggactcggttgtatcctccgtccagcgcgcggtggagatgccctgtcctgcggggcggggtcgtcctcgcgggtacctggttggcgctgtctctcatttagaggcgtcgccaagccagtactgctatttgcgcctcccagttgatcttgccattgcggaagactggctgttctgcacttggtaggggggcgcccggtcgcccagcggtaacgattggacagggtttaccctccggccatagcccagccttccttggacttgcagcttccctgagtctcctgctcagtttgaaacttttgtaatttcttcgtgacttggtagttcctgctcaggaagctcccaggctaaggaggagagagacacgctctccggaaaagttctggttctagaatagacagcaggcgagaagaggaggcggttgggggtagtgagagttctccctggggagatgggagggtgagcggaccttccaggcactggaagtggccagtatgcctggaggggaccccacgtggcattgagttgttccacccctagtcagctgcaggtgggcctctccgtgctttcctgtggctcccacagcctgcatctctgagcgtggtgttggagttgcagagccgctggacagtggggcttgccctcctggagcgcagggttgggacctcggggctttggttttgctgagtggacaggaaggatgcccacccggcacgactcttgcacctggcggggcctcccgaaggacccagtgtccatatgagacctaagggtcagcatttgcccaaggtctggggccgagcactgcagatgtgcctgcttgcctctcttctgggaagtctctggggcctcaaagccaaagccaggagcatctccccaggcctggctgcttctccattccaggtcttggcgattgccccaatgtcaggtcccacagccccacagcccttctcctgtctgcccctctgagtcactgcctcacccacagccccagaaccttcatgcgggctgttggcgctcccctgctccagcactgcagcacatagcctgcccttgctgaacctctgcagcagcttcctggggccctccgaatgagcagcaaagtctttaacccaagggaggtgggggcgtgtggcaggaggggccgggggccttatcagcccccctgtggagctgtgctctattctccaggggtctagaaagcccactctggtgtctgtggggagggtatgggtagggcgggtttcgagaagcctggttaggacaggcgggggtagatgggggcacctgggctgggtagcactaagtgctggggggggtcccgagctctggcctggacagggttgggaggaagggtaggcaggaggacaggatttgttctgttggtgtggagttaatgggcggaggagttaatgggcggaggggcgagtggcgcagctgaccaggtgggcagatgcagtttgttcgtaggacatgctcagcctcataatgagctcctgcccttacctgtcctggaacagggcccctcataggcgggcttgcccctagctttgctttgtgcttgtgccgcctgtccgtgcatcctcggacagtctgctacttagttttgctttgttcctcctgagttcttctgtactcctcacttttgcccagccatgaagcttctgggctgcgtgtgtgctgatgcctttcggcgtgttcactgctgcgtactattcactggcgtgacagtacctcggctttgcttctgtcaagggaccttggcttgtttccagttttttggttaattacaagccccgtgctgctgtggacatcgtgtgccagtcttctgcgtgtgtctttctggatgggcagggcctgtcttaagcatgtaccgccagctaccaggatttatggtgggggtgtgcacgcactcagcgttactgctgggcagttttccagagtggttgtgcctgctccggcccccactgacagggacgagagtccccactgctccacatttgtgccaacactcatttgacttaatttttgccagtctggtgggtgtgaagtggtatcgtggttttaacttgaatttctctgattactaatttaggccatttgtacttccttgtcagtgaaattcctgttcctttgccagtttttttttctctttttttctgcttgagtttcagcagtttctttagagatagtcatcctttctcggctgtgttgaggatgtccccgtccagttatgagcgagtctttgctctctgagcagcctctgggtgcactccccgtgtcagcctggtggagtgtgcacattgactgtttgccaggctggggtgctggtctcgtttcggttctccttctgggaggcagccggagaagtctgcccccgggagcttgaactgggcatgctgggctgttgttggggaggcctgtgctccgggtttccttgcgacgcttttggctcagcactgttacacacggtgctcctaggtggtccacggggtatgcgtcagtgcctgtctgtggcctctgcctcctgggttcccagagtgtcctcctggtgcccatgtccctgagcgcccccacctgctcttcagcaagggctgggctgctttgtaccttgcccttcccacttgattgttttttcggttgatgtttattaatttgtttttatttatgtattttgttgttgttgttgcagagacagggtctccctatgttgcccagactggtcttgaactcctgggctcaagtgatcctctcacctcggcctcccgaagtgctgagattacaggtatgagcccctgggcctggccatctgtttggtttttagagacagagcctcactttgtggcccagactggggtgcagtggcttgatcatggctcattgtaacccctaaaacctgggctcaagcagtcctcccacatcagcttcctgagcagctgggactacaggtgtacaccaccatgtctgtctaatttttttgttttgttttgtttttttgagacagagtctcactctgtcaccaggctggagtgcagtggtgcaatctcggctcactgcaacctccgcctccctgtttcgattttcctgcctcagcctcccaagtagctaggactacaggcgcctgccagcatgcccggctaatttttgtatttttattttatttatttatttatttatttttattttattttattttattttgagatggagtctcgctctgtcacccaggctggagtgcagtggtgctgtctcggctcactgcaagctccgcctcctgggttcacaccattctcctgcctcagcctcccgagtagctgggactacaggcgcccgccaccacgcccggctaattttttttatatttttagtagagatggggtttcaccgtgttagccaggatggtctcaattttctgacctcgtgatccgcccgcctcagcctcccaaagtgttgggattacaggcgtgagccaccacgccctgcctattttatttttttgagaagctctgtcgcccaggctggagtgcagtggcacgatctcagctcactacaacctccacttcccgggttcaagcaattctcctgcctcagcctcctgagtagttgggactacaggcgtgcaccaccacgcccagctaatttctgtatttttagtagagacagggtttcaccatgttggccaggatggtctcgatctcttgacctcgtgatccgcccgccttggcctctgaaagtgctgggattacaggcgtgagccaccacgcccagccagaattatctttttaagtttcacacaaagccacatttggtttataattggaagttctttaactctgtagagcaggttggggagaattgacgtttgtgtggtactgagtcttctcattcatgatcaagctatttacttaggtcttgaatgtattttgagagttttacaagattctgctgtcatgcatatcctttgttacatttattcctagatgcttgtattttagaagtcatagtaaaagtcagctttttattatgtttgttgctaacatatagaaattcagttgatttttcaaagaaatcagtgattttactatttttaacctagtaacttatctatagattattttgtattttcaaaatgtatgttttgtcttttgcaaaagacaaagttgtttcttttcaatcctcatacttttctttctttctcttgcctgactgtgccagttgtcatagtacagtgttgaatatggttggttgcgtggattacccgtgttctgtcttgaccttaaggaaggtttccagtgttttacctttaaggacgatgtttgctgcaactttttgtggatagcctttatgcacttaaaaagtctcatcctattcatgacttgcaaaggctttttaaagaaatcattatgagtggatgttgaatataatcaagtactttcattaagaggattatataatttttatcttttcattactattgtggtaaattacataaattgattttatttcttttcttttctttttgagacagagtctcgctctgttaccaggctggagtgcagtggcgtgatctcagctcactgcaacctctgcctcccaggttcaagcaattcccctgcctcagcctcccaagtagctgggactacaggtgtgcaccaccacgcccagcgaatttttgtatttttagtagagacggggtttcaccgtgttggccaggagggtctcgatctcctgaccttgttatccgtccacctcagcctcccaaagtgctgggattacaggcgtgagccaccatgcctggccgtaaattgattttctaacattaacctattcctggaaaaatactagtttaagcatgttgtattaccctttttaaaaattggtggatatatatttatttatgtatttattttttgagacagggtcttgctcttttgcctaggctggagtgcagtggtgtgaccatggctcaagcaatcctcctgcctcagcctcctgagtagctgagactacaggtgcatgccactggcctggctaattttaaattttttgtagagatggggtctcactatgttgctcaggctggtctccaactcctggcctcaagtgatcctctcaccttggcctctcaaagagctgggactccaggtgtgagcctccctacctgcccacattggtgggtttagatgatagtatcttgtttaggacttctgcatgtgtgtctggggtctatgtgcttcctttcttctgtagtccttagcagattttggcgctaagatttccttgtgaaatgaaatgagtactgcctcttttgctgtatcgtggtatagcttatgtaaaattggaatcatttcttccttgaatgtttgggataattcacttataaaataacctgactggccgggcctggtggttcacacctgtaatcccagcactttgggaggctgaggtgggtggattaccggaggttaggagttcgagaccagcctgggcaacgtagtgaaatcccatctctactaaacatacaaaaattagccaggcgtggtggcacgcacctgtaattccagctactcaggaggctgaagcaggagaatcacttgaacttgggaggcggaggttgcagtgagcccagatggcgccactgcaaaaacatttttttttgaacctgctttctgggtcagtgtgtcaattttaatgcacgttctgtttatacttaaaaggaatgtgtgtttggcagttgatggtgcagtgtttgtctattagatcaagcttggtttactgtggtcttcaagtccgttccctttttttgtctactagaaatgtatgttaaaatcttataatctgagaatagattggtccgggttttctaacagttctgtcagtttctgtttgatactttttttttttccagacaggatctcactctgtcacctaggctggagtgtagtgggacgatcacagctcactgtagccttgaactcccaggcttaatcgatcctcccacctcagcttcccgagtagctgggactacaggtgtgcaccaccacacctggctaaattttgtattttttgtagagactgggtttttccatgttgctcgggctgatcttgaattcttgggctcaagcagtctacctgcctcagcctcccaaagtgctgggattataggcatgaaccactaacgccccgtcacttaatatatttttgaggctatgttattaggtacatacatgtttagaattgtaattctaggtattttgaacttttctcattgtatgactgcttttatatctagtaatgctttttgtctttagtattgactttgatgcaagcattcttttggataatttttgcctgttagctatttttctatcctttttaaaaacctttgtatatccttacatattagatgtgtctttggttattcagcatgtatctagatttcattttcattcactctgaccttttctgacttttttttttttgagacagagtctcgctgtgtcgccaggctggagtacagtcgtgcaatcttggctcactgcaacctctcctcccgggttcaagcgattctcctgcctcagcctcccgagtagctgggactacaggcgcctgccaccacgcccagttaatttttgtatttttagtagagacggggtttcaccatgttggccaggctggtctcgaactctcgacctcgtgatccgcccgccttggcctcccaaagtgctgggattacaggctgagcctctgtgcccggcctttttttatttttattttttattttttgagacggagtctctctcttttgagatggagtcttgctctgttgcccagggtggaatgcagtggcgcaatcttggctcactgcaacctccacctcccaggtcaagtgattcttgtgcctcagcctcccgagtagctggaactacaggtgcgcgccaccgcacccggctcatttttttgtatttttagtagagacggggtttcaccatgttggccagactggtctcgaactcctgacctcaaatgatctgcccgcctcggcctcccaaagtgctgggattacaggcataagccaccacgcccagcctaccctgtacattttaatgtgcatagttaattgtatctttactctcctgctgaactatgcagggaccttagcccactttattctaatccaaccctttcatgtttatatttatatgattttgttactgtgtatcttaattgttttcttgtgaagcccacaagatgttgttactgctttatactgtgatatttgatgagcttcaaaactcaccacttcctttgttgctcattcttcttgcatgtcaggaatcattttccttcttctgttgaatatttgttcttaggatttcctttagtgaggatctgctgataactaccttctctttctgtttgtctgaagatgttttagtttaccctcaccctgagcagggcgtgtgctggttgtacgatgctggggtggtgtgtgctcctcccacaggtccaggcagggcgtccctggctttgacttccagctttgctgtaagaggtcagcggccgtgacaggctggagggagacgtctgggtggctttgtggtcatgtcatcgttgccaacggtcgtctcatggtgggtcctggtgtgggttctcttgtgattgcctgagtcggggttactagacttgctgactttgtggatcgatgattttcatgagtcccgggaagctctcagccactttttcttctgctgttggttctgcgctattctctctctcacctctggagcaacaattggacgtgttgctcttcctgccggatcctccacatccatagatgcactgggtggtgtcagtgggcggcggctggctggggcagtagcctgtctccagcccttccccctgcctctgtccacgtgcaggggcgtctcctcaggacgcatgttgcctactgaccgctgccagcctgcacgagactctcacggcgggaccctgtctgccttgctcggtgctgcccagagcctgcacagtgtagctccttggcggacgttcctgtaatggaaccaggatgtcatgccaaggagtgtggtttcattttgagtggtggggaagtcgctggactatttcaagtgtgtgtatttgggagagcagtgctgctggagtggtggaccacactggaggtggagattgcctcagggtgtgcaggtggagatgggtgggaggtgtcgtgcagggcttgggacagggctttcggaggtggtctgcagtgatccagggaagatgggctgctctgagggaggggctgaggaagctgacctgggcagccagtggcctgtaggctgggcagcactcgagctggggccaaggggcagcaggacggtgcccgtagccctggaggccttggggattcggaggacctggcccatcgccgtggcctgcacggtgcgtgcacaccgctctgtccgcgcaggctgtgccctgctttcaagatgcctggaaacctctggcagctctgtcctgctgtcaacactggagtcacatgtcagtgggtctcctgctggggactggcttttgtgcaggagatggagggcagggggctacagtgcccttggactaaaggatgctttccttggatctgggcactagaaccagccctttccctctctctgcccagcattctcagcatgcgtctcaggaaggtttgatggagtgggcagctgcggtgctgtggcggggtcggggggctgctgcagagagcgggtctgcggtcagtcacagtgacgggggtctctttggaccctgtgacttgtgtgtggtggtggcaggcagtggcgttgccgagacagggtgctcaggtgcaggtgggaaggggtggcaggatggaggttgtacagtgctttccccaggaccagggggcagggtgtggcgtgcttattcctgcctggccgtggagggtctctgtaggacaggctcccgctgagggcagccctgaggcctgtgagctgctggccccgcagggtggctgggcctggctggctcagcagctgctctgagaggcagccctaaaaatagccgagcgctgagaggccgtccctttctgctccgcaggcgcgcgccgatgtgtgctcagctcaggccgacttagcagggttgtgagagtgatgagagcgtggctgctggtcatggtgctggggtcgtcagcagctcctcgagggctccggcctgtggaggccggtggcgccccgtctcaccccacggatggggggcaggctctccaggagccccagggagcactggctactgctgggctgctctcaggcccgggacattcatggccgtagccccaggtcctctgcatggtcaggggccatgctgggtcccctggggtgcagatgccgctcaacagaggagtcaggacccaaaaggggcagaaatgggcaagggaagacactggggaaggggtgggtctgcccttcctgctgggggtgcacacgggcctggggctgagcaacccgctctgggcctggctgttccgctccactgccccaaccagcctttcctcagcaccccctggccaagctgtgggcaccccctgcccccggacacaggcagcacctggccaagtgcagagacactccagctggctcttcgcctgtgtcccagccctgagggcaccgtcgtagggtggtgggacgggggggggctcggacacagtggttgtggaggggtcagtgctgtggctcggggtggggtggggctgggggagggtttgcttcagggtagcggctctcttcaggggttcagcaaggagacagatgggttctaatgacccctgagtcctgagacaaggtggggtgagctggagcaggggaggggacttggaagggccttcagtccccatgcagcccttgcacaacctttcgggccaacatcctgggccttgcttggcagaggagtttgggatccacgggcttgaggcccaggtggtcagctcgctcggtgcaatgctgtgtctcgcatttctgtctctcgactgccccatccagcccgtgtcctaagagcagctggcagcagccgccacgcacaggcagctcagctcagcagccccaggagccaggtgtgtcttgagctgggcagcaaagtggccatgcagtccagcctcccttcagccttccccaggatgcctttcatcttggggagatggccattgtgggggtgaccagcactgtcccttccctggcaggccaggatgtggatccacagcgaggcagacctgcagatgcacatccctcttctcaaatgctgttcttgttctggtgagcacggggaacggcaccaagccaatgctgatgggaagggccctgaccttgggctgctgtcctgcgagcttggcccctctgctgggcccctcctccatgcctttgtttactctccaaccttctgggagtcccacatctgcatcaggacagaggtgaccagggaccagttgacagctaggatgccaccagcatcttttgtttaatttgagtctcatttcccagtgtaattctgtagctgaccttgcaggaggcattgacaatatttctttattgtatggccccagccaggacttccctctttttagatgcaaaataattgggcaagacttttcatgggcattgcatgctgggctcgtgcaggtgtctccagggccgcctcgagaccagcgcccgcctccctggtcctggatacaggtggggcgggggctcccccgcagcagtggagttgagacccgcacctgcttcctggtcctggacacgggtggggcgggggctccgcagcagcagtggagttgaggcttccgtatgagctcgctcctggtcagtttgagggtggacataccagacatcctgcatcttcccagtcgccccaggagcgcctcaggagggtgagtggcaggaggccgatgccctgctagcaggcagtccctcggggccaggccttcctggtgcggtgctgaattgggctgttcgttcctctgagcaccaaggagagggatggcggctcaggcttcaggcagtgcccgccggtgcctctagaaggtgctccgtggtggggcccgggagggtggcccttccacattctcgggctgcctgtgtgccacccaagtgtcaggtcatgaggcccctcggtctggcctagggctctccttcctcccccacctcaagcctggggtgtggcctagccagggaggggagcgggagctctggccgtgaagacccaccctgaggtctgggctctcctggcctgagcgtgctttctgctatgagctccacgttcaccctgcggccaggactctactgttcctcctggtgggagctgctgtggtgccctgggtggcctccagtcaccgccagcctgccccttgcagtcagtcctgctgttccttcggctcctgcagtttccagcttggccctggacttcctgtttttcccacctagctggacgtaaaggttgtcgcgccttggaaagttaagtcactacacccgaatcgacgcactcttggctcgcctggctatggcttcagctggaaacggagctgagcgtggcttatgtttataaatacagcacctatcaggtccagcgtcgctgtctcctgcgggaggtgtcagctttgggcgtgaagaacagctgcaaggccacagggccaaggggtatctcaccagctgggaggccggcgtgcctgacctggccacacagagcgagcctcagaagcgagggggaaggagggcaggccttggggaggggtccaggaaggtcgagaggctgcagtggtggtagcctgaggggatgtgcgcggccaggtcagtgcctgccgctactgcctgctgcgctgactgcctgagcactggggatcgtgggcctgaggggcggggaccttggctcccgtggatagctcctgcaccatcctcttgcttctcagaccctcggcaagtggtgacagggggctggggtggagttgttctcctgccgtggtcctgtcaaatggtgctgggggcggggccaggaatcacagcaggtgtctgccgctagcgctcggagcctgtgctgggggcagggtggtgcatctcatgcctctgccgcttgctcactgtacttgcctggggaggatgtggcaggggcagaggacagctggccaggctcttggactgcacctgactctggtgggctatcgaaggttttggaggtttctttaattagcaacatgatatccagagattgcgactgtggctcgagcggttccctgccagggagcaggaccattgacagccgagccttgactcaccggcccaggccacccgaggggccattgacaactgagccttggctcaccggcccaggccacccgatggaccattgacagccgagccttggctcaccggcccaggccacccgaggggccattgacaactgagccttggctcaccggcccaggccacccgaggggccattgacagccgagccttggctcaccggcccaggccacccgaggtttcactgcggattctatcagaacagtgcctccccccaggattcgtcaaccttcagtggaccaggccctgcagtggttccagttattccctgggaaaatttccagcactgattagggggtgactcttggtcagaggttgagtgtttccctaggtgtggaggtgcacggagaagagaggggtgcagttcttaaaggacacatggcttatgccacaccccctgccccaacccccggagtggccagctttcctttgactggggaggaggcagctgtccagggttgtcctcacctctcctcctggagaatgtggtcccttcagaaaggggacccagtagtgggtgacctggtgcaaaccacccactgcctcctctgggccttcctggggctcttcggctctcaggagaggagggagctcaggctgtggctgctctgtgagttggacacggacgctccagccgctgggcccagcagtgtgaatggccatagagaacaggggcccagaggctgctctcgaggacactggcagcagttgtgctctgggctcgccatccttgaagctggaatattccacaagtgccacgcacttgctggaggtactgcctgggggtagactgtggccaggccctcccagcagcccgagtcttggcgcgtgggctggactcccacactcagcacctttctgctgacctgaacacccagggcacagtggcagcggcgtcattaggatttccaactagctgtttctgttaagagtgaagaggaaaccttgtttgattagactcattgtaaaaaagattccagtgaatctcttgcctgctgtctttgcagttgcctctaagggtcacgaggcagggcggcgtcctctctcagtgccactgtgacctggcagcacctcttttgcatattattgacctagagagagaggtcaattgtaattcggagctgcacagtcggaaaatttgtagcaacagagaattataggcgctctaggcattcgatgaatcttctccaccttgctgtggggttaattcaggggagcagtggggagtgtgctgggagtgagattagagggaggactccctggaggctggccctgcgccctggaggccagcatggccctggtgctggctacatcctctggggctcttcctcatctgtctgcagaggaggcagctgtggagcgagggtgtgtacgggagcaggatgggctgcacagaagcctttccgggggtgcctgtggtttgcaggggcctggctgcagctgccctgtgtgatctctgtccccgtcttctcccggcttccttgggtcctgtgtgcccaacttggcacttcaagatttgctccctggcaactgttgcctttcccagaagagaagtccctggaaccaggaccagcctgctgtcacctgcctgctgctcctgccccaccagaaccatcctgagtccaaactggctgagagtcaagggggtgttcagggcctccaggagctctgggagagtctaggatgctctagatccttgggctcatggggcagtagagtggggggctgtggtcctgggcaccctctggagagaccgctctggtgtcagccaagtggcgggcaccttctgggcttgggggcggggcttctcacgatggctcagggaggtccagacagcccccttgtctaggtgcgcacctggagtcctttcctgcgtgacttgcaaacaggccttgcagggctctagtgtatcagctcccggactgcaggcagcagcaaactctgccgtgtggtactgcttctcatggacaggagaccaccaggctccttccaggagggtgaggtctctgcagcgggagcatccaggcctggaactcgagctgtggtgtggtggtgccagcccaggagccaagcacagccaggagatgaaacccatccctgtggtctgcacgtccatgccagggccgagcccccagctgggatgccctgggagggtgcagggtgggctctggatgcctgctgggggatttcagtgagaaccaggaagggttgagccagagcctccgagaagcctggggtccatgtgtgggaaggaacggggacagggagcctccgagaagcctggggtccgtgtgtgggaaggaacggggacagggagcctccgagaagcctggggtccgtgtgtgggacggaacggggacagggagcctccgagaagcctggggtccgtgtgtgggacggaacggggacagggagcctccgagaagcctggggtccgtgtgtgggacggaatggggacaggagcctccgagaagcctggggtccgtgtgtgggaaggaacggggacaggagcctccaagaagcctggggtccgtgtgtccgtaggaacgggggacaggaggttgtgaagggcgtgtgggttccgggaggctcactatagtgatgtcctgccttagacgaggtcacacaggggaaggttactgtgccgcagagttttctttccgagcactcaatgctcacctcctgggagggagtggggccgcagccagccctgacccagctgggtgtgtggccgctctctggacccccggtcccagggtggcagctagtgcagcctaggccacaccagcatgacccctcgcccctgtctccacggagcaccgtgggactctggcatcagaatcctggggccccacccaacacccacgcatttcctgtcttttctcaggcaatcgccatggtacccagggctggccttgtttcagcttcctgacgagtgccctgtggtcagtcatttctgtcctcgcctttacctcaaatcctgctttttgccttaagtgcgttcccaattccatctctgtgccagctgtgccccatgcagcctctaccggcatctcacgtgatgtcaaccttctgggtccttggggcctagccttgctctggtgaacggctttgttggatgctggggttggcattttttttttttttgagacagagtcatcctgttgcccaggctggagtgcagtggcacaatctcggctcactgcaaccttgcctccagggttcaggtgattctcctgcctcagcctcccgagtagctgggattacaggcatgcaccgtcacacccagctaatttttgtatttttagtagagacggggtttcaccgtgttggccaggctggtctcaaactcctgacctcaggtgatctgcctgcctcggcctcccaaagtgctgggattacaggcatgagccaccgtgcccagcctgggttggcttttaactggcaagtttagtctgtgtttctgtgcgatgatatagttgcatgtattcctgtcattttgatcattttgattgtgtttattacgtatttcctctcctaagttttgttatttcctcctcggaaattaaggaaggatcaagactgattgaatttatttgtatttttgagacaggttctcactctgttgctcaggctagagtgcagtggcatgatcatagctccctgcagcctcaaactctggggctcgagtcatcctcccatttcagcctcctaaagtgctgggattaacaggcacgaaccattgtgcctggcctgagttttatgtattacccactccaggaaatcactgtagtccttttaactgttactgatttgcttaaaatgtgaaaggcctgttgacatttaaggatagtcaacaaccctcccaccctccaaaggaaggagagctgaaatgcaggagaaacagcaatgcctttgatgagtatggctttgctgctactttgctcacctgtggccctgcctttcccaaggatagtttttgttttcctggagcacatccttcagaagctctttcagtctttcagtgcctgaagatggcgtttttgtccccctcatacttggtgatcacagagttcttctaggttgacagttttgtctcctcggtactttgacgattgttttattgtcttctggcctctgttgtggttttgaggagtctgcgatcagcctgctccttgttccttgtgggacacatgtgtgatctgtggttgcttttagcgtttttattttgatttggtgcggatttgttatcaacattgcttttgatcctccttgggacttactgaatatgagcatctctcttcttgttttggaagaatcctcagtcagacattgcatctccttccttgggtggaagctgctcagtcactgtcctgtgccttgccgtggggctgcctgtgcctctgtgcctgcttctccttccatggggagcccctcccagcccctcactggcgctgggaagcacagtggtcctcccctctgtgggctgtgttgagaaatgttgctggctagtcccagacccacaacacggagcacgggggttttgcctggtgcccgtgatatcagtggggagtgagaggagcaggtggccccctcggctgtgttcagggtgtgcctgtgtggccgaccacctccaggactgaggccacacaggaagcagttgggattgtgaaaacccccatgggaagctgtgctgatcctcccctgagcctgtgacagctgagggcacaggcaatggtggggctcggtgcctggggctgagttgggaaggtttggtgtctgacccacttcttcccaagtgggagctccctcctcgggcactgcatggcttctctgcggggcctctgcctggtcctctcgtgggcggtccaagacctggagcccaggaggtggattctgaggtctgagtcccccgcaggacagcagttccatcctctggtccctctcctgcccccaggggccagtaggttacagacaccttcctgaaactccctggaggggagcagccttgattcctaaacaagaagttggtcctaagtgcatcctcttgatgtggggcagagaagaaatctgagacagtctcatgcccccaccgccatcgtccccccacttttttgtgggggtgcccaatctgtgctctgccccctccccaggctccgctcctgtgggctgcgtcgtggtttctcctctctgtgggacgtgtgctgggcccctgggggtggatgcagaccgagcctgggcccatgtagaccaactggcgtgggtgtgagagagagagacgcatacccactcaggcacatacacgtgcacacacacacccatgcacgcgtgtgcacacacaccctggccctgttccctaccagtccccaccccctcctgctgcatgtgctcctggttccctctcttcacctgacagctggagtcatcctcctgcccacagccgtgccctgtgcagagcaggtgctggttctgccctcccctggcctgccccaggcggggacactacactgggaagctgccccgttgcaggcgttcccatggcgccactgctgtgttagctgcctgcagcacaggccggccagtcctggggtgctggacagaccctcctggaagccagtccctggccgtcctgtcctgctgggggcacagtgtctcggcagaaggttctggctgctccctggggtgctggcttgtgtcacctggctttgctgggtcccagtgacatgcagtctggggatgttcctgggacccgttgggcttgcggtggccacttgggaaagctgagcactgaaagtgccaaaacctgggacaccttcttgcaggcccactcttcagcctttgccccgtgggccattggggagggaggaggtgggaggttttggcaaagcagcccaaaggtccacacagacccagggctggcaaccggcccggcctgtcacccttctcactgagggtcacagcctgtggcccatggcagggctgcccaggacaggggcttggccccggaggcctgcagtgtgaggcgtggcccacaggccttcccagagggggttctgggagcctcccccagctgtcacacgcacctgcctgtgcctcacccgggctaaaatagcccctgcacagaaacgcccttgctgggcagggcccattcctgctgggagacacctgtcagggcccttcctgcctggggccatatggagtgtccagcctgggggtggtcgtggggtgtcgggggcctgggcctggatccacgatgccctgtctggtctagagcctggcctggcttccccttggcgtgactgcccacaggcagtggccgccgtctgctcagctgcatcctcctgcgttgggctcatctgtctgccttcccctgacacctcctcctgccagactccagggccaagggagtgggccccggctgcagaggcagtgccagctagctgagtgggtcaggccacagaccccacctgactccagggcagcgtggccaggagagcattggaaggagagagctgttcccaccttgaggctgacgcagaccagacctggctctgtcctgagcagcagaaagtatgtgcagggcttcaccctcttccctctgtctgtgtagagctccacctgaggcccagtgtgtgcgtagagtcccacctgaggcccagtgtctacgtagagctccacctgaggcccaatatgtgcgtagagctccacctgagggccagtgcctacgtagagctccacctgagggccagtatgtgcgtagagctccacctgaggcccagtgtctacatagagctccacctgagggtccagtgtgtgggtagagctccacctgagggccagtgtctgtgtagagctccacctgagggccagtgtgtgcttggtgcccacagctgagttagcccaggctcgtggtcatgctcacaggtgcacgtggccacacaagtcactgagcacagacccagatgggatgcagctcataacgtgcactgcgggggggagctgtggcatcttttcccagagcccctctggtctggcagcctcgggagtgtgtgcatggtatgggaggtgggaacagagctgggaggggctcccctccatggggtggggttcccctccagctgttggtgaggcacactgtacacctgcacacctgtgcctgggactgttgggctggacgtgtaggaacatggaatggcccctgggccttcgggtgactgagacagaagtacaggcccagcaggtctgaggacagggcctcctgatgactggacccagcctggacaatggccggcagctcccagccttgccacaggctgactggaatgcgtggtgtggtggagcccagcactgagggccggacgtgtgtttgcagcattgttctcacagccacctcggaggcttccctgctctggggcagatgccgttgctggagccgtggtgctcccagaggcaccctgggctcagctcagcccccataggccagtgcctggagtggctgtgacgctgtggccggcgcctggcgtggctgtgacgctgtggccggcgcctggcgtggctctgacgctgtggccggcgcctggcgtggctctgacgctgtggccggcgcctggcgtggctctgacgctgtggccggcgcctggcatggctgtgatgtgctgactccggcaccatcagttccttcccctattctggggcaggtggggaccacctcttcaccctccctcatgggcagggctggcctctgctgaggtggcccctcactgggcccaggcatggagacccagtggtcctagccctcggtgtagtctatccatgaggcacctggctgagcctgttcctctcactccacagcagcctccttggccctgaccactggccaacgaggacactgagaaggcaccctgaccttctgtcctcattagcagggagcagccatgtccagataaggctgtacatcagagaaagctgagtgaggctggcaagagctggcagccgccctcggccgcccgggcgagccttgggacgggctgggtggtaagtgctggtgatgcaggagcagagagccccgtggaactctctccatgaggacggcggtgccctggggcccagctacgaggatggctgtgcaggcacctggagcctggggatggcagggcgtgggctgagcatgtggagcaccagcctgtgacattcctctgcccaggggcagcagggcacggagcgtgtgtggccagctgccgccacaggcccccagctcccacgcgggcaggctcgcgaccgcaccaagggggcagctcctggagacaaaagctcctcagttttcccttccaacaaaacacagtcagcaggtttgggaccagctgcctggggtcttaaccatctgtgctctgtgcgcgcccccacccccttgcctgcctggaggaaagtggtggggttgacatgcgcctcgagggccagccgggcgctggtgcatttctcagaaatccgtgaagtgctcccttgtcctgctcgtgttctgtgctgtccttgggagtggcgcggccgcttgccagggctgcagagttggccacgcagcctctccaggaggccttgagccaagcacaggatgcagcccagcagtggtggcaccgtggagtggctgggcggaagagatcctggtccacgctgctgtctggagggcagggtcctcaggtgaccagagtccgtgcaggagcgagtgaggacagggctggggcaggcggcaggatgaggccgcccagagcaactcagtgagtgaatgagtgaaagcacgcacgccccatgctccagcggggccagagtgtgctgttgggtgagtctggccttccttcctggggttgtgggccctacttgtgggaggccactgtggggagggcgtccttgtagaagtgttaatcagagtgaaagccagtccctgtgcactgctgctgggaatgtagcatggtgcagctgttgcggggaacaggacggcagcccctcgggaaatgagacagagttaccgtcagagttactgtgtgagctagcagttgcacttctcagtagaacccgggagcactgacgcagggcctccaggggagatctccaccctgtgttcacagcagccttactcacggtgactgcgtgatggacgcagcctgtatccatcctcggacaaacaagtcagcaccatgtggccctccgcaccacccagcatcactgggccctcggtcagcaccgcgtggccctccacactgtggaatattacttagccctgaaaaggaaggaaatggacacaggctgcaacgtggatggaacttgagtatattgtgctgagtggaataagccagtcacaggaggacatgcactgtatgatcccatttgtgtcaggtccctagagtcattgcattcatagggacggaggtaggatggtgcagcctggtgatgccaggggccggggaaggtgggaatggggagttggggttgaatgggtagtttcagttgcgcaaggtgaagagagttctcgggatggatggcggtgagggctgcacaacagcatccacgcacgtagtgccactgacctgcacactgaaaaatggttcaaacggcaagttttacgttatatttaccacaataaaaaagagaaatagacatcgtcaagctgttctccaaaataaggctgtcaccgtttaccttcctaccagaaaaaaacagttaagtcccaaagccagggggagcaccagtgttaacctcctgggttggggctggctgagcccgtggctatgcctccctgggcttaggtggcaaccctgcgaggagcttgggcctctcgtcttttgggttcctgttcaaaatgggaagtggtctccaaaccccagggcccacctgagccccctgagatgggaacctctccagacctgcccctgagatcctgtcccacccctggacaagggcctctgtgcctctgaacaaaactggggggcctggtgcagagtcctagctcaggcttccagaagtcagtggtttgaaggggtgcccacccttgctccgttgggacatagggacgcaggtgcctgtctcagcccccacatgtgcacccccaggggcagcagcgtcccctccagtctctggtttgcatcatgcacaggagtgggtgggtgggagtttcagtctcccagagagcatactgttgggccatgctgtctctggcctcctcacccatggaggtcctgccccgcccccatctgaggctgggtggccgaggggtctgttctcagactggggcctggcgctggcccggtttcctggaggaggaagcgggggagtgacctgcggaggacttccagcctccccttccgcctgctgtgggctgcatggcgctggggctctgcccagccctggagagtgttggctgctctccttccagctgacatggaaatgccatgcagggcacgcacgtggggcactttctgctgagtcaggtttctctgaccttcctgaaatgtcacttgttctgtaactcacaaaaactggggtgctgggatatggtgccttccttctcccggaagtccctgccgaggggggcggtggtggggcattcccagggggtgtttgtcctttgctgtctttactttcccaccttgttccttgggcctcccctgacctattgaccctgccacagctcgctcaccccaggtccctgggggctgtgcaggattccgggtcctccagggccagtgtgatccttgctgggttctcagagtgaccctggagggaggtcccctgccgaccctcacctcccgttcccaggtcatctgccccagggccaggtgtccatccaccctgactgtgaccatgtgcctgtgacctgcgtgactgacccctgcccttgggtgcccaggcctagcagtgccccatgccactgggtccccaggcatctgccaggaaaggacagctctaaagtggccagggcagcaggggtcctgatgtctgttgaaggcccttggaattccctggcttcattgtgccatctccccgctcttctccctccctcctgcctcctgtcttcctactctctcccctccttccacccacccagctgctctcctctctgagcctggccccacaaccagaggtgctcactcctgccttcaactgactgcaggtatccaggcatctgggctgagggtgcctctgtggctttgttgaccaacccaggctgacttcagaggtgctcttcagcccctgctttgcaagttcctggggacccgtggctgtcactttggccccttgatgtttatggtggttcccgtagctaagtggatgctgccaaagatggaaagtgggggacgctattccactgccactcagagcgagaccaggtgcttcaaaaagactagcagggttgggtgtggtggctcatgcctgtaaccctagcactttgggaggtcaaggtggggggaccacctgaggtcaggagtttgagatcagcctggccaacatgagaaaagcccatctctactgaaaatacaaaaattagccgggtgtggtggtatgcacctgtagtcttagctacttgggaggctgaggcgaaagaatggcttgaacccgggggcagaggttgcagtgagctgagatcatgccattgcactccagcctgggcaacaagagcaaaactctgtctctataaaaaaaaaaaaaaaggaagaaaaagaaaagaccagcagggccaggtgtggtggctcatgcctgcaatcctagcactttgggaggctgaagggagaggatctcctgagcacaggggttcaaggctgcagtgagccgtgattgcaccactacactctagcctaggtgacagagcaagattctgtctctattaaaaaaaaaaaaaaaggaatggagatgacaaagaacaagtcttaattgaatattaacaaaagccagaagctgattggaaaagcttaataaagtagcaaacatgcctggctaatttttgtatttttagtagagaggagtttcaccatgttggccaggctggtttcaaactcctgacctcaggtgatcagccctcctcggcctcccgaagtcctgggattacaggcatgagccaccacatccggccaatttttgtattttttgtagagatggggtttcaccatgttgcccaggctggtcttgagctcctgggctcaggtgatccacctgccttggcctcccaaagggctgcgattccaagtgtgagccaccgcgtctggctaaggagtattttccttagcagatacaaatttatttaaattagctatgctagttaaaacaatatggaattggcagaagtataaacattgactaatggaatgtaccagcagaaacacatgcgatcgtaatgtgcttcagaaatggcctcattcatctgtggggaaaggatatacttctgggtaaatggtttggtgataactgaacattcatgtaggaaataaaatgcaatcacaacacacacaactccaaatggatggataatctcattgtgaaaaagaggaaggaacaaatgggggagtgggatggattaaagcagtggtccccaacctttttgccgccagggaccggttttgtggaagacagtttttccacagacggtgatgggaatggtttccagtgaaactgtcccacctccgatcatcagccatcagattctcataagcagcgtgcagcctggatccctcgcgtgcacagttacaatagggttcttccggagctcaggtgggaatgctcactccctggtgctcatctcctgctgtgcggccagttgctaacaggccaggaacctgtcctgggggttggggacctctggtctacagcacaggtgacttttctgtaccagagctaggaatgaagggctggctgagctggtgcttcctgccacctgtgtagtggtgcaggtgtccatggtccagggctggccaggggcatctcctgtcctggcttggcttctgcccctgggtccgtggtggctgcctgggacctgcccttgcagccagggtgaaaggagtgggcagggcctgctgcctctgctcagggcccctagtggggctgcttgctcagcacccttgccccgtctctggccacgtagccgtcacccagctagcatggggaggctcgctaccaaggggtggggggctggagaacggagcttggagacagctggcagtctcggccacacatagagacacccgctcctgagacctgcagtgcctgcagaggggaagaaacggggctggcggggagagcacacagtgcgtttctgtggtcaggcccctttatttcttcaaatagatcccaagtgtagagaacatgtgctcattcttgttggcaggcctgtgggtttttgtgtctcactctgaacttttcctgtatgcctctcgcttctctctgtcagaaaacaaaacagaagcctctattctctgggattcggattcaagtcggctcttttattcacctatttcgagcagacacaatgaaagaggaaacagataacactgtgggtattcagcaagttgtcttggatgtgaacattgagtttccacttgtcactgtgattttattttatattgagttgtttttaaaatatgctttgcttcactttcgttgctgttgaatctattacagctgcacggtgtcctgaacacagtggcaggctggtgatgaatcgtcttctgtaggttttctggtgtctttgttatgattctctcagggccaagtgtggtgcacctggcctgggcaaacctttaggcctcgctctcagaaccaactgtggataataagcaaataacatgttttgtttatctgcgcagtttctgaatgcaaatgattctttttattccttattttatttatttatgttttagagacagagtcttgccgtgttgcccaggctggagctttttattcttcgtgtttgcacagtggctgtagctatgtgtagtgacagcagagacaggcctgagaggggcagccacgttccccctgggcaggatctgtctgctacgggaccgcaagctgcgactttttccttctaagtgtgcggagaggagcccctgcctagggacggggagccgtagcctgctgtttttgtgacaagcatcttgggcgagggggcactgggctgtgctgcatagatggtgagcactggactcacccccagccccaagtcaaacgaatgtaaggaacgtgagcttctggaaacgagcgtggaagcctgagtggtgaggaagggaaatcttgcagtacctgcacactccccaaatgcctcttgtgggtttgcagtacctgcgcactccccaaatgcctcttgtggatttgtttgtttgtttgtttacaattagttcatccacagcaggatccaagctgctgcctgtgtgtgtgtgtgtgtgtgtgtgtgtgtgtgtgtgtgtgtctatgtgtgagagagagagagacagggtcctctgtcacccaggctgagtgtagtggtgcaatcacagctgactgcagcctccaactcctgggctcaggtgatcctcccacctcagcctcccaagtagctgggactgcaggtgcgccccaccaagcccagctaatttttgtatttttttgtagagacagggtttcgccatgttggccaggctggtctcgaactcctggcctcaagtgatccacccgcctcggcctcccacagtgctgggattacaggcatgattgtgcccagccacagtagagcttcttgtttgcagttggttggtgtgtgtcttgtggctgtctttaataaaacaaaaactttgcaagtatcgtctggtaggccaggcgcagtggctcacgcctgtaatcctagcacttcaggaggccgaggtgggcgggtcacttgaggtcaggagttcaaaaccagcctggccgatatggtgaaaccccatctctagtaaaaatataaaaaattagctgggtgtggtggtgcacgcctgtagtcccagctactcaggaggctgaggcaggtgaattgcttgaacccgggaggcggaggttgcagtgagccaagatcgcaccactgcactccagcctgggtgacagcaggactctgtcttaaaaaaaaaaaaaaaaaaagacagtattgttatggtaaaggttcacccctcacaccttttttcgtatgcagctctgagcttaacatccaccatacaaccaggcacagaacactgggcagtccacccaaaacagtccccagcagccaccctccctactgacctggccttgtgcccccagctctgccttttccagagtgccatagagatggacaaaaatggtgtgtgccctcttgacacgggcgtctctcactcaacacgatgccttccagatccatcctatcacgtatcgatctgttcctagctgttgctgaatagtaccaaaatgtccttgtctttgtgtgaaggacatcggggtttccagtgggtggcagttatgaatagagctgctgtgaatgtgcattagggatctgtgtagggacatatgctttcatttcccttggaccaattccaaggggtaggattgctgggtcctgtatgtttaactttgtaagaaactgccaaactgctttccagtgactctgccatgtggcgttctgcacgttcagagtatatggaagtcccagtggttttgcttcctcgccagcatttggtattagctttttttatttttcatgttttttaagccattctaataggtgtagttggtatctcgtttggttttaatttgcatttccctaataactaataattttgagcatcttttcatgtgcttatttgctatcaatgtatcttttctggtgaaacgtctgttcaaatattttgctcacttttttttttttttgagatggagtcttgctctgtcacccaggctagagtgcagtggcgcgacctcagctcactgcaacctttacctccctggttcaagcaattcccctgcctcagccttccgagtagctgggactacaggcttttctcactttttattaggttgtttgttttcatattgttgagttctgagagttcatatatttatatattctggataaaatttttgtcgaatgtgtgatctgtggccaggtgtggtggctcatgcctataatcccagcactttgggaggctgaggtgggcagatcactcgaggccaggagtttgagaccaggcctggcctacatgtagctgggactacagatgtgtgctgccgtacttggctaatttttatactttttgtagagacagggtctccctgtgtacccaggctggtctcaaactcctgggctcaagtgatccacccacctcagcttcccgaagtgttgggattacaggcatgagccacccttccctgcctcaacttttaatatatggttgaatttgcctggaagtttttttttgttttgttttgtttttggaagatttaattaattaattgatttatttttgagacagagtctcactctgtcccccaggctggcgtgcagtgatacgatctcggctcactacaacctctgcctccccagttcaagtgattctcccacacccggcccagaaaatttaacaattaattcaatttatttaatagttgtaggactataccagctatctatttcatcgtggggagttttagtagtttgtggctttctagggaaatgaaaattggtacattttatcaaagtagtcaaatttttgttcatgaagttgtttatagtatttcccagtagtctgtaaggtctgtagtgctttccttcttttacttctgataatggcaacttttgtctactttcttctttgtttgggtagaggttttatgaattttattgatcttcccaaagaactagcatttggttttattttattgtttatctattttcagtttagttgttcctctttatcattataatttccttccttttgcttacttggggtttaatatgttcttctagtttcttaagatggaaccttagggctgggcgcagtggcccagtaatcccagcactttgggaggccgaggtgggtggatcacctgaggtcaggagttcgagaccagcctggccaacatggtgaaatcgtgtctccaccaaaaatataaaaaattagctgggcgtggtagtgcacacctgtaatcccagctgcttgggaggctgaggcatgagaatcgtttgaacccaggaggtggaggttgcagtgagccgagatcacaccactgcactccagcctgggcaacacagtgtgactccatctcaaaaaagatggaatctggctgggcgcagtggctcaacgcctgtaatcccagcactttgggaggccaaggcaggcggatcacgaggtcgggagattgagaccatcctgcctaacacggtgaaaccccgtctccactaaaaatacaaaaaattagctgggtgtgatgtcgggcgcctgtagtcccagctactcgggaggctgaggcaggacaatagcgtgaacccaggaggcggagcttgcagtgagctgagatcacgccaccgcactccagcctgggcaacagagcgagactccgtcttgagaaaaaaaaaaatggaatctttagattgtgtatttgaatcttttttcttttctgacataagcacttaatgctataaattctcatttcagaacggctttagctgcacctggcagattgacgtgctgcgttttcatttacattccattcagagtgttctctgatttcctttgagacttcctttgatccataggtttttgttttttagtttcccaagcatcccaagaggatttccccgccatctttctgtgatagattgctagtctaacgccattttggtcagagaacgtattctttgtatgatatcagctcttttgtatttgtgaaggatttgtggtgtgacccagcctatggtctatcttggttcatatcacctctcttagtctctctcctctgtctttcttcctcttgcattgtgttgagtaagagagagtctgtgggaatccgggcagccccagtggagtggggtggaaccaggacgagggtccctgctggaggagcgccccctcaggccaggcccttccgcgtttctgccaagtcctaggagactctgacttaatgcctgacttattttgtgatatactgagttatgagaatgactttaaagctcacaggtggcctcagagtgcaccttgtgctcacaaacactgacgggcgacagtggacagtctgactgcagctcggggaatgagttgaaggactctgacagagatgtctgtagtaggcaggcttgtcacactcattgtttaagctccatgcctgtttacctaaaaagctggacttaaatacatcgaacttggaactcagaaaaataaaacatcttctgacctgggtaggtccgtcttccagtgttggaaagcagactcatttccgggttagtcctgtgctgctttttgacctacactgacccgatcttgtttggaacaggccgccctgtgcatgatttggtcccatgcagaatcacacagcccggttggtgactttgatggctgtcaggcactgctcgcgtctgcagccctgtctgcagagagcaccccgtggccctgcatgcacggctcccccacccccgcccacacaacatcccccccaccgcctgcacggctcccccacccacacccgcacaacttcccccccaccccctgcacagttcccccactcccacgcgcacgacttccccccctaccccctgcacggctcccccacccccacccgcacggcatcacccccaccgcctgcacggctcccccacccccacccgcacggcatcacccccaccgcctgcacggctcccccacccccacccgcacaacttcccccccaccccctgcacggctcccccacccccacccccacgcgcatgactttccccccaccccctgcacggctcccccactcccacgcgcatgacttcccccccaccccctgcacggctcccccactcccacgcgcatgacttcccccccaccccctgcacggctcccccacccccacccccacccgcacggcatcaccccctaccccctgcacggctcccccacccccacctgcacagcatccccccaccactgcatggctcccccacctctgcccacacagcttccctacccccgcctgcacggctcccccactgcctgttgtccgctgtccccgttgcacctcccacctgctgccctgctgtcaagtcaggcgcgtcccacccagagtgctctggtgtctgccccttggcttctctcagcagctcagtggagtgtagacagtgtagtagatcatcacctgagcagccaggatgggagtggggtctctgtggtctccattttacaaatgggttgacaggtgctcaggaagccctgtgatgtcctgaggccgcccaggcagtcatacacaggctgtacccatccagtgctcccgttgcctgggggcagggatgtgtgctggaagggcctgggactgccttcccaccgccatgtccacacccaatgcccaggggtggagacggaagcacgtggcggccactgtggcactggtgggtggctgcgttccatggcctgactgtgtctggcgcctgttctggtgttttacattcatactttgagggccaagcaccagcccaggaggtgggtgccacaagtccagacttccccaagggaaagtgtccccagcacagactcagccactcagaacttgttggtcttagagcctgaagccgggcagggcagacagtgccatccctatctggatggtggtgccttcacccttctgctgtcctgagcaagaagaaaaatgagccaagcttcaaagagagctgtgccaaagtttccggaaagcttgccagtgtgggtgttgcaccccacacaccttcaggcatgggtgggtggtgtgggcatcttcactggatggatttggagccctggcgcgtgtacggcagatgccccggggagatggcatgttcacacggggcagcactaggcagagtggagggtagggtctacacccctccactcctcagcaacagagccctggacactgggtgtgtccttcagactgtccctggcgtctccagcactcctgtggcctcaggacggaatgatggaggtgaaatgaacagaaggaaggttgggggaaagcgtatcccagctatgggcagggggtcctggggtgggcaggatttggggcggctgggcctggggctggatagggccgcgggagaggggaggcctgtgctctcacagctgggagctggctcaggactctcagatcttctctttgtggcctgtcatccctcctacctgcctgtccacaggcccacactgagtgagttccatgggagggaggctcaccctcaggggccttcaggagatgggacctctggcccggcagccaacggatgctgaggggtgcccaccatgtgcagggacagctggggtgatgtcttggagccctgtgaggtcctggggccgcccaggcagtcacaccccgccctgcaccccagggtgcaggctcccggggtgacacagtgctgggacggcacagggccgcgtcctgaggagagggcggagccccgaggctgagctgtgccttgcctcacaggttgtgcagcctgactctgaagaagctggtggtcttcaaggagctggagaaggagctgatctccgtggtgatcgctgtcaagatgcaggtgaggccgcttgtgaccccggctgtggctgggtgctgtgtaggctttccatgtgcctgggagacgagtcaggcggtgcgctactgtggggccttgtgccaaaacagcgggcagcccatgccatctccgggagcccggggggctgggaatgacaggatgctcctgggtccagtcctgtcccgcacaagggaggcaggcccggccttctgggatgtggaggtcacatgcatggggccttcccagggcagagctgccctcgagtcacctcacagtgatggacgggccccaagcacctggagccagggcttccctgctgcactcagcacccacttcctgcccactttttgtggggtggagggcgtcggtgggagaggggagcagggcactctgggaggcgagggcctagccagaactcccagcccctggtgccagggcctctctcctgaccctagtgggtcctgtgacctctcgaaggctttgaacaagtagcggttccagaggggtcatgctggtgtcttccccatgcctggcccaggccccgccccctccttggggtagagctgccatgacccttgcagcatggcctttgcccagtggcccagacagggaggtgtccccgccaactgtcagggccacccctgccctttcagggtcatacggttccaggtgtgtggcctgtatagggccaccgccagcgggctctccctagccggcaccactcatgggcaagtctcacccatgtcctcagcatacaggagtgtccttctgtgtggccgtccagcgtgacagggtggggtctcagtggctgttgtgctcctgaccccagcccatcagctcctcgaggatggggccctgcccttggagcccatgtccaaggccccacacaggtccctgcagctggccggattcttgacacctgctgtggctctgacacggggtctccgggtctccccgacctgcagagtagcacctgagcctcggccagtgtggctgaggtcaccagccaagcactgggtcttgagtgcgaggaggcctgaggcttgttgtctgtcccagtcaattgccactatgtgaaacctactgcatcttaaataaacgtctggagaaacccttttcctcgctgaacatgctcgtggattagcagcagcctacatctgcggcgtgtgctggtggccaggttccccgggtggtggggccttgccccaggaacttccaggagcgtgtggctaatagcaggaccccaagaacttccaggagtgcgtggctaatgcaggacccggagaacttccaggagagcgtggctaatagcaggaccccgagaacttccaggagagcgtggctaatgcaggaccccgagaacttccaggagagcgtggctaatagcaggaccccgagaacttccgggagcgcgtggctaatagcaggaccccgagaacttccgggagcgcgtggctaatagcaggaccccaagaacttccaggagtgcgtggctgatagcaggatggaagcgtctctccgcctgtcctgcccatgggtgtggccatgcccagggtgcccagtacctgctgcagtctggctgcgggtcgtccctggggaacagggagctctctgtgggccattgccaccaggccgtgaggctgtgtctggacctcttggcttggggggcaggggtcagggtctcattgggtcttcagagcaatgcagaaaggcatgaaggcaagagtcgacccctcactgacttctgagtctggtgctgttgacctctaacctctggcatggggccccaccccacactgaccctgttccttggccccattccttcctctgcctgtctctggtcctgccccagcctgtgtcttgaccgagagcttggccccagggcccctcagagccccacctctccagcccctctgtgtagcgcatggactggctgcccatgccctccctgcccaccccagctcagcagccacgtggcccttggcctcccttgatcaccccagctcctcatctgcttctcttggggtgtcctctccgcccaggccccctgtgggggaagcagccagcctggccccgcagccccacctgcccctcagccttctctggcgtgcaccttcgcctcactggctggtggcacacactgtccttttcccgacacagctgggtccctgcaggtcctctgaggggggaatgctaagagggacccgacgcagagcacatttgcagggaaacatctctgaagggtcaaggggaggagcagggagagtccagaccacaacgcaggggcagctggggagaggagaggggacaggagggctggccgaggagagccgcgctgcctcttgccacgctgcacgtgaggccccagcacaaggggaggaccagagtccgccatggacgtctcatggagcccgagtacggccatgcgggccgcccgcacctgtcctgaggccccgctgctcccacccgaacctgggctggccccgggctcccgttgtctgtcctggacccccgcccgccctccagccacctggcacctctcatccactgtgtcccgcgcgccggcctccgggaaccttgtgcctgggaccccgcagcggctgcttgtttctcggggcacgaggtccccaagctcatccttgttgggatggtcccatttaaaacagcactgcgataagcacgttcaatccattaggaatctattttgatataaagtttgcggttggggtcctgttgtctttcacgcaaatgactcgttatccatttagcaggtgcgtgtgatgtctcctgctggcctgaagctcactgggtatgaactgtgttttcaggtgctcatgcatttcctgcacctacatctaggcttctactaccctcatttttgtgacagcatctccgtattttaagtattgtatctctgtatgttttactttctgagaggaccagtcaggcctgatcattcttctttttagaaaatgctttaggccaggtgcagtggctcatgcctaatcccagcactgtgggaggccgaggagggtggattgcttgaactcaggagttggagaccagtctgggcaacatgactaatccttgtctcttaacaaaatacaaaaattattgtatatttttttgtggtggtacatgcctgtagtcccaggtgctagggaggctgaggctggaggattgcctgagcctaggaggtcaaggctgtagtgagttgagatcgagccactgccccacagcctgggtgacagagaccctgtctcaaaaaataaaaacaaaaaataaaaaaatgctttaagccaagcatggaggcacatgcctgtaaggctgagctacttaggaggctgaggcaggaggattgcttgagcccgggagctcaagtccagcctgagcaacacagcgagacctgtctctcaaaaccaaaaccagaagaggcttggtgcctccagatttgttctgccagacagacttgggcagcgcagtcaggtgctgctgcacctggccgtggaatctgttttgtgatcgcgttaacttcagcaggagccgctcctggtttctctctcatgtcttagggcagattcctggaggtggaacctgtgggccgaagggtctccatgtttttaaggttcttgggaaagatgccagggcacctctgagaattaccccagcctgtgcctaccacccccagactgcagggctgcaatcctgccagttttagagtgcaggagtcacggtgtctttgcctggtttcctgctgatatgcagtcctttgagctagaacaggtcttgcttaatcacagggctccaaacgaatcctgcggtcccatgagattgtgctgccccccagtggacaagtggagacagacctggccctgaccttctccttgcaggtgagtctttcaccagtggtgacgacaccctcatcactgtcccctggggagacgggcccccctcatcactgtcccctggggagacgggcccccctcatcactgtcccctggggtgatgggcccccctcatcagtgtcccctggggagacgggcacgcctcatcaccgtcccctggggagacgggcacccctcatcaccgtcccctggggcgacgggccccgtcatccctgtcccctggggtgacgggcccccccatcactatcccctggggtgacgggcacccccatcactgtaccctggggagacaggccctccccatcactgttccctggggagacgggcccccccatcactgtcccctggggagacgggcccccccatcagtgtcccctggggagacgggcacgcctcatcactgtcccctggggtgacgggccccctcatcactgtcccctggggagatgggcccccctcatcagtgtcccctggggagacgggcacccctcatcactgtcccctggggtgacgggccccctcatcactgtcccctggggagacgggcacccccatcactgtcccctggggagacgggcacccccatcactgtcccctggggtgacaggccccccccatcactgtcccctggggtgacgggcaccccctcatcactgtcccctggggagacgggcacccccatcactgtcccctggggtgacgggcccccccaatcactgtcccctggggtgatgggcaccccctcatcactgtcccctggggagacgggcacccccatcgctgtcccctggggtgacgggcccccccatcactgtcccctggggtgatgggccccctcgtcactgtcccctggggagacgggcgccctcatcactgtcccctggggtgatggccccccctcatcactgtcccctggggtgacggccccccctcatcactgtcccctggggtgatgggccccctcatcactgtcccctggggtgagagcatttgtctcatcattgccatcagtgtcctgcgttactgcagatcttctgttgattatggtttattcttaaatgattagaagatttgtatttgtttattaggttgagtttttctttgttttttctttgttttttgtttgtttgtttgtttttgagatggagtctctccttgtcacccaggctggtgcagtcttggctcactgcaacctccacctcccgagttcaagcgattctcctgcttcagcctcccgagcagctgggattacaggcatgtgccaccacgcccggctatttttcgtatctttagttgagacggggtttcaccatgtcggccaggctggtctcgaactcctgactgcatgatctgcctgcctcggcctctcaaagtgctgggattacaggcgtgggacaccatgcccagcctagtttttcattccttatctatgataaagagaatataaggccgggtgtggtggctcatgcctgtaatcccagcacttcgggaggccgaggtaggtggcaggagaatcgcttgaacccgggaggtggaggttggttgcagtgagctgagatcatgccatagcactccagcctgggggacagagtgagactccatctcaaaaaaaagagagaatataataacgagggcaaaaaaacacttactgagtcaaggctattttgctcttctatttaaaaagataggggaaactcagagttcacaagcaatcccagctcttcgggaggctgaggcaggaggattgcttgaacccaggaggtggaggtgacagtgagcccggctaatttttgtatttttgtagagatggggttttgccatgttggctagggtggtctcgaactccctacctcaggtgatccgcccagcttggcctcccaaagtgccgggattacaggtgtgagccaccgcgcctggcccaatgctccatggttcagtgggttttgataggcatgctcaggcatgtcagcaccaccgcagttagggtggtgaacagccccattttcccctaagtatttaaactgatttttatttgtgaactctgagtgtctaagagatacctgtgaacatcagcttgctggagccctgctggacagggagcctgtggtgagacgtgcaggcgagttgggtgaacagggggcctcggagggagagccctccccgccctgtgtgcccctcgcggaaaagcgtcctgggtcccaccttgctgattgcctcaggcacatgagccgccacactgtttccgagtgtccacaggcgcgctcggccatcccggacactgcagcacatagtccttgtccacctgccatggctgttagcgtggcgcggagccctcagggcctgagctctggcgactggctcactcttgattgtgttgggtaaaggatgggctctggggaccggcatgccactgggatgaacttgggggcccgtctgtgggtgcccttccgatctcatgggcagcaggttggcctggtcgcaggctgcagggtggctgggccgtcagaggccgtgatgctgcctggggccccggtgcaccctcagctgccactcgcacttgtgcccacagtatcctcacttcttgaagagggaaggcaacaagcttcagatcatgctgcagcgcagaaagcgctacaagaacagaaccatcctgggctacaagacgctggccgcgggctccatcagcatggctgaggtgagtgctccgtctggcgtggcctgcgtcgggctggccacctgggtgccagagcattcgcccgtgggagatggagatgtctctcccgggtccagatgtccagggatcaggtgaaaatgatgagaggagcctgggcggccgggctccgccataagggccaggtgcggccccaggtggtgcttcctctctgaccttcccttgccgcctagcatggctccccgcatgcctgcagccgcgcgcactcccctctaacgagcctgtcctgcccttcagtggaggctgggttttgggtcaggctgctctggagtccttcccatggaggaatcgctgctgtccccacaccacgggtgcgtcctgtgatgggttcgtgtctgcatcctgctcagcacgtgctctggcccaggattggctgagcaggagcaggacaggtgtcagttctgtgaaggggctagcgacaatacccgagcagggcgggggcagcacccagaggtcagaggggtggctggagttccctggaggggaaagaaggggaagtacctcaaaaggaaaagaaacagccaagcagcagcccaccttgctccagagaacccagcgttccaaggaggctgcagtagggcgtgggggcctgggagaagacaccccaggctgaggcctcggactttctcatggaccctttcggggctgcaagattggctctgggagaaggggcagcccagggccccagaccagtttgtctcttttgcttcagaactttccccatcgtggggttgtgttcaggggtccaggggctgcgggcgtgagtggtgcttggggcatgtgaagctgggttgctgcctgcctggggcctgggaaggtcagccagcgcagcccctcattgggagccggagatgccagagccccccagcccctcttcttcccactttgtccccctgctcctggggcttggggctgggacagtgggggtgcccacttgtagctggttcccccacacccccaggcccagcctgcaggcctcctgtctcccaggtcaagcgctaggtcccccagatcctcacacacccccacttacgcatccaggacaagtgccaagtactactctgggctcagccctccctgctaccccaggagatgggagcgtggagggtacaggaagcagcagtggcgtcccgaggcctcgcttctccgtgccgccgcagggcctcagacaagctttgcagtcttcccgattccttcggcaaaccacggacagcacgggtggaccgggcctccaggctgcacttcccagggccctgggacccctctggtggcctggagctgcccatcatcccagcctccctcctgcaggctgagcgatgggtgaacaggtagctcagggatgctctctgggctgtgagagcctcctgggagccaccgcttgcttcctgtggagcaggagggtccaggcactgtggggaggtcatgcaggctctgtttcccattagccatgcaggcgaggtcctgctgatccctgccggtccctgtgtttcccattagccatgcaggcgaggtcctgctgatccctgccggtccctgtgtttcccattagccatgcaggcgaggtcctgctgatccctgccggtccctgtgtttcccattagccatgcaggcgatgtcctgctgatccctgccggtccctgtgtttcccattagccattcaggcgatgtcctgctgatccctgctggtccctgtgtttcccattagccatgcaggcgatgtcctgctgatccctgccggtccctgtgtttcccattagccatgcaggcgatgtcctgctgatccctgctggtccctgtgtagccatgcaggtgatgtcctgctgatccctgccggtccctgtgagctcctgccccaggctgctccgcccacatctctcagtctgcaccccagtgccccaggcggctcctcccagcccctctcagcactggtgcttctgtgtttgacgtccttgccctgaatgctggcctctgctcccaggcccctccctcacctgtcctcccagccttgggctgtcccctcctgatccccggggagaggctggagcaaccttcccccaccccaggtcacaccagccacatcgtctgctgcttgaaatcccatcatctgttcttcactcttggcagaaaagccccacccctggatgtagttccagtgccctgcccctgagcctgtggcccccaccccaaggctccctcgccctgcacctgtggcttccaaagccgaggtcatctgactgctcctcgctctcccctccagcatctcctccaggccctcggggcatccttccaccttccactggcagcctggtcccagaacctagttgggtcctcccatgtgtccccgagcaccagggcggttcatgggctccctgtgtcctgccaccttttggggctggttcccacctgtgagcgttgctggcttgttgagagtatgagcacgggagattgcggaggcgggacagccccgagggcacagacggacacaggtggcagaggtggggggctctcaccagctgggctcaggcagctgtgccatgggggcttgctggctccgagactgcacgcctgagacgggggtgagggcatgggtgctgccatagggactgtcgtgagagtggggtgtcggtgaggctggcgccatgcatttgagagtagtgctcggcggtggggaagggtccttgagggcacagggtggggtgaggcgggctgttgggcggactcgaggccagggctgagagtgtggtgggagaggatgtggggggcacctgcccaggacctccaggctgtggggagaccaggaggcgatggctgtggggacacaggtgtcatctcccttcaaatgggtgcacacgcagggggcaggaggggctgggagcagcctgggcccctgccacaccatagctctgccctcacctggcactcattctgtgtgagctgaggcccagagccctggacttactctgaggctgaggaagtggagtccaaggtggcccagggtaggggccgggcctcatgggtgccaggagctggacgccggcgtggggtggcttaggtctgcaggctgaccagcagttctggctgggaccatcaggagtgaccgcagccccagggcctgctgggcacgcgcctctgcctgccacttctcaggaagcttgagctgactgcaggtggtccctctcagaggcagctccgcagaggcaggtgtgcggtgggggcagacgtggggccttctcctgtggtgtggctctcagaactcaccccagcacccgtagagggagtgtgtaggggtgggcgttcgtgtggccagaccaccctggggctgcagcctgggagacgcaggcatgccagctggtggccattgtctgaggctggggcctgtgggctccccgacaagacaggaaggttgacagacccatgaccaggcgaaggggtgacctgggagtgcggtggtggctgagggagcagccatgcttctttgcacagccggactcctcttgtggcctcgccacaagctgcacatgccactggggccaggtccagcccaaggggacctgtgaggggcgggcggctcatggtgggacacaggaagacctcagggtaaggacagcgcgggagcgtcaccctgaccgtttgcatgctggattccctttagtttctctctatgagtgtctgcacagccacaggctgctgatgacagcccagtcaggtgtgggctgcatatcaatgggtggccccgtgagaatatgatggcactggacacttcctatctcctgatgacatggtagccatcgtaacaccatagcacagttactttattcctgtgtgaactcagtgtggcccaggtgtccagggcctggtcacacacacgtccatccctacacggcggtgcatggcgacctcccaggccttcgcatccacacacacgtccacccctacgcggcggtgcgtggtgacctcccaggccttcgcattactcactcacccaccagcttgtccagagccacctccagccccgcaggctctgccatcgtcagtgccctattcacaggcaccacttaatgtcttttatactttatttttactgtgcttttttttttttgctttttatttttaaatttttttcgtgatgtggtttcacttttatagtgcagtggcgcgatctcagttcactgcaacctccacctcccgggttcaagtgattctccttcctccgcctcccgagtggttgggattacaggtgctcatcaccacacccaactaatttttttatttttagtggagacagggtttcaccctgttgtccaggctggtcttgaactcctgacctcaagtgatctgtctatctgggcctcccaaagtgttggtatttctttcttttttttttttttttttttttgagacagaatctcgctctgtcgcccaggctggagtgcagtgccgcaatctcagctcactgcaacctccacctcccaggttcacgccattctcctgcctcagcctcccgagtagctgggactacaggcgcccgccactacgcctggctaattttctgtatttttagtagagacggggtttcaccgtgttagccaagatggtctcgatctcctgacctcgcgatccgcccaccttggtctcccaaagtgctgggattacaggcgtgagccactgtacccggccaagtgttggtatttcaagcatgagccaccgtgcccagcctactttttctgtgtttaaatgtgtttagacacataaatacttaccatctgtaacaattgcctacagtattcagtacagtaacatgctttacaggtctgtggcctaggagcaggaggctgtctctcatataggctgaccttgaagatattgtgtgttcagttctaggccaccccaataaaaacggatattgaaataaagtgagtcacacaaatttcgtggtttttcagtgcatataaaagttatgtttacactgtactgtagtctgttaagtgtgcaatagcattacgtcaaaaaatatatacatacattaattttaaaatattgctaaagctgggtgcggtggctcatgcctgtaatcccagcactttgggaggccaaggcgggcgtatcacctgaggtcaggtgttcgaaaccagcctggccaatatggtgaaatgtcgtctctactaaaaatacaaaaaaaaattagccgggcgtcgtggctcacacctgtaatcccagctactagggaggggaggcaggagaatcactttaacccgggaggcggaggttgcagtgagccgagatcacgccactgcattctagcctgggtgacagagtaagacttcctctcaaaaaaaaaaaaaaaagaaaagaaaaagctaacaatcatctgagccttcggggagttgtaaccctttggctggtgggggtccttagtgtgggtgggtgctgaccggtcagagtgttggttgctgaaggctagggtgcctgtggcaatttcttaaataaaacaagaaagaagtttcctgcatacttgactcttcttttcgcagaatagttccctgtcgcatgcggtgctgtttggtaccatgttacccaccattatttcagaattggggtcagtcctctcaaaccccgttgctgcgttactaaccgagacggtggactctcccaagtcctgtgttgtcactccgcagtgttcacagcatcctcaccaggagcagattccatcttaagaaaccactttcgttgctcatccatgagaagccacttcttatcagctgaagtttcttcatgagactgcagcaattcagtcagtcctcaggctctgcttctaatcccagtcctcttgctatttccaccacatgtgcacttccttcctgcactgaagccttgagccctcaaagtcatccacgagagagttggaatccacttctcccaaattcctgtcaatgctgatatctcaactttttcccatgaatcacagatgttcttcatggcatcaagaatggtgaatccaggccacgcgcagtggctcacacctgtcatcccagcactttgggaggccaaggtgggcggatcatttgaggtcaggagttctaaaccagcctggccaatatggtgaaacgctgtctctgctaaaaatacaaaaaaagaaaaaaaggctgggcacggtggctcacacctgtaatcccagcactttggcaggccagggcgggtggattacctgaggtcaggagtttgagaccagcctggccaacatggtgaaaccttgtctctactaaaagtacaacaattagccaggtgtggtagaggacacctgtaattccagctactcagtaggctgagacagaagaatcggttgaacctgggaggcggaggttgcagtgagctgagattgcaccagtgcattccagcctgggtgacaagagtgagactccgtctcaaaacaaacaaacaaacaaaaaaattagtgggccgggtgcaatggctcacgccggtaatcccagcactttgggaggccaaggcgggcaggtcacctgaggtcgggagctcgagaccagcctgaccaacatggagaaaccccgtctctactaaaaatacaaaattagctgggtgtggtggcacatgcctgtaattccagctactcaggaggctgaggcaggagaatcgcttgaacccaggaggcggaaattgcaatgagccaagatcacgacattgcactccagcctgggcgccaagagtgagacttcatctcaaacaaacaaacaaaaaaaacgaattagtggagtgtggtggcaggcacctaaagtcccagctactcgggaggctgaggcaggagaattgcttgaacctgggaagtggaggttgtagtgagcgagatcgcaccattgcactccagcctgggcaacaagagttagaatctgtctcaaaaaaaaagaatgggccaggtgtggtggctcacgcctgtcatcccagcactttgggaggccacggtgggcggatcacgaggtcaggagatcaagaccatcctggctaacacagtgaaacaccgtctctactgaaaatataaaaaattagctgggcgtggtggcgggcgcctgtagtcccagctactcgggaggctgaggcaggagaatggtgtgaacctggaggtggagcttgcagtgagccgagatcgcgccactgcactccagcctgggcgacagagcgagactccgtctcaaaaaaaaaaaaaagaaaagaaaaaaaaagaatggtgagtcatttccagggggtttccaatttaccttgcccagatccatcagaggaatcactgtctatggcagctatagccttatgaatgaaatacattttttttaaataataagacttgaggccaggcgcagtggctcacacctgtaatcccagcactttgggaggtcaaggcaggtggatcatctgaggtcaggagttcaagaccagcctgaccaacatgttgaaatgccatctctgctaaaaatataaaaattagccaggcgtggtggcgggcccctgtaatcccagctactcaggaggctgaggcaggagaatcgcttgaacctgggaggcagaggttgtagtgagccaagatcgcgtcattgcactccagcctgggcaacagagcgaaactccaactcaaataataataagacttgaaagttgaaatgactccttgatgcatgggctgcctgatggatgtcgtgtgagcagccatgaaaacaacattcgtctcctgcgagtctccagcagagctcttgggtgaccaggtcatgtcaatgagcagtcatattttgaaaggaaccttttttttcccaagcaataggtctcatagtgggcttaaaacattcagccaattgtgctgtaaacagatgtgctgtcatccaggctttgttgttccattttcagaacacagacagtcgactttgcataattcttaagggccctaggatttcaggaatggtaaatgagcactggcttcaacttaaagtcaccagctgccttcactcctaacaagagaggcagcctgtcctttgaagctttgaggccaggcatcgacttctcctctctagctatgaaagtcctagatggcatcttcttccaatggaaggctgtgtcttctacgttgaaaatctgttgtttagtgttagccaccttcgtcaagatctgaactagaccttctagagaactcgctgcagcttctccgtcagcacttgccgcttcaccttgcatttctgttatggagacggctgctttactaaaacctcatgaaccaacttctgccagctccaaacttcttctgcagcctcctcgcctctctcagccttcacagaggtgaagggagtcagggccttgctccggatgaggctttggcttaaaggagtgttgtctggttcaatcttcatcccggccactcactctctccacaccgtcactgaggctgctctgctgattctccttcctgtgttcgctggagcagcgattttcctttccctcaggagctttctctttgcattcactgcttggtgatttagtataaggggcctcgccctcaccctgtctcggctctgacgtgccttcttcactaaactcagtcatttctaggttctcattgaaagagatgtgcaacccctcctttcacttgaacacttaggggcccgtagagttagtaattggcctaatttccatattattgtgtctcggaagagagaggccacaggagagacagacatgggaatggccggtgggctgagcagtcagacgcacacacctactgattaagttcactgtcttacatgggtgatgttcgtggtgccccagagcagttgtgatagtcacaccgtagctcactgatcacagatcaccatacagatataataatagtgaagaagtttgaaatattgggagaattaccaaaatgtgacacagacaccaagtgaacacgtgctgttggaaaagtggcgctgatagacttgcttgatgcagggttgccaaaagccttcactgtaaaaaacagaagatcagcaaagtgcagcagagcagagtgagggctgcagcccgggtgcgcggtgggcggcggcctgcgggtgtggtgggcgtcccgggtgcgcggtgggcggcggcccgggggtgtggtgggcggtgtcccgggtgcacggtgggcgtcccgggtgcgcggtgggcggtgtcccgggtgcgcggtgggcggtgtcccgggtgcgcggtgggcggcgtcccgggtgcgcggtgggcggcgtcccgggtgcgcggtgggtggcggcccgggtgcgcggtgggcggtggcctgggtgcgcggtgggcggcaccatccaggcttgctgcgatgttggcaagaggacgaggtctcctcaccatgcatgtctcagaacatacctctgtcgttacgtggtgcatgactgtttttgtaaaatttttattgtagtatttgtacaattaagtgtgacatcctgagcaattttcttttctttttttttttttttttttgagacggggtcttactttgccacccaggctggagtgcagtggtgtgatcttggctcactgcagcctcaagcccctgggcccaagcagtcctcccacctcagtcctcaagtagctgggactacaggtgcgcaccaccatgcccagctaattttttatactttttgtagagataagagtttcgccatgttgcccaggctggtctcaaactcctgagctcaagccatccacctgcctcaacctcccaaagtgttaggattacaggcgtgaaccattatgcccggcctcaattttcctagtcactaaaatctatttgaaaatggaagagggaggagcctgtcagggtcaggggtggagggagctgggccctggggccaccctccctggtgaggcagctccagccctttgctgaggattgcagagcatccacagagcatctgctggactaacccgggagggtggtctcagggtcagcaggggcaggagtgggaatggccacagtccaggacagtgacctgccggccagcatcaccccaggggagtgcccagctcaggggtggctggccccttggcaggaggacgcacgccccaaggagcactgtcaggaggagaggaacatgcagcctggagtgtcggggcctgggacttccagggcctgcagatatcaaaatagtgttcacatataggtcgaccacaggctgagtggagcgggggctaatcaacaacccgcccctggcccgctgcgggcccagcagagcattcccactacagccagctccagggatcccggcaaaagcatctttgataagaggccccattccttcctgccctcccacctgaaggaggaagcgagcagggttttcttaggagaaaaagggcccagacccctctgagccccgtggaggttggtatgagcaggtgcagcaccacctgagccccaccttgattcctccgggaccccagcccggcagccccctcccctctgagctcattttactgggatccccagcaagggctcagcatttctgaccgagggcttctgagcttccaggttctcacccctgtgtgacactgagaccctgccacatcagatgccactctgagaaggcgactcagggtgctgggggcctggacaacagcagcctccaagtacgtgaagctgcgtgtgccccggcgagttgtgggcacgagggcgtcagcagtgggtgcgagtgttggcagaagctgccagctgcccttcgtcattttctgaaatgaagatgagggcaaatgtaaacttttaaacatttttttaccttgattaattgaagaattagcagcccaaatcaggaccccacaatcaaaataaatctggtcggctgggcgtggtggctcacgcctgtaatcccagcactttgggaggccgaggcaggcagatcatttgaggtcaggagtttgagaccatcctggccaacatggtgaaactgtttctactaaaaatacaaaacttagctgggcgtgctggcagatgcctgtaatcccaggtacttgggaagctgaggcaggagaatcacttgaacccaggaggcggaggttgcagtgagccaagatcgcaccattgcacaccagcctgggccacagaatgagactccgtctcaaaaaagtaataaataaataaatctggtctataaaatcctaacatctggatgtgaaccgatagccccaaaaggcggcttctagagcacagctggccccaaggctgtgagtgtctgagagttgtcgtcatggcgtgtggttctgaggctggcgtggggcacggcggggctgtgcctgggtacaggtcgtggctgcaggaggggccggggcttgttctgcagctccgtggtttgagtgcctcacaacagaggagctggacctggcctgtgagccaggcctggtgggtgtctcctgctgctggagattccggcctggctgagagtgctgggctcctccttggtcccccacagacactggtccctgggcattggctcctgtgggttgggcagccggcttcacacactgctttgctgctgctgagctcttgggtgggtggagggtggaggcagggttggagcagggggccaggatcttcctgggtggcactgcatggacagcagtcgtgcctgagatcaggagggccgcggacacccctgtctgtccatctcagtccctcgtgactgtgcctggcactggcctctccagcacagcccagtgccctctgcttatggcccgttcgtgaaagctcccacgtgttcctctcgtctgtccgcctggctcctgtgtcctcctctcgtatctgtcccctctccccagtggccacgtttcctgtccactggatgctccctgccctgtggctgccctgctgagggtcccccttgctgtcactgagagagaaagcccttcagaaaccccagcccacacatcagggcaccggggctccttcccgtcgtgctgctttctagaaccgtgcccctggcctgcaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacgggtgagtgtggtgccagcccgctcctgcccctgctgtggggaggccctgccttccagccatggcacatcgggtggcagaaactgtccagcctggcttaaggagttgggggtccggagcacgtgtcagttgctctcctgtctggaagccacagcagaggtgcgcgctgttgtagggtccgggctgccacaggtccctgttctgcccccgtggctgcagctccttggtcaagaggcctgagtcctgagtgtcctcaaaaaggaggtgtggggtcgcactgtgatgcccttgctggtctgggtgcagggcccgccatgggcaggtgccacagctgccgccaccccagtggggtcaccagggcctcccctactcctcaggcgggggagacccagtcggtgcaaatccaggctgaaatgccagctggcaggaggggccgtggaggccggagcagttcatgtggccccctttgccctccctgcccctccccacttcctgccaaccccgacctggaccgttgccagtggacttgggggactcgggggctcggggccacggcacctgtgtctggagcccctctgtcctgcatggatccacctcctcgctgcccccactctgtgtccagggaagcctgggggtggtcactgcctggtttcccgggtggaatctcacggcaccctcccttctgtctgttcattccgcagataactactccgaggaggagtatgagagcttctcctccgagcaggaggccagtgacgacgccgtgcaggggcaggtgacctggggccggggctccgcgccctctcctggctcacaccgggtgtcctggggtctgtggggtcctcaccagctgtcaccagggcctcgtgagggtgggtgagccacgggcctggcccctggttggccgcccatctctcgtctcccgaccccaggggcccgagtttatgctcaggtggctctgagagtcttgggacacaggtgggctctcagtgccgggcctctcccatcgcccacgctgaggctggcagggtcctgccagcactatgcaggctgccgtggcctcagccactgcatatgtctctgcaggacttggacgaggacgactttgacgtggggaagccgaagaagcagcggagatcgattgtaagaacgacgtccatgaccagggttggtggagactgcttctatgaatgctggggaaggcgagggtcggggaggacgctgggagcctgggcgtgggggggacacgggcgtgggaagtgagatctcaccccaggtcacagcagcatgtcccgtggcagaccccctgattgccagtctcctgccgggtgccactgtctcccctgcctcgccacatctcctggctttagccttgtgtggccgctaggctcagtgggccctgagcaaggctgggaggctgcctcgctgccaggctcactccatgtgcagaaactccgggaggccatcctcccttttgtcccgtcaggtgcccacatacacctgagtgggctggttcccccatttttgtttgggatctggcctacctacctccacggtccccaggagcttggcagggctgttcagcattttttccctgaggaaagctcaggcagctctttcctcagaggccgtgtccggcactggcacagagggtccaccgcctggcgcctggacaccccaaggacaggcacggttccagggaggccagcgcaggtgggcggggagctctgtgcctggtgctgacaagggacatgggcacagcccagcccggacaccgccgcctcctctggcagcattcaagggggcgctgtgggcagacggtgccagggacgggcaagctgctcccaaagtggtgaagctgtgtcttgctggcctggagagcagcccccgctgtgcagaacaccagcttgagcctccattccagggcccccttgggcccaactgttgtgaagggagggcgtgggctgcctttgtagggttggtccccgagagggtggctgagggtcccgctcacccagtggctggagccgaggttctgcagtccagggtggcacgaggcacccacggggctcaggctcttggagcacgccccaccccacactcgcccacctgcccaccccacgtgggtgcccagcaccttccttctggggtcggccagggcctttcctgggagggggtgctgagggaagggccccgtgagcctgggaagggctgcagaggcttctggaagaaccatggagtccgcacacgcctccccgggtcccccttggccaggaatggaactgtcagacctcaggcctgttgggaagcctctgggagccacgagcgaatccatcagcgtggctggtgctgaggccttgctgctctcccacggcgggcctgggtgcggcctgggcctgaggaaggggctccagcggcgggtctgcagctctggcggcggctctgactctgcaccgcctgtcttgcagcaacagaacttcaagcagaaagtggtagcgctgctgcggaggttcaaagtgtccgacgaggtgagtgcgccgcgccttctgctcgcggcccccacgcctgcaacagcacctggtcgggaggaggcctctggggtctgtctccgggccacctctggttctgccgctcaccgtctgcacggccccgccagcatcgcacagtctgcgaggcgcagtgacagtggcactgcctcccgggctccaggtcacccgctgggtctctgctgaagtagaagtcgtgaataccctggaagtcggaaagtcattttcagggggatgtaaccattagtttgtgtgtttttttttttataaatagactttagtttttagagcagttttaggtttacagcaaaattgagcagaaagttcagagttcccatggacccctccccacctgacagccccccactattgacatgggccccccctccccacctgacagccccccactactgacattccatggatttttaatgttcatcttttagcttttctctaatctctgaattttctacaatgagcttgtataattttcataccgaaaagaaaaacatggctgggctcagtggctcatgcctgtaatcccagcactttgggaggccaaggcaggcagatcacttgggcccaggagtttgagaccagcctgggcaacatagtgaaaccccatctctacaataaaatacaaaaattagctgtgggtggtggtgtgcacctgtagtcccagctacttgggaggaaacctagtaggccaaggctgcagtgagtggagattgagccactgcacttcagcctgggcaacagagcgagaccctgtctcaaaagaaaaaacttcaaatctcggctcactgcaacctctgcctcccaggttcaacagggtttcaccctgttggccaggctggtcttgaactcctggcctcaagtgatctgcctgcctctgcctcccaaagtggtgggattacaggcgtgagccaccgcgcccagcctttgttgtttctttaacgtcagaagaaaaacgtgcctgggttcaggacctgaagtggagaggtggcgtttaagcgtctcagccttgaagcagggttgtcacccgtcggcctgagagcacactgcctgtagatggcgctgtgtcctaacatactcgggatgcatccagctcagcccctggggcacacactcagcgaggctgtcaggtccatgtgccgaaacaggtgctttgtggcccggtggggcaggcagcatttctgggaacagcgtaacatcaccaactggccgcagaggaagggcagctccgccactgggatggtcatcgggcccctgtgtcttttggtttgcatcttggattggaacattcccaagtgcagctgaagatgggacttagccaagtcggctccctggcctggggcttccttgagccctgctgagcgcctgtgggttcaggggtgggtgttcttggttgaatcttgaccgtggggttctgcactcacctgggcaactgaactgagtcccagaatgcatttcacttacacagattatggttctgagactcacaacccaaactgtgaaaagatgggccaacgtcacagacgctgttcagggagaggacatcgttttcatagggataattgcacagcgttgtgtgaaattcatgcaggtcaacacagtactttaatggagtgatgggatctctttccgtattttccacccatcactccctttcctgaaaagaccagaccatctccgccacagctctgaacctgtgtcttggccactaggagtgccacacctggcactgccccctgcccaggacttcacagcaaccctcagggggcaggagatgcacagtgagacgaggtcaccgcctggattacagccatctgagattgttcatgctgctataacaaaatactttagactgggaaattaataaacaaccaaagtgtatttctcgcagttccggaggctgtgagtccaagatcaaggtgccagtagactcggtgtcttgagggcccgtttcccatagagggcaccttctgtgtgttgtgtggtgagagggcctgacaagctccctcaagcctccctcatcagggccctgagcctattcagcgggcagagctctcgggccctaaccacctgttagaggccccacttcctaattctagcaccttggtggtcaggtttcagtgtaggaattttgggggtacaaacgttcacagcccccaggctgaccacagagcactggcatccaggctgccctgtgcccaggtgccacacagtgggtctggtgaggaggagagcagggctctgcttgggacccatcctgtgaggaggaaccagagtgaagtctgttccttacagccctcagcttcagctcacagcgaaagcgtccgctgagggctgccttctgaatttttcattgtaaaaggtggcacacctggatagtcagttgattttcaacaagggtgccaagttcattggagaaaatatcttttcgcaaaaaaactgaggcttgacaatgcacaccatgtgcagaattcagcttgactggatcatattcctaaatgtaaaagcctaaaatttaaattacctagattctaagccttaaaaaatatgaacttaaatcctgcactaatgccactgaactgtacacctaaaaatagataaaatggtaaatattatgttttatatatttttaacacaataaaaaaagtagaaatttgctttctgaaaggtactgttaaaagaatgaaaagatggccaggtgcggtggctcacgcctgtaatcccagcactttgggaggccgaggcagtacgaggtcaggagatcgagaccatcctggctaacatggtgaaaccccatctctactaaaaatacaaaaaaattagctgggcgtggtggcaggcgactgtagtcccagctacttgggaggcagaggcaggagaatgatgtgaaaccaggaggcagagcttgcagtaagccaagatggggccactgcactccagcctgggtgacagagcgagactccgtctcaaaaaaaaaagaaaaaagccacaggttgacagaaaatatttgcaaataacatacctggtaaagatttgtatccaatagatatattaaaaactttcaaaacccaataagaaaagcaacctgatttttaaaatgagtaagactcatacagtgaaactatgaaacattttttaaagaaagaagatataaataagtggaaagatgtcatatgttcatgaattggaaaacttagtcttgttaaggtggcaataatccctaaattgatgtacaaattcaacaaattcaagtgcgtatcagattcccagctgtgtttttgtagaaattgaccagctaaaatttatgtgtaaatgccagagactcagggcagacagaacagtcttgaagaaagaagacttatacttcccaatttcaaaatgtactacaaaaccacagtagtaatcctgaccatgtggggctggcccagggacaggcatggagatcagtggaatggaggtgatagtccagaagtgaacccttccatttatgggcaagtgatggtcaacaaagatgtcaagatatccatgggggaagaatagtcttcaacaaaggtgctaggaccactggatatccacatgcaaaagaaggaattacagccagctgtggtggcacatgcctgtaaccccagcactctgggaggctgaggcaggcagattgcataagtccacatagtgaaatcgcatctctactaaaaatacaaaaaattggccgggcatggtggtatgcacctgtaatcccagctactcggaaggctgaggtgggagaatcacctgagcccaggaggtggaagctgcagtgagctgagatcatgccattgcactccacctgggcaaccagagtgagaccctgtctcaaaaaaaaaaaaggaatttggacccctacctcacaccatattcaagaattaactaaatggatcagctgggtgcggtggctcacgcctgtaatcccagcactttgggattagtggccgaggcttgaggctcaagtgacccggatcacttgaggtcaggagatcgaaaccagcctggctaacatagtgaaatcccgtctctactaaaaatacaaaaacaattagccaggcatcgtggcgggtgcctgtagtccctgctacctgggaggctgaagtggaagaaacacttgaacctgggaggcagaggttgcagtgagccaacattgcatcattgcactccagcctgggcgacacagcgagactctgtctcaaaaaaaaaaaaaaaaacttgaaatggatcaaatatctccatctgtgagctaagattataaagctcttagaagaaaatgggccaatcttatgaccttgggttaggcaggggtttcttagatgtgacatcaaaagcataagcaacaaaaggtaagtttttctggaccacagcaacattttacagttttgtgcaccaaatagtgccatcaagaaaaccgaacagtagaacagaagaatgttttttgcaaatcatatatgtgataaggggcttgaatccagaacacataaagaatgcttataactgaaaaataaagacacagacagtctagttaaaagctgaactgtccattgctttgagaacgatgcagcctcaggtgccacggagctggggcccgcccactcctgccctgactcgctgctgtccacttgtactgagaagtcgaccaggaagccgcctcgtggccacggcttttaaagacaccgggaggacacctctggagcccgtggagtgattccttgaattagaattaccctgaccagctgcaatgtaaaatccctggaggtgtgtgctggcttatgaggggcacggagaaaaacaatctcaaagtgaaagaaccagttctgatgcctgccaagtctttgagaatcactaagagaaacacaccttgtggtgaaggttctcagacacaggatcacttccagacgagaatccataagcagctcgtggacctgcctggtccatcctggattgtgaggctgattgctctgttggaattgagctgcgagccgcggttgacatcaccattgcagatgcttaagccaagtgttttaataaagtgattatcacttgtcagaaccaggcacagtggctcacacctgtaatcccagcactttgggggctgacgtgggaggatcacttgagcccaggaggtcgaggctgcagtgaactatgattgtgccactgcgctctaccctgggcaacaaagcaagaccctttctcaaagacaaagaacagtgaattgtccaattaaaaaatgggcagggggctgggtgtggtcgctcacacctgtaatcccagaactttgggaggccgaggcgggtggattacaaggtcaagagatcaagaccatcctggctaacacggtgaaaccccatctctactaaaaatacaaaaagtagccgggcgtggtgatgggcgcctgtagtcccagctactcaggaggctgaggccggagaatggcgtgaacccgggaggcggagcttgcagtgagccgagatcgtgccactgcactccagcctgggcaacagacagtgcgagactccatctcaaaaaaaaaaaaaaaaaaaaaatagggatctttctaaatagatttcttcaaagacacacaagtagccaataagtacacgatcatcatgatcattatcactggtcattagggaaatgtaaaccaaaccacaatgagacactacttgatccccactaggatggctggaacaaatgaaatgcaacagggtgaggtgtaacagcaggaacccacaccctgctgggggaatgtaaggtggtgtggcagccacaggaagcagttgccagacacccagcacccctgttcttcagtgttgacttcagggaggtgaacacacacatgcatggacccactcagacgttcacagcagcttcatctgtgatggtcataatgcccgtcagctggtgatctgttagactggggtccacccactcagtggcgcactgcagaaccatcagaggaagtgaataaaggaaagaggtttagttgactcacagttcagcatggctggggaggcctcaggaagctgccaatcatggcagaaggggaagcaggcaccttctttatggggcagcaggtcggagtgggtgcctgcaggggaaatacaagatgcttataaaaccatcagatctcttaagatgtgctcattatcatgagaacagcgtggaggaaaccacccccaggatccagttacctccacttgtcctgcccttggcacgtggggcttatggggattacaattcaaggtgagacttgggtggggacacagtggaacatgaagtgtgccacgctgggtggatgacgccctcctccccccgccaccgagagctgcaggccacatgattccttttgggtagcactcgggaaagggcagaatgtacaggaacagagtgagattcgcagggcctggggctgagggaggggacgcactagaggaaggcaaaggggagcctcctgggtgtggggagcactttctgtcttggttttggtggtggctgcacagtggcccacacccgtcagagctcacctgcctgcacccaggccctccgtgcaccctggcagcccagatgactgcaccagcccaggggaggtggaggaatgccacacgcaccggtacctggggaccgggggtcctcggtgatcatcccgagctccaagacagaagctggactacagccgtgctgagtggaggggtttggtggctgggtgcccgcctcctattgctcctgcagactctggggtctcgggcgcccccagtggggcaatgtgggctgctgcagggaactcacgcgtgcctggcacccgtgcaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggtgagccctacagggcggggcggggaggaacagccatttcagatgccccggccactctgcgaccactctggcagacccatgtccagccctggagacggggtgggcagggccagctgcctcgaagcctgggaaggctctggtggctggaaggaggggtgtgcggctgcctggcaggcccaggctacggctgcactgagccaggcagctttcctttcataggccagggggtgcaagctctgggctggggaggaccgagaggggtcccccagggtgctggctgggctgggtgtggcaccccgttgtaggggatccgtctctgggggatgccctgggaactgcaggggacctccgttcactcaggtggggagtagagctcccatgctgggtgcccctccctgaggaggaggaggcagaggcaggtggggagggggagggcaggtgtctctgtggctggatgggaggaggggctggctggggtggcctggcctgggcaggaggagaggatgcagggcaggcagctctgtgcatgggtctgggtatggaggcctcggtcagctgggggcaggaaggcaagcacaccaggcagaaggcaggtgccagcctctgggcagctgctgaggagccagaggccccagtcagagtcaggaagcttggtagaccttttgctctcacacttttttaacctaaacaacacgaagaaggtggccttgctgcatgttggaggcgcggccccagttagccctgcagccacgcagcggcctcccacctcacctgccccggcctggcagccccagcccaacttgctgctccttcagttgccagcagccaccataacaggtgaccgcggatgtggccaccagaaacagcctctgttcctcctgttctggagattgccatcccgaggctgtggcctcattcttggccagggtctcgctgggctcgggtggaggtattggtggctgccctgactggggctccgaggtcatgcagtgcaggcccagcgtggtggttggtggagttcagctccgtgtggctgcgggatgggggtctggctgccctgccgcctggtggccgttggtcattcttgccttctggcaaccgtcctcgtaccctggcccagggtccctcctccaccttcggaaccagcaaggcccagtgaagtccccctcacactttgggcctccctggccttcctgcctcatctcttctgccttcagccggagaaagttttctgtctttaacggctcacgtgattccataggagacatctttgtggcccagatcctctcccatcttaaactccgtggtgttggctgtatctgcagagccctggccagctagcattcatagtttgaggagaggcgtgtgcgtctcggggctatgatcttgaatgggcacacacagcagcaagtttccacgtgggtttgtcacccagggtggagcagcagacactgctaagtcccgtctgtttttttagggggcgggggagttgtttgtttcttgagataaggccttgctctgtcagccaggctagagtgtagttgtgcagtcgtggctcactgcagcctcaaccacctgggcccaagcggttctcccacctcagcctcctcagtagctgagaccaatggcgtgcgccaccacacccagctaatttttatatttttgtagagacagggtctccctatgtttcccaggctggtctcgaactgagctcaagcgaaccacctgccttggccacccaaagtgctgacactacaggtgtgagccagtgcacctggcctcctgtcaaatttttttcacttgaaaggtcttttaagtcttattgaatctgtaggtctcccttcctcctttttcttcgtacatattatatcaaccagggatgagacattcggcctggatggcctggatcggccagatggtctgcaagggtctggtttgtctggaaaggcatgggtggcctggatcagcctggatcagcctgggtggtctggaaaggcatggatggcctggatctgcctgagtggtccggaaaggcatgggtggcctggatcagcctggatcagcctgggtggtccggaaaggcatggatggtctggataggcctggatggtcgggaagggcctgggtggtccggaaaggcatggatggcctggatctgcctgagtggtctggaaaggcctggatggtctggatttgcctgagtggtctggaaaggcatgggtggcctgcatcagtgtggatagtgtggaaaggcctgggtggtccggaaaggcctggatagtctggataggcctggatggtttggaaggacctggatgggcctgggtggtctgatctgcctggtgggtccggaagggcctgcttcatctgatgtgcccttgttgttttgtcgagcatgttcacctgtttgctgcaggctggctgcagatcccagggctgccctccagcaggattggccagtggagctctccccagagccccttcgtgtttgtggcagccttgcctggagctaaggctgcgagtttcaggggtgtgtgtttcctgcagctgatgtcagggcaggtggaagaaccaggacggggcagccaggttggcccagcgcttagtgttgccagctccagaatcattctgtgccctgtgctgcagctggtgcgagcggggtgtgcgctgacacgggctcttctctggacccagctctgctctgccgttggattctgcagtctgtccctccaggtgtggtgggagaactgcgctttcagtgcaagaagggtcctggaaattaacgtgtcccccacccctgttccctgagccaggccatactttgaaggcctgtcgcactcgagctcgcagacggagattgggagcatccacagcgcccgcagccacaaggagcccccaagcccggtgagtggggccacactgatctcccagagcagaccgtggtctgactgggctgtggtgtggcccaaatctcccagcatgtcctgggcccagggccctgtccagctgtcctggagccactctgcacccactgtccagcacactgccacgcaggtaccccgggcctccctgagtcccagcattcccagtccagaagtcagcgccttggcacctgcagttgagcacaagctgattcccatctcctcccccacaggctgacgtgcccgagaagacgcggtccctgggaggcaggcagccgagcgacagtgtctctgacacggtggccctcgtaagcaggcttgggccgcacccacccgttccacacatcaggcacaccaatgctgcctttaagggtctgacctggaggggcggggcccacatataggtcctcatgtcacacctggtgtgcagaggtggggtcagccctcaggggtggccaggctgccagatggtcagagtatcccaaaattcactccagcttcagggtcagggcgccctggactcaccccaccctcagggtcagggcagctggactccccccacccgcagggtccggatgccctggactccccccaccctcagggtcagggcagctggactccccccaccctcagggtcagggcagctggactcaccccaccctcagggtcagggcccctggactcaccccaccctcagggtctgggttccccagactcaccctaccttcagggtcagggcgcctggactcaccccacccgcagggtcagggcccccggactccccccaccctcaggtggatggcacccaggaacgcctggttcccccctgctgcgttgcatggggtctcctcagttaggaggtcctgggcccagggcaagtcaggtcctgggaggttgggggctggtcaccctgcatggcccggatgggagccctgtgcttggaatttggctcagctaggctccctggtcagcgtatggccgggtccacatgtaggagccacggcctagagaggcctaaaccctcacccgagccagaggccacagggctggagaggccgcagcacgggtgtggtttccacgggaggctccaggcccgtctctgctcagcagggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtgatgggggctgcacggcggggcggggcggtgatgcacctgtcgggggaggggccgtcacgggcatcagtcggggtgggtgcgtgtcagtccatcctgatgagctccctcgggtgtagacagcagattcagggcctcgtccttcttaaaaaggagaagcaaaccccctggcccggcattgggtgtcaagcctgcagccccagattccaccctacctgtttgagggcagggtcaggcgggtctgccctccagcaggtgcccccacatccccctgagtagcccctgcctcagccaaaagacacacatacaccagcttgattcttccaggatttcaatttcatgtttctgtgatatttgggactttttccaaagcagcgagtctgggcactggtttttaccttgtggtggcacgcaggtgcctgtgtccgcgctttggagccaggtcgccctggcagcctcagtgccctgcactggcctgcacctggctctgcccagctcttggcccgggcagggagggtgagctcagtcctcacggtggctccaagcctcctggcctggctcgaagtctcacaggcagagctgtgtggggtcccatcggaggcacggcctcacttgtactcagctgctgctgtggccctcccagggctggtgacctctctgtgcagcccatgttcccactgcccatcagtcagccctgtgctcacccttccctgtccccaccacaatgtgtaggccactgcaggcctgcccctgcctctgcccctgttcctgttcctgctgccacagccacttagcctgtcctggtccccaataggtccgaggggaagcaggctggccgacggggccggagcacatccttgaaggagcggcaggcagcacggccccagaatgagcgggccaacagcctggacaacgagcgctgcccggacgcccggagccagctacaggtgcagctgcaggtgggggtggagggcgtggcacgcccaggaggcagggctcgtggtcaccctggcaccaaccagagcagggcaaaaagagaagcacagggggccaagggtgctgggccacagagcatgcctgggctttggagggctcctgctacacagcagggcgggcgggccatgggttggtttgtcaggaagaccatgtggaccccagggcaagttctagtccttctgctgccctccctggtccagggcagcctcattgcttggctgatttagcccagggcagttctccaagctggccagctctcttcctgccaccgagcctctgtggctgcagggggagcaggggcactgcaggcaccagggctggcgtggtggggatgggcgctgtgcttctcttctgggtgtggacagggctctgtgcctccagatccccaggaagactgtgtatgaccagctcaaccacatcctcatctccgatgaccagcttcccgaaaacatcatccttgtcaacacctcggactggcaggggcaggtagaggggcagtctcttggagtggagggtcagggtgtaggacagaggagagtgggttcctgaagctgccccctacccggcacacctgggtgctggagctgctggctgtggtttgcctggacgtgcctggggtctctggagcccctgagagctttggtgagggtcaggtgctgggggtggcctgggcggctgtgccgaagtcagcgtctgcctgtcttctgccagttcctctccgacgtcctgcagaggcacacgctccccgtggtgtgcacgtgctctcctgcggacgtccaggcggccttcagcaccatcgtctcacggatacagagatagtgagttgggctccaccctgtactcaccacccaagtacccctcggggtccctgcacccccacctctgcccattgctccggggctaggtgcgtcctggacctggggctgtggctggtgtccacagaggctgacccatgcgctcttcgcagcctggcctcccctcagttgtgggcgggagcagcagcctggtgggtgtcctgccacactggagtggtggcctcctggcctgtccttggaagcctgggctgaggccatgactgtgtggtccctcagcctgggcacgtttgggcatgtgggggtcctgggcttgggcagctccagggcagttgtggcatgagcggccacaggcacggagccccctgggctcacactggcatccttggatggaggacggctcccctgaggcgtctgtcccctctccgtcccacctgcctctggattgcagctgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggtgagcaccacgccgtccacctgggcctgggcacagatgccacgggcagtgtggcgtggcatggagtggtgtggcgtggcgtggcgtgttgtgtggcgtggcgtggcgcggtgtgtcgtggtgtggcgcggtgtggcatggcgtggtgtccctgcttgctacacatttgttgtttttaaatgtttgtttgatacagtaacactttgttaattttaattatatgcaagataacttgattgccctaaaacagccatttgggtcaagataaagccatcgccctctgaaggggcctgagctgggtgtctcctccatcagtcgctgtgataactctatgccagtttcgatttccaaagtcagaagtgcaaagcagggctcgttattaatcctctcaaatcgtccaggtcctgtgtcgtcgaactccattacttctttaggtccatacgatgtgtcttaccacgaaacaaacccacccagccttaatctgttgaccagcagcaaggcctggaggcgacacctctcccgtgtggccctcacgatgccgacgtcagagccctgagccagccgaggcctctgcacggtcacatgtgccctgctgggccttcctcagtggcactcagggctctgggacctcagctcagggctggagctccttcagcggggccacaggcatccaccagggaggggcagtggtggctttctctttcggtggcaggaaagtgggcttgtctggaaggcagcagcacaggcctggggtcgggtggcccagcttttgtgccgcggtgggagccttgcagctccgagtcccccgtggtgacaccagccccacccctggcatgcaggctcccaccccgtggccaggtacctaggctccgtggactaccgctacaacaacttcttccaggacctggcctggagagacctgttcaacaagctggaggcccagagtgcgggtgaggcccgggcgcgtccacagcccacgccacggcgggaggaaggggccccggtttccccagatgctgtgcccaggaggccctgcacctgctcaggctcagcctcagggaagaggccatggacagggcctgctggggccttggccaggatgcctcctattcccctgagccttggaatgttggaagctgtggggcctgtctgggaaggggcgggcacagcccttcaggtcttcccacgcttgccctggtactgcctcgagagtagagcaccagggcccctcagctgcaaccagcgagccctgccgcgcttcggggtacgggaggcctgggcggggcaccggggaggcccagcttagccccgcctgcaaccccacctggcaccagcctaaccccccaccgcctcctccccctgcagtacaggacacgccagacattgtgtcacgcatcacgcagtacatcgcaggggccaactgtgcccaccagctccccatcgcagaggccatgctgacctacaagcagaagaggtaacgcggtgggcccaggcaccataccacaggctgccgccagccaccaaccctccgtgggcctccccacccgctgctgggcttggcctggtgggccgcagagccctgcaccgggcttagaccagagcctgggccagctgggcagctctgggcctccctgacagcaggtgcttccccgcaccccagatccctcatagtaagcgccatttccgcacctgtttctgtgcatgttgaaaccccgcgtgataagaagttgacagaatggatagctgtcatggggccagggtggcagtggcccagcccctccagtctgggcacctgttccttccacagcctgggtttctcgggctggggaacgaaggattccctgggcctcgggccctgtgggtgagtgatcagctcgtgtcctcacctgcccagagcaggacggtgctcaggagcccccggccgaaagtcctgcggagacctgtctgtcccgcccggcgcctcctccctgcacatctggcgccactgtcccacaccttccctagactacaggggagagagccgagtgcaaggcgcaaagccagcgctcacgggctctcccacgcaggagccccagtgagatgggagccactgagtgccctcggcggtccctggaggggtcctgagggcgtcgtaacgtgtctgttttctcttttggtggctttctgaaaaggaaaaagcattttcattttgactttaccctaaggtacggctctgtgggtctgcctcccaccctgtctgtccccaggctggtcttcagggcttgtttggcagagtcacgtaggaatcaccccgctgtcctctctccggactgggagtcaggccctgagggccaccagctgcaggctgagagcccgcacgggagaggggaagtggccccaacccgagtcactttttgctgacgtggacccttttcctccatccgatctctgacactgagtcaggagagcagcagatgggccctcctgtccctggccaggcccgtgtgctgggactccaccccagagccctgaagcctgcaggtcggccaggcaggcctttccccggctctgttttgaccctgggttttgatttaagaagtggccaggtttagcccctcctcgttttaaaccaggagcgagtggctggtgtggacaccaggatcacctgggccaggctgtttcccaggcccttcacgtttgtgaagctggcagcagcctagcaggggcacgggtgcacgccctacacacggggacgcccaagcaagtagttaaggagctggcctggtgacacggtggtcagcggctgtgccttgggccccctacacactgcagagcctggctcccagggctccctcgagcacctggggccagcagagaggggtttccagcatcttgtggcttacctggagacggggccaaactaccgagacctccaaatgggggtaaagagttttcattccgaggcagctccaccccctacaacctttcatgttcagagccaagtcccaggcacccccaaagctgccctttcagacagagccaccccttttccttggccaggtgtgtcctgctgcagggtgggggcccctgctggtcctcccatgggctcgttctctaccccgtgtcttctgccctgtgtgaggtcatttgctgtcctaggaaacccccccaaccccctgacctcagtgcagggtagttgggtccctggggcccccttgctggcctaggagctgctcgaagtgggcagcctgggaccacccacagctgtagggctgggcgctgggaagacacaggaagggggctgaacatcctatgtcttgtcctgctaaacaagccttcacaggtgaaagaccagccgtgggggcctcccctgctgacccccagcagcctccgcccttgccccctggctgtggcacgaggagcctgcagcatgttctggccgcccggccgccgcaggccgtggacgcagctgcttgtatctcccaggtcagctcttccaagcagcaagccagggccttagggggccttacacccactcccaccctgcacctcctgcccctgcctccgtgttgcaggggtgacactggctgcctccacgttataagggtgacactggctgcctggggtcctggaaggaacccagcaaaggccataagtgtcttacctgctctctgtacccagaggagggtcagtcgggaggctgagagagtgcaggcggtggcacagcccttgtgacgggggacctgtgcagagccctctccagccaggctcccctgcgagagtccctcgtgaggtgactcctgctggcccgccctcctctgccgagaatggcactcctcctatgagggcaggccaggcctggagggcggcctcgagccccagcctgcccgtgcagcgcatgggtggaaagggctgctcaggcatccggcagcttgcccagggccatgcggagtggcccccaaggcatctgtgccctccgtgcccgcggggcctccccacgccacggtggtatgctccttacactcctgaccacactgcctccacagacatgtgtgtgcctccagggtcaggatgagggtctcagtgtccagccggtgtcacccctgtcatattggcccatgtccagggctgggtgctgtctgcatggcccagaggcgcagcttggctttgagagttccagcaacatccctgtgttgtgacgtctcctgcattcggccctcatctgccacgcactgccccatgggcctcggagcagagcatggatgggaggccagcctgccatggctggctcggtgggggggtctggctcggcagagggcaggtggccctgggaattggagccacccatgccctggggaccagcagccaccacctgtcttctgtgccttcgcgtgcctgggaggacacagatgtcacagatttccaaacactggtctgctcaacaaggatagtgggatgtcaaaggccacgtccaggcactcctgcctgacagctgtggacacagccagggtgctggggggccaggaggccgccctgaggcagaggtgggcctcaacacaggatttgcatcgctttatgttatttgaaatggacaagaagaggggaaagtttcaactcttctccttagaaatggaactaggcctggggcatctttaatgggatgggaggaatctgtaggtggtttcatccagaggcatttgccaggtcttctgcagagggtgggccaggagccgtccaggttggcgtctggggagggtgggtcttgccagccgccgtctcctcacactggcgctgcgaagacagggaaggcacctgctgggaccagccgcagaggctgcctcctgggagtgtgctctggaccggctgccgggcagaggctgttttacttgtgggcacactttgtggggagcactgggatcaagcctctgccctgcagggctcttgaggagatagcgctgctggtcctgggagctggtgctccaggcagacggctgggctgggcctgtggcatcctccgctgggcctgtttcctgcaagggattctctctgaatgaccctgtgctggacgacaacccaagggagggccggggccactgtgcgagcccatgttctgcacctggtgccgggctgtccctgagggccaccctgctggcctggccattctcgtcctgcccccggcgctccaggggcaacaggtgctcctctgcactgtgtgtgcacagtctccgcctgtaagacagccacttgccggcatcagactctgcagtttggggaaatgagacagaagaaacagctgagggagctgcccagagagaaggcaccagttgctgatgcggtctggctgaggaagctgggcggggaggcacctctgtccctacgtgcaggccacggggggccttgaggccaggggagaggaggaaagaggagagccagacccagcccaccactcaggataggccctgccctctggatctttcctggggcccagaaggagatgccctcacctcaccctagctgccggcggggcctcatgctgtgctggccccttgtcttgtgggagagctccctgggcccaagcccaggctgcagtgggcacagtcagcaggagcctgtgcgagctggaccacaggacagccctgcttgagctgcacacgtcggaggggaagacagacgggtcccctcagcggccccgcggctcctgtcctccacccttggcatcttcgtgtggacgggctgtgaccagacttccaggagaggctgctgttacctgccagatgttgtatggggccaagtccaggcaaaacctccactgcccgctgagtacatcagctcacgcggggcacggcctggggtgtgctgggcctgcctgcaggctgtgcgtggggtgttctggtagaacatggaggcccactgcagccaaagcctggcctcttatgtgggcatggacgttacccagatagtctggagaaaacttctgcaccctggctttggtgctgctgattaccagagagggcccaggctcttcctgggagtcccagggcactggcagctgccctaaccccagcagagcaggggtgcccagcttggtggggaagtggaaatgcaagccggacagggctgagctggctgtgtgggcgtcgggcacctaggatggcagagtgaatccctccgtggagctgtgccctctggcctgtcctcctgaccatgggtgcacagagacccctttgtccttccagcatgtcagcatgtcagaaggggcccaggcgttggtcctgggggccaggccagggctggcagtggttggagatgggtggggccgggacacacagggcagggctgtccggcagggccatccggcagggccgcggccccagggctgcgccaggttctcaggccaagagggagctgtgcccaccaggcggggctgtgccctgaggagagcttaactgtctgtttccttgctcttagccctgacgaagagtcctcccaaaagttcattccctttgtcggggtgagtactggccagctttatgtgatgggaaaccgcacacctgccaacttgtcgtttacagtcagaacgtttggggattgactcgatatattccagaaccttcccacagatacgagctggggatttgccttcccatctggcctgtctcaaagctcgcttccttccctgctggagtggggtgtggggccagaggttgttagttccccttagctctgccttgggggctgataaatggaagcagagacaggtcggtggggcgaggcctcagaacacccaggaggcttggccccacgtctcaggagaggagagactgcctgcccgggttggggagggcgcctctgtcctttaggagcccaaggccccgggagcttcccagtgctcacttgggctgcagcctgcagtgtgtgggtttcacttcctgccctgcccagggttagggctgcttctgccagccaggccatctccctgccagccctgggtctccacagcctgtttcctgccatcttttcgctctgttgtgtggcctccctcccgccaggtgtctgctgtgagacagacccacagggcctggcagacaggttgcccaggcagcggaagggtctctgggcctcggtttccccactggtggaacagaggcctttttgtgcaccgtgcagtggttgggtctgctgagggctctggggcgatggctggccctctgggagggtggaattcgtcttgaacagcggctgcccaaagagctttctccggtgacaagagtacactgtgctcgggcacacaggccttcccatgcaaccaaggccctgcggtgtcactgggattcacggtagatctacgtagccgcctgtggctcgtggctgccaggtccggggcctatccccgtcggcccgccaaggtccctctcaccagcgtcctgtttttactgcacacatagtttgcagctgccctgagggccgactttagagagagcagtccctcctgctgaggccacgcaccctgagcactgtctgtccccacatggctgctctgagctcagctctgctccacagatggggagagaagggcaggagggagctggcaccacctggccgctccagcatcatgggagtggtggccacggtggggaggcgggagccccactgggagggcgctgggctagctgaattgcacggctttcaccagccagtgcctgttgttttctaggttgtgaaggttggaattgtggagccatcctcggccacatcaggtaaccccgtcccaccctgaggccttgtgagtggcccgtgggtgggctgcaggagcacggtcattcgagtcctgcagaccagatcaacctttcagggcctgagagccgccacgtcccagtcttgctgtggtgcttctgtcctgcggggggttcatcctccaaggactgctgtcacaaagccccacatcaaggctggcagggttgtcttccaaaaaccgaggagaatccgagaccctcccgtctctcacaggccactggggactcccaccctgcccacccccaggagctgcctggcctggccacatcctggtccggagggcctggtggcacccgggcagagcagcaggtgggctcagcctgccctgtgactcctccccaaaggcgactcggacgacgcggccccctcgggctctggcacgctctcctccaccccgccgtccgcatctcctgcggccaaggaggcctcacccaccccgccctcctccccgtcggtgagcggaggcctgtcctcccccaggtaaaggtgcctcacggctcagcacgtttcacttacccgccccaccacatgctgcctgattcagtcatcctcccctatgtcacatccacctcccagggcacctggcctgtcagccacgaaggcggaggggctctgcaggacggctgggtcctctctggccacctcctgccacagatctggtgtttgggggcaggacctctgggggacagaaactcctgcacagtgaataaacatgggcgttgtgctgggctgtctctcagctctgtacacagttggggcttttaaaaaacaagctgagggcagaaggtgcaagagacgtgagtctctagacggtcctcatgggatgagcttcgatagctgtgctgaggccccgctagcccgcccgggtctctccggagcagacctcactcaagtggaactaagccatggggggttgtgggccctgaggccaggcgtggtgctggtgctgcgtgcagggctcacaccagcagatacccccccgacccccctgcctctgtgtttccagccgccggctccttccaggctgcgcctgagggagctggttcgcacgggccctcacgactccaaggggcagcttggagagcaggtggacaggcctcccaggccgaggctctcctgtcgccagggtccctgtaatttaagcaggacccttgtgggggtgactgggcatgtgaacagctccacagagcatgctccaagcacccggccctcctctgctggcaagttggcacaggtgctggctgtcacctcctggcctgtcacagggacagtgatgtccccatcactaggcccaaagatgcaggtgtgaatgcctccctctgcctttcccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaagggtgaggtggggcaggctataaggccacacggcgcagaagggcggctctgtgggagagggcggctcgcagtcaacagggatgacagcccccgggctggcctcgggcagcccacatgcgcaggcaggggcgggtggggtgagggagcctgaatcctgagggcagtgagggtcaggtgcttctgaccagagcctcaggcggaggccagctgggtgggcaggagagcagctgtcctcagtcaccgtggaaggcaggtttcctaggtgagcagtgccatgaccagctgagcccccagtgcctcccccacacgtacccctggccctggccccagccccgaaggagcagcaagatgacagcagggcctcttttctcctcccagtgatgtttctgcccaagaaagcgaaggacaaggacgtggagtctaagagccagtgcattgagggcatcagccggctcatctgcactgccaggcagcagcagaacatgctgcggggtgagcaccaccggccccggggtctgtagagtgggacgtaggtgagagcacagcaaggctgctttggagcccagcctaggagctgcgggtgtctcgctgtgacacgcacattccacgattcaaggtgcaagcacattcgatgaagccctcagtgaggctgacaaccttccaaatgctgagaaagaattttttttcaaccctttttgctttttaaaaataatgacttgtttcgtttttcttgtttgttttttgttttggtttttttttttttgagacagagttttgctcttgttacccaggctggagtgcaatggtgtgatctcagctcactgcaacttccatctctcaggttcaagcgattctcctgcctgagcctcccaagtagctgggattacaggcgcgtgccaccacgcccggctaattttttgtatttttagtagagatggggttttaccgtgttggccaggctggtctcaaactcctgacctcaggtgatctgcctgcctcggcctcccaaagtgctgggattatgggcgcgagccaccgcacctggcctaaaaataatggcttgtagtttaaaagtgttggctgagcgcagaggctgaggcaggagaatggcgtgaacccgggtggcggagcttgcagtgagccgagattgcgccactgcactccagcctgggtgacagagcaagactccgcctcaaaaaaaaaaaaaaaaaaaggggttttggagaagatactctgcaagtaactgtttcagaaacggagctctgggaggctttcctctttttgagcacgggtcagatgacctccaggtcgacgtggccctgtctccccacaggggtctctgttttaagggggctcccactgtcttcttcccacacctgtgcaggtggaagtggatgtggacgagcagcgcctggcggaaggtggtggggtctgctccttccacctgcaggcagccctgggggaaatgctgccctccccaccccccagggctctgagtgtggagggcaggggcaggaatggcgtccctcaggagccagcatggccctggagcccccgagtccctgaggaaagtgttgatgccctccagcatggggctccttctcatcctgtacgcccggctgccacccagcctggtgggccaggcaggcaggtggatagggtgggcaggccgggcaggggggcaggcggtcaggcagccctctcccacagtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcagatatttttaatgcttttcaatacatgttctaatgtagctgccaaacatgttgctcttctgaagtccccctggggctgggcagagccagcagagcctgcccccacttccccagcccctgccccaccccgcctcacaccttccccactctcaggctgttcttgaaacaccatgaggcttctgcgtgtagtccctgccccaaacttagcaagcacaggggcctccacagcccaggtggccccagaaaatgttccagagcccagcttggtacatagtgagatgctgctggggttggcctgaggtgggggccacttcctccaccccagtgggtatgtctgaggtcagccatggggatatctgggttgagattcaggttttggtgaatatggggcaggcgtccagatgtgtttgtgtcacctgctgcaacgctgtagccaatgaagattccagcgggatggcctgaccagcggggccggcactttggagccgtgggtgcagccaggtaccccgtgcagggcctgggaggctctccaggccacagtcctcagagcgtgttgggtcccatgttgtgtgtgggttccatgccctccacacagcaggagagggcttccctgaccacacctgccccctcagtcctgcttctccccagtaagcctgcactgtggggtctccataggaggagctggggaagctggggccctcccaggggtcctgatcgaccctgggggctcttggcctggtttcgtaagatggagcactgcaaaaggccatgctcagaaagcaaacgcagggcagggtgggcctcgagccggggctggaggggtctccacccttgctggcctgagagatggcccacatttcttacttgtgaccgccctgctcttcctggccgccccccccaggtggctgaacagggtgattttgttgtggtgaggggccaggatgtggcctggtgtgcagcctcagctccctgggttcaggcctcagaggtagcctgtgtgcaggaggcagagccccagcccctcccagccagagcccctccacaccagggactcctccttcacctgggaccaggagcctggggcacaccccagggtgggggagagggtaggaaggtctcccattgaatcctggcttcaggctctgccccgagaagtgtctgcggtgagggtgtgagccccgggctgatggcctctgaccccggcaacaggtgggaccctgactgactcgttcagctgcccccaagctgggctgcagagcatctgtttttctgctctccagtttcttttctttttttttttttttttttttgagatggagtcttgctctgttgcccaggctggagtgcagtggcatgatctcagctcactgcagcctccgtctcccaggttcaagcagttctcctgcctcagcctcccgagtagctgggattacaggcgtgtgccaccacacctggctattttttttgtatttttagtagagatggggttttgccatgttggccaggctggtcttgaactcctgacctcaagtgatccacccgcctcggcctcccaaagtgctgggattacaggcgtgagtcaccgcgtcctgcctgctcttcctgtttctttcccaagggtcacactcagtagggagatgaaggtggaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccaaagaagcaccactgtagtttctgcagacccccatgcggttcattgtgcattgtttggtttctaggatgtatgtgttgctagttttttttaatgaaaccctggattaatgtaaatagctttttggggaacggattctaatgtcacgtatgtgaccgtgtggactatttcaaggtgctgatgcaacactaataaacctggaggggccggc

SEQ ID NO: 1489 - DNA, 97338 bp, Homo sapiens
caacggccgcgcccgcgggatgggacaggcaccgggaccacggcggggacgcgaggactggagccgcgacctccccactgcgagcgagctggcctcccttgcggcgcgccggcgtcggaggggcgacctgcgggggctgggcttcggcggaacccgagcggggcctaccggtgagcgcagccgaggactggcgcttgggggcggggccacggcggtgagcgcagcccgggactggagtttggggcggggcctcgtcggtgggcgacaccggggactagagctaagggtggggcctcgcggtgagtgcagccggggacgggacccaaggctggcgacgggacccaaggctggcgacgcgacctaaggcagtgggcgggcccttggcgatgaacgcagtcggggactaaagctggacgcggggcagaggagggtcctcctcggatagtgagcgcggtctccagcggcgagcgaggcctggggtgaggactcagccggatgcggggctgagggtggggggcggggcctcccgtggagagacggcctgcgaagggaactggagctgtgggcgggggaagggggcggagcctgggtctggacccgaactgtgggcggggcttgaggcgagggggccgagcgtggtgggcggggccttggctcctgagggcgacctgggacccaaccccgggctctgggagtggtgggcggggccagggcagctgcgctggggggcctggccgcagaggtggagacacccgccaggggccaccctgccccgccctccgcatttgcggcgtccgccgctccgctcgcccaggttccagagcctccccgtgcgccccgctattctccgttttctgttcccctaaaattcccactttctagcagtcattcgtggccacctgtggttacccgtgagtcacctcgctgtgccccctgcccagagcgggaaccctggctgcgcacgccctcaaatatctgcaggtgctgttcacaatcgccatagggccggtgacatacccaggaatgagcctaaaaagaaatgcgtaaccaggcgtagtggctcacgcttgtaatcccagcactttgggaggccaaggcaggcggatcacgtaaggtgaggagttcgagaccagcctggccaacatggcgaaaccccgtctccactaaaaatacaaaaaaattagccaggcttggtggtgggcgcctgtaatcccagctactcgcgagtctgagacaggagaaccacttgaacctgagaggtggaggttgcagtgagctgagatcccgccattgcactccagcctgggtgacgggtgacaagagtgaaactctgtctcaaaaaaaaaaaagagaaaaaaggaaatgcggaagaccccaccctcttttttttctttcttttttttttttttttgagacggagtctctgctctgttgcccaggctggagtgcagtggtgagatatcggctcactgcaacctctgcctcctgggtttaagcgattctcctctctcagcctcccgagtagctgggattacaggtatgcaccaccacacctggctaattttgtatttttagtagagacggggtttctccatgttggtcaggccagtcttgaactcccgacctcaggtgatccgcccacttcagcctcccaaagtgctgggattacaggcatgagccaccgtgcatggccctatttcattaatttctgctctcatttttgttagatccttctttccacttaatttggttcaatgtgttccctttttctagtttcttcattttttaaaaattgagatagtgtctcattctgtcacccaaggtggagtgcagtagcataatcaagcctcactgcagactctacctcctgggctcaggtgatcctcccacctcagcctcccgagtagctggaactacaggcatgtgccaccacacccagataatattttttgtagagatgggtttttgcctcatttgcccaggctggtctggaactcctgggctcaagtgagccacccgccttgtcttcccaaagtgctgggattacaggcatgagccactgctccccgccctgtcctcccaaagtgctgggattacaggcatgagccactgctccccgccctttctctagttcttttttttttttgagatagagaacacccaggctggagttcagtggtgccatctcagctcactgcaacttccacctcccaggttcaagtgattctgtcacttcagcctcccaagtagctggaattacaggcatgtgccaccacgcccagctaatttttgtatttttagtagagatggggtttcaccatgttggctaggctggtcccaaactcctgacctcaagtgatccacctgtcttggtctcccaaagtgttgagattctacacgtgagccaatgcacccggcccctttttctagtttttgttttgttttgttttttgaggtggagtctcgctctgtcacccaggctggaatgcagtggtgcgatcttggctcactgtaacctccacctcccgggttcatgccattctcctgcctcagcctcccaagtagctgggactacaggtgcccaccaccatgcctggctaattttttgtatttttagtagagacagggtttcactgtgttagccaggatggtcttgatctcctgacctcgtgatccacctgtctcgccctcccaaagtgctgggactatgggcgtgagccatcgcgcctggccttttcctagttttttaaggtgaaagatgaaatcattgatttaagatctcttttcctttataaataggcattttattgctataattctccctgtaattaccactttagctgaatcctgcacatttcaatgtgctgtgttttcattttcattcagctcaagattgtctccactcttaatttcctcccggatccaagggttattaggaagtgtattgttttgtttctaaatgttggggatttttcaaatatgtattattgatctctatgcaaaatgctctctgtccatgatgacatttcatccttatggcaacactagcttgcagacactgttgtctccattttatggagggagcccttgaggatgtgaggggtgacagccccaaatctcatagccagtaggtaacaaagccagaatccaatctgaggccatgtggccactggatccttgctctcacctgacagactagaggggttatttcgtgtgctccctcaccaaagcctgtgaggtgcctgcaggtgcaaggggcagcatgcctcccaggccacagcggtgcaggacagtcaggcagtacaggacagtcaggctgtacaggacaggattggccagaggagcagagggtggggaagaccacacccacaacggtaagaggtttaaagggtgtggtttcagccaggctcggtggctcaggactgtaatcccagcactttgggaggctgaggagggcagatcacgaggtcaagagatcaagaccgtcctggccaacatggtgaaacccatctttccaaaaaatacaaaaattagcaggtgtgatggtgggcgcctgtagttccagctactcgggaggctgaggcaggagaattgcttgaacctgggaggcgggagttgtggtgaggcgagatggcgtcattgcacttcagcctggacgacaagagtgaaactccatctcacaataaataaaataaaataaaataaaatataaaaaagggtgaggctctactgggcaatggcccaaggtgcgtgctgccagaactaagcctttgctcagatgggctgcagaggaggggtgctatggtctgaatgtgcattgtatcagtctgttttcacactgctgataaagacatacgtgagactgggcgattaacaaacaaaagaggtttattggacctgtagttccacgtggctgcagaggcctcacaatcatggaggaaggcaaggaggagcaagtcacgtcttacgtggatggcagcagggagagagagagcttctgcagggaaactccctcttataaaaccgtcagatctcgtgagacttattcgcaatcacaagaacagcacgggaaagacctgcccccatgattcaattccctcccaccaggtccctccacaatatgtgggaattcaagatgagatctgggtgggtacacagagccaaatcatatcatgtgtgttcccccaaagtccatatgttgacgtccttgccccaaggcgatggttttagagaggtggggcctttgggagatgaggtcatgagggctgcttccctcatgagcgggattaatgccctcagaaaagtggctggctgggcacagtggctcacatctgtgatctcagcactttgggaggctgaggagggaggattgcttgagtccaggagtttgagaccagcctaagcaacatggcaaaaccctgactctacaaaaactacaaaaacttagccggttgtggtagcatgtgtctgtagtcccagctacttgggaggctgaggtaggaggattgcttgagcccagaaagttgaggctgcagtgagctgagatcacaccactccactccagcctgggcgacagattgagaacctgtctcaaagaaaaaagaaacaagaaaaaagaaaaaacgtggctggagggagcttgtctgctgcttcccccatgtgaggatgcaggaagagggcactgtctatgaaccaggaagtggccctcaccagacacggcatctgccagcaccgtcctgtgaaatgaatagtggtttataagccacttggactgtggtggtttgccattgcagtgtgaaccaactgaggcagggagtaacgctccccacgtgatgtgaaggcataaagaatggagccaggttagagggagaatgcggagaactgccctggggaccggttaggtgccccatgctgcaagcgccccaggaagcttggaaacatttaggactgactgacaagctcaaagagtcaagcaagggcggccaaggggcaccagtgccctcagagcacccacactgggcacccagcaccagcttcctgtgcccagggtcctctgtactcctcattcagccctgcaaggcaggaccctcactcgcaccgcgccaaagaggacgctggaaacgtgcagtgatctccgctctggctgtaaacagggagaggctgtgggcttgcccctagacctgactccagcacacagcagcagagcggggcccaggctgggggtgtggggcaggaacattccttcatgggggccccagagagctggaaagtaatgtaggtgttgcactgaaatgagagaattgctttaatctgaactgaacgtgctcgtaacacttagaccaggaaggatttccttttctcagggcctgagaaaaatgacctgaccagcagggttagagttttgaaggacacgcctaggcacctgcaaacttcccctcctggaggctttcttcattcatggtgtcttttgtttttgggtttgttttgttttgttttgttttgttttgtttttgagacacagtcttgctctgtcccccaggctggagtgcagcggcgccatctcgactcagtgcaacctctgcctcccaggttcaagcgattctcctgcctcagcctcccgattagctgggattacaggtgcatgccaccatgcccggctaattttttgtatttttagtagagatggggtttcaccatgttggccaggatggcctcgatctcctgacctcgtgatctgcccacctcaacctcccaaagtgctgggattataggcatgagccaccacacctggcctgttttttgggggttttttttgagactgagtctcgctgtgtcgcccaggctgtagtgcaatggcacgatcttgatgtaccgcaatctctacctcccgggttcaagcaattctcctgcctcagcctcccaagtagctaggattacaggcacctgccactgcgcccagctaatttttgtatttttagtagagtcagggttccatcatgttggccaggctcgtcttgaattcctgacctcaaatgatccatctgccttggcctcccaaagtgctgggattacaggcgtgagccaccgtgccaagccccatcgtgttctcatctgtggtgctttgacatcttggggtctcgtggacctagagagggactcccctcccagggttagctaattcctagagacagctgaccacttgcctctgagtatgccttatttactttattttttctttttttcttttttttttgaggcagggtctcactctgtcacccaggctggagtgcagtggtatgatcatagctcactgtcgtctcaaactgctgggctcaagagatcctttggccccagcctcccaaagtactgagatcccaggcttgagccaccgtgcaggctgagcatacctttgatatgcagagcaaccatcatgagtcccacctgcctcctttcatcaggctcctgcattcctgaacactagccccctgccctaaatcaccccaaggccaggtaccagctagctagataccacccccaagcccagagcccactgaaatgacccagttctaattctgctcagcttgcctcctctgccttgcctggaaaatggcaataaaggctcttgcccaccctttcccttcaccccctccctgtcctgactggccctgggtgcttccccacgtgcccctcctcctgggaactgtgagtaataaactcctctttcaaaggcggttgtctctgtgtctgtcatcttatcacatttgatcaaaataactcctgggtactcaatagccctgtccccccatgcagcagtcagcaggggaaatgagaaagcaagcttctatggccttctcaccttctcacctgctgcctggccttgggcaagtgcttcaatctctctaggtttctacttcctcatctgcataacagggataagaatagcccaccctagcactgcggagtatgatggaggacatgtgtctggtagacagactgctcagaaggcaagtccctgttcctgtctgttctccgcaactcgagtgagacttggtgaggctccagtccaccttccaccacagaagtcaagggccaggccaggacagtggctcacgcctgtcatcccagcactttgggaggcagaggtgggaggatagcttgagcccaggagttcgagaccagcctgggcaacaaagtgagatccctgtctctacaaaaaatttaaaaattagctgtgcgtggtggtgcgtgcctctagttcagctacttgggaggctgaggcaggagaatcgcttgaacccaggtgactgaggctgcagtgagttatgatcacaccacagcactccagcctggaccatagagtgagactctgtcccccccaaaaaaacaattaggccgggcacagtggctcacacctgttatcccagcactttgggaggctgaggtgagaggattgattgagcccaggtgtttgagaccagcctgggaaatatggcaaaacagcatctctaacaaaaatacaaaaattagccaggtgtggtggtacatgcctgtggtcccagctactcgggaggctgaagagggaggattgcctgagcccaggagacagaagttgcagtgagctgagatggcaccattgtactccagcctgggcacgacagaggcagattctgtctttttttttttttttttttgagatggagtcttgctctgtcgtccgggctggagtgcagtggtgcaatcttggctcactgcaacctccgcctcctgggttcaagtgattctcctgcctcagccttctgagtagctgggattacaggtatgagccactgtgcccagctaagttttgcagttttagtagagacagggtttcaccatgttggccaggctggtctggaactcctgacttcatgatccgcctgcctcagccccccaaagtgctgggattacaggcatgagccactgtgcccagccatgactttgtctctaaataaataaataattttttaaaacccttagggacccagcacagtggttcacacttgtaatcccagcactttgagaggctgaggcaggaggatggtttgagtccaggagatctggcctacagtgagccatgatggcaccactgcactccagcctggttgacagagcaagaccctgtcaagaaaacaaaagaaaaaaaaagaaaaagacaaacaaaacctaacaaaaccagaaatccatcctgcacgaagagcactgaggttgagtgttggttgacacgtgttgcggtaattgctgttctgatgtctgtgaatgtccttggctgatttctgtattagggcctgggtgttttcctttcttttctaatatttaagttatgtcctggcttattgtgatgatattctattgtgggaaagaaagaagtgttaaaatttatgcatcaaggtccctcttaatcttggggctcaggataaccacagtcaagaggggagagttttattcctgaatccaggtcatgctgtgttcaactttacaccctgatttgtcacacaatcacatatctgagaatttccccatgttgctaaaactgaggcagcgttccgttttgctggttattccacatcccatggggtggatgtgccagggcaagttttgtcatttcccctggactggacattcctttctgtaggtgttgctgtttgaaatatctcacacacctggacctgtgtccctgttgacatttccagtgtcacctgcaggatgccatgggatacccatgagcccaggcaaatctcccaagacgctgccaagccactctgcagagctgctctgggtcctgccccaggtgctgtgtgagggagctgcgctgcctgcgcccaacccaggaggggagcagcgtgcaggacaccgaggatgtcatcacgaccttaggtctgtattaggtctagattagcctgcattaaggagaaggtggtgatgtgtgtcttttttttttttttttttttttttttttagacggagtctcactctcttgcccaggcaggagtgcagtggcacaatctcggctcactgcaagctccgcctcctggattcaagcaattctcctgtctcagcctcccgactagctgggactacaggcgcccgccaccacacccgactaatttttgtatttttagtagagacggggtttcagtgtattggtcaggctagttttgaactcctgacctggagatccacccgcctcggcctcccaaagtgctgggattacaggtatgagccaccgcacccagccatgtgcatctttttataatttacaattcgtgatagtagtgacaactgtctcacttattcttttgtgaatcttttgtagcttctctaaccattttccactgggaattttttagtggtcttatggacttgtatgatttcctttgatattaagaatgttaccctagtgagccaggcacagtggctcacgcctgtaatcccagcactttgggaggtcgaggcgggcggatcatgaggtcaggagatcaagaccatcctggctaacacggtgaaaccccgtctctaataaaaatacaaaaaattagccaggcgtggtggcaggcgcctgtagtcccccctactcaggaggctgaggcaggagaatggcatgaacccgggaggcagagcttgcagtgagctgagatggcaccactgcactccagcctgggcgacagacagagcgagactctgtctcaaaaaaaaaaaaaaaaaaaaaagaatgttaccctagtgaaacattcagtattcttacaaagatcatcctcaatagtttgttgcgttgggtgagggttccctttgcacgtttggttttttcaggacggggcgcagccccagccagatggcgcccggctctccagccagcggcagctcaccctgctgtggtttgattttccctacacaattaatacatgttcatcatggagaaaataggagataaagataagcaaaaaggagaaaccaaatcaatggaatccccatcacacagagatactttcttaacactttggattaatttgtatcctatcaatatttttctatacctgaaaataggtgttttatatgtataatcactaacatgtaaatacatactgcacatggacatgcattttcacatacatttttgttttcttgagacagagtttcactcttgtcacccaggctggagtgcagtggcacaatcttggctcaatggaacctctgcctgctgggttcaagcgattctcctgcctcagcctcccgagtagctgggattacaggcgcgcaccatcatgccccactaattttttgtatttttagtagagatggggtttcactatgttggccaggatggtcacaaactcctgacctcaggtgatccacccacttcggcctcccaaagtgctaagattacaggcatgagccactgtgcccggcctttttatttttattttttgagatggagcctggctctgtcccccagactggagtgcagtggtgtgatcctggttcactgcaacctccacctcctgggttcaagtgattctcccacctcagcttcccaagtcactgggatcacagatgcgcaccaccatgcccaggtacgtttttgtatttttgttagagatgggactttgccatattgcccaagctggtcttgaactcctgaggtcacgggatctgtgcgctttggcctcccaaagtgctgggattacaggtgtgagcccctgcgactggcctgtttttagctacttttaactcactatttctgccagctgtagaatattctatcaggttctatcatggctcacctaaccctgttctactctacaaccccggggttgattccaggcctcactctcagcagttgagctgctctaagggtgaccgtgggaactgtccacaggtgcggctgcgggtgcagcgatctcagcggtcttagagctcttggccatcccccacatggcttcccagaaaatgcctccaggaggagggccctgctgtaccttttttgtgaccattcctcctcagcctcagtcatggccatgtgctccaaccatgggagtggatgcggcagggcctgtctaggggttcggcagttctgtccctctgccatagcatgggctgggcagggacctggccacgtggggctgcttcctcagcccagctcctggcaggagaaggagtaggggcgctgtgggctggagccgccaactgaccagtgctggccctggaggaggcccctcccccactccccgacttcagcagggcctgctgtgtgtctgtgtcatcttagcccaggctgaggagatgaatgcgtttccaagcagcccatggtcctggcgcccgactggaaaagcctgagccttcaccctaggtggagggacctagcgaagccaggcggacagaggaaaggcctcggcccatcctgtcccatgactgggggttggggcttcgtctttttaataccaatggaatcctagccaagcattcagaaccttgaagctttaacttcttaaataataataactcccacaacctccggggaccccgggcagcacgtggtaggaccagctttcaggttgtcctcctgagaccccagggctctgaaggatcctcttcttggacctcctccccaaccgtgcccagccaccccagtcatccgagaggtttgtctcaaaccaagttcctgctttaaagaaaacgctaccagagaaagcacctgtgctccaaacacgggggtgagggctcacaccatgccagggtcatagcatggggagggatgcctcccagccttcaggggatctcctcctgtgacccacagccctcaagagaaggaccagcacagcatcattttccgacagaggagggcagtgcaaataacaagttctggctaaaaagttactctgatcacccaagggacatctgtgcacttggaaaatacagaagaccacagtcccatcaccaccatcccaccttaaaaacaaacataaacgtggtcgcaggcgtgacacatggtgtgtttcgtgtccctgctttcctgcctggcagaagcattgatgtagacccaccatacgggttcttcgggccactctggtacagactgtgtgggtcatatcccgacccctggcagctgcataacctcacaggccgccatctcctcttttgtcacttgggatgggacagaactgtcacgtcccttaagggctcacaacggtgcctggcacagaggaggggcaccgctcaatggtggcagctggtgccaagccctgctgtgcacggcttagtcaccccgcatctcctcacttgacccccagttgtagtccctgcctgggttagacgctggcatacacaggcaccatgtgtcaggcggcccatccgtctgactgcaactgcacgctcgccaggtccagcagcgccgtacgctcagttctggggtcaatgggtgcctgtctcctgccctcccatcacagacagcctgtcctcctggggtatggctaccccctctctggacatagtcacttctccccctaccctgtctcaaaggtatgagatccaccggccctctgcccgccgagcagctggccaaggtcagacagaccctcatggctctcagtgtaccaccttagaggagccaggggcgcgtgggaaacacagagtcccttgttctctccgaagtgggaccctgactttaagcagtcgcagctgtttgcagttctagatacaggagttacagctggaggctgagctctctcaacggaggaagcagcggcatgagggcctttgcagaaggagctgacggggcactggggtggcaagccccgtgggccaggaaagaaaccagctccaggtcaatttgctcgggctggatttgtttcagtaaaactacttgtagacaagacacagggcgaagagaaaagcaactgtaaactaactgtgaaacaaggaaacagaagagaggccagaaaaccgtttcctaaatctcggcttggcatctggtgctggaccacagccgctgccaaacagatgggggaagcaccctccctgagccccagagcctacacgtcgggccccagcggctctagccattgcctcctctttgcttgggtccccaagttcactgttaaccccagggccaggagccagccttggccccagacatttgttctccattgtcctgagcacaacgctgaaaagcggcgctgaataaggatgctgggacgcaaagagggcgcccggggtcatctggagccctggaggctaagctcggcagcctggcgccccgagtggcttcgagtccccgcgaccgccgccaggcccggccacctccttgccacctccctgcgtcccggggaacccacgcaggggggcgcgagggaggggctcggggacgggcggggcccgcacagccgggccaacccagcgggggtcggcaggagacaaggggcggcgagggcaggggggcggggagactcggggcatggcggggtggaggcgggaaagtgtcgaggccggggaatccgcgcgtggggaggtgggcatcgccagggcgacgatgagctttccttagggggcggcgcctgaagctggccgggacccggtggacccccacgactctcccggcccttgcccgcggctcccggggggcggggcggggcgccccgggcggggtctgtgcgcaggcgcgtgagtgcgcgctctcgcgcaccggcgggcggggacgccccgtgaggcgccgccggaggaagcgcgcgcgcacctcacttccggcgcgcgctgcgccggcggcgattggacccgaggcggcgagctggcgccccgcccagccaatcggcggcgccggcgcgggtcggagggcgccgggcgcgcgcggggcggccgggggcgcgcggggcgcgggcggggcgccgggcggggcggggcggagcggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggtacgcgccgcccgccgcgctttgttcccgccgggcacctgctgggggtgtcctggccgcggcctctgcgcgccccatccccggcccgggtcccccagcggagcccaggtcgccccccgcgcccccgcccgccggttcgacgcgtgcagccgccgcccccccgcagctccggcaagcgcggccccagccccccaggtcccgagcaccgggggccgcgctcagcttccgaggacccggtgctgctcagacccggcgggaccttggggctcccgggcggcgctcacctggctcgccgcaaccgcacctgcacacctgcctcaatgcggtgccggccggggtgacgagggtgcttcctctctcgggtaccacacgcttcctttcgcgttcggcgacactgtcagacctcggcctgggagcgacccccggcgcacggggcgcgcaggactcggttgtatcctccgtccagcgcgcggtggagatgccctgtcctgcggggcggggtcgtcctcgcgggtacctggttggcgctgtctctcatttagaggcgtcgccaagccagtactgctatttgcgcctcccagttgatcttgccattgcggaagactggctgttctgcacttggtaggggggcgcccggtcgcccagcggtaacgattggacagggtttaccctccggccatagcccagccttccttggacttgcagcttccctgagtctcctgctcagtttgaaacttttgtaatttcttcgtgacttggtagttcctgctcaggaagctcccaggctaaggaggagagagacacgctctccggaaaagttctggttctagaatagacagcaggcgagaagaggaggcggttgggggtagtgagagttctccctggggagatgggagggtgagcggaccttccaggcactggaagtggccagtatgcctggaggggaccccacgtggcattgagttgttccacccctagtcagctgcaggtgggcctctccgtgctttcctgtggctcccacagcctgcatctctgagcgtggtgttggagttgcagagccgctggacagtggggcttgccctcctggagcgcagggttgggacctcggggctttggttttgctgagtggacaggaaggatgcccacccggcacgactcttgcacctggcggggcctcccgaaggacccagtgtccatatgagacctaagggtcagcatttgcccaaggtctggggccgagcactgcagatgtgcctgcttgcctctcttctgggaagtctctggggcctcaaagccaaagccaggagcatctccccaggcctggctgcttctccattccaggtcttggcgattgccccaatgtcaggtcccacagccccacagcccttctcctgtctgcccctctgagtcactgcctcacccacagccccagaaccttcatgcgggctgttggcgctcccctgctccagcactgcagcacatagcctgcccttgctgaacctctgcagcagcttcctggggccctccgaatgagcagcaaagtctttaacccaagggaggtgggggcgtgtggcaggaggggccgggggccttatcagcccccctgtggagctgtgctctattctccaggggtctagaaagcccactctggtgtctgtggggagggtatgggtagggcgggtttcgagaagcctggttaggacaggcgggggtagatgggggcacctgggctgggtagcactaagtgctggggggggtcccgagctctggcctggacagggttgggaggaagggtaggcaggaggacaggatttgttctgttggtgtggagttaatgggcggaggagttaatgggcggaggggcgagtggcgcagctgaccaggtgggcagatgcagtttgttcgtaggacatgctcagcctcataatgagctcctgcccttacctgtcctggaacagggcccctcataggcgggcttgcccctagctttgctttgtgcttgtgccgcctgtccgtgcatcctcggacagtctgctacttagttttgctttgttcctcctgagttcttctgtactcctcacttttgcccagccatgaagcttctgggctgcgtgtgtgctgatgcctttcggcgtgttcactgctgcgtactattcactggcgtgacagtacctcggctttgcttctgtcaagggaccttggcttgtttccagttttttggttaattacaagccccgtgctgctgtggacatcgtgtgccagtcttctgcgtgtgtctttctggatgggcagggcctgtcttaagcatgtaccgccagctaccaggatttatggtgggggtgtgcacgcactcagcgttactgctgggcagttttccagagtggttgtgcctgctccggcccccactgacagggacgagagtccccactgctccacatttgtgccaacactcatttgacttaatttttgccagtctggtgggtgtgaagtggtatcgtggttttaacttgaatttctctgattactaatttaggccatttgtacttccttgtcagtgaaattcctgttcctttgccagtttttttttctctttttttctgcttgagtttcagcagtttctttagagatagtcatcctttctcggctgtgttgaggatgtccccgtccagttatgagcgagtctttgctctctgagcagcctctgggtgcactccccgtgtcagcctggtggagtgtgcacattgactgtttgccaggctggggtgctggtctcgtttcggttctccttctgggaggcagccggagaagtctgcccccgggagcttgaactgggcatgctgggctgttgttggggaggcctgtgctccgggtttccttgcgacgcttttggctcagcactgttacacacggtgctcctaggtggtccacggggtatgcgtcagtgcctgtctgtggcctctgcctcctgggttcccagagtgtcctcctggtgcccatgtccctgagcgcccccacctgctcttcagcaagggctgggctgctttgtaccttgcccttcccacttgattgttttttcggttgatgtttattaatttgtttttatttatgtattttgttgttgttgttgcagagacagggtctccctatgttgcccagactggtcttgaactcctgggctcaagtgatcctctcacctcggcctcccgaagtgctgagattacaggtatgagcccctgggcctggccatctgtttggtttttagagacagagcctcactttgtggcccagactggggtgcagtggcttgatcatggctcattgtaacccctaaaacctgggctcaagcagtcctcccacatcagcttcctgagcagctgggactacaggtgtacaccaccatgtctgtctaatttttttgttttgttttgtttttttgagacagagtctcactctgtcaccaggctggagtgcagtggtgcaatctcggctcactgcaacctccgcctccctgtttcgattttcctgcctcagcctcccaagtagctaggactacaggcgcctgccagcatgcccggctaatttttgtatttttattttatttatttatttatttatttttattttattttattttattttgagatggagtctcgctctgtcacccaggctggagtgcagtggtgctgtctcggctcactgcaagctccgcctcctgggttcacaccattctcctgcctcagcctcccgagtagctgggactacaggcgcccgccaccacgcccggctaattttttttatatttttagtagagatggggtttcaccgtgttagccaggatggtctcaattttctgacctcgtgatccgcccgcctcagcctcccaaagtgttgggattacaggcgtgagccaccacgccctgcctattttatttttttgagaagctctgtcgcccaggctggagtgcagtggcacgatctcagctcactacaacctccacttcccgggttcaagcaattctcctgcctcagcctcctgagtagttgggactacaggcgtgcaccaccacgcccagctaatttctgtatttttagtagagacagggtttcaccatgttggccaggatggtctcgatctcttgacctcgtgatccgcccgccttggcctctgaaagtgctgggattacaggcgtgagccaccacgcccagccagaattatctttttaagtttcacacaaagccacatttggtttataattggaagttctttaactctgtagagcaggttggggagaattgacgtttgtgtggtactgagtcttctcattcatgatcaagctatttacttaggtcttgaatgtattttgagagttttacaagattctgctgtcatgcatatcctttgttacatttattcctagatgcttgtattttagaagtcatagtaaaagtcagctttttattatgtttgttgctaacatatagaaattcagttgatttttcaaagaaatcagtgattttactatttttaacctagtaacttatctatagattattttgtattttcaaaatgtatgttttgtcttttgcaaaagacaaagttgtttcttttcaatcctcatacttttctttctttctcttgcctgactgtgccagttgtcatagtacagtgttgaatatggttggttgcgtggattacccgtgttctgtcttgaccttaaggaaggtttccagtgttttacctttaaggacgatgtttgctgcaactttttgtggatagcctttatgcacttaaaaagtctcatcctattcatgacttgcaaaggctttttaaagaaatcattatgagtggatgttgaatataatcaagtactttcattaagaggattatataatttttatcttttcattactattgtggtaaattacataaattgattttatttcttttcttttctttttgagacagagtctcgctctgttaccaggctggagtgcagtggcgtgatctcagctcactgcaacctctgcctcccaggttcaagcaattcccctgcctcagcctcccaagtagctgggactacaggtgtgcaccaccacgcccagcgaatttttgtatttttagtagagacggggtttcaccgtgttggccaggagggtctcgatctcctgaccttgttatccgtccacctcagcctcccaaagtgctgggattacaggcgtgagccaccatgcctggccgtaaattgattttctaacattaacctattcctggaaaaatactagtttaagcatgttgtattaccctttttaaaaattggtggatatatatttatttatgtatttattttttgagacagggtcttgctcttttgcctaggctggagtgcagtggtgtgaccatggctcaagcaatcctcctgcctcagcctcctgagtagctgagactacaggtgcatgccactggcctggctaattttaaattttttgtagagatggggtctcactatgttgctcaggctggtctccaactcctggcctcaagtgatcctctcaccttggcctctcaaagagctgggactccaggtgtgagcctccctacctgcccacattggtgggtttagatgatagtatcttgtttaggacttctgcatgtgtgtctggggtctatgtgcttcctttcttctgtagtccttagcagattttggcgctaagatttccttgtgaaatgaaatgagtactgcctcttttgctgtatcgtggtatagcttatgtaaaattggaatcatttcttccttgaatgtttgggataattcacttataaaataacctgactggccgggcctggtggttcacacctgtaatcccagcactttgggaggctgaggtgggtggattaccggaggttaggagttcgagaccagcctgggcaacgtagtgaaatcccatctctactaaacatacaaaaattagccaggcgtggtggcacgcacctgtaattccagctactcaggaggctgaagcaggagaatcacttgaacttgggaggcggaggttgcagtgagcccagatggcgccactgcaaaaacatttttttttgaacctgctttctgggtcagtgtgtcaattttaatgcacgttctgtttatacttaaaaggaatgtgtgtttggcagttgatggtgcagtgtttgtctattagatcaagcttggtttactgtggtcttcaagtccgttccctttttttgtctactagaaatgtatgttaaaatcttataatctgagaatagattggtccgggttttctaacagttctgtcagtttctgtttgatactttttttttttccagacaggatctcactctgtcacctaggctggagtgtagtgggacgatcacagctcactgtagccttgaactcccaggcttaatcgatcctcccacctcagcttcccgagtagctgggactacaggtgtgcaccaccacacctggctaaattttgtattttttgtagagactgggtttttccatgttgctcgggctgatcttgaattcttgggctcaagcagtctacctgcctcagcctcccaaagtgctgggattataggcatgaaccactaacgccccgtcacttaatatatttttgaggctatgttattaggtacatacatgtttagaattgtaattctaggtattttgaacttttctcattgtatgactgcttttatatctagtaatgctttttgtctttagtattgactttgatgcaagcattcttttggataatttttgcctgttagctatttttctatcctttttaaaaacctttgtatatccttacatattagatgtgtctttggttattcagcatgtatctagatttcattttcattcactctgaccttttctgacttttttttttttgagacagagtctcgctgtgtcgccaggctggagtacagtcgtgcaatcttggctcactgcaacctctcctcccgggttcaagcgattctcctgcctcagcctcccgagtagctgggactacaggcgcctgccaccacgcccagttaatttttgtatttttagtagagacggggtttcaccatgttggccaggctggtctcgaactctcgacctcgtgatccgcccgccttggcctcccaaagtgctgggattacaggctgagcctctgtgcccggcctttttttatttttattttttattttttgagacggagtctctctcttttgagatggagtcttgctctgttgcccagggtggaatgcagtggcgcaatcttggctcactgcaacctccacctcccaggtcaagtgattcttgtgcctcagcctcccgagtagctggaactacaggtgcgcgccaccgcacccggctcatttttttgtatttttagtagagacggggtttcaccatgttggccagactggtctcgaactcctgacctcaaatgatctgcccgcctcggcctcccaaagtgctgggattacaggcataagccaccacgcccagcctaccctgtacattttaatgtgcatagttaattgtatctttactctcctgctgaactatgcagggaccttagcccactttattctaatccaaccctttcatgtttatatttatatgattttgttactgtgtatcttaattgttttcttgtgaagcccacaagatgttgttactgctttatactgtgatatttgatgagcttcaaaactcaccacttcctttgttgctcattcttcttgcatgtcaggaatcattttccttcttctgttgaatatttgttcttaggatttcctttagtgaggatctgctgataactaccttctctttctgtttgtctgaagatgttttagtttaccctcaccctgagcagggcgtgtgctggttgtacgatgctggggtggtgtgtgctcctcccacaggtccaggcagggcgtccctggctttgacttccagctttgctgtaagaggtcagcggccgtgacaggctggagggagacgtctgggtggctttgtggtcatgtcatcgttgccaacggtcgtctcatggtgggtcctggtgtgggttctcttgtgattgcctgagtcggggttactagacttgctgactttgtggatcgatgattttcatgagtcccgggaagctctcagccactttttcttctgctgttggttctgcgctattctctctctcacctctggagcaacaattggacgtgttgctcttcctgccggatcctccacatccatagatgcactgggtggtgtcagtgggcggcggctggctggggcagtagcctgtctccagcccttccccctgcctctgtccacgtgcaggggcgtctcctcaggacgcatgttgcctactgaccgctgccagcctgcacgagactctcacggcgggaccctgtctgccttgctcggtgctgcccagagcctgcacagtgtagctccttggcggacgttcctgtaatggaaccaggatgtcatgccaaggagtgtggtttcattttgagtggtggggaagtcgctggactatttcaagtgtgtgtatttgggagagcagtgctgctggagtggtggaccacactggaggtggagattgcctcagggtgtgcaggtggagatgggtgggaggtgtcgtgcagggcttgggacagggctttcggaggtggtctgcagtgatccagggaagatgggctgctctgagggaggggctgaggaagctgacctgggcagccagtggcctgtaggctgggcagcactcgagctggggccaaggggcagcaggacggtgcccgtagccctggaggccttggggattcggaggacctggcccatcgccgtggcctgcacggtgcgtgcacaccgctctgtccgcgcaggctgtgccctgctttcaagatgcctggaaacctctggcagctctgtcctgctgtcaacactggagtcacatgtcagtgggtctcctgctggggactggcttttgtgcaggagatggagggcagggggctacagtgcccttggactaaaggatgctttccttggatctgggcactagaaccagccctttccctctctctgcccagcattctcagcatgcgtctcaggaaggtttgatggagtgggcagctgcggtgctgtggcggggtcggggggctgctgcagagagcgggtctgcggtcagtcacagtgacgggggtctctttggaccctgtgacttgtgtgtggtggtggcaggcagtggcgttgccgagacagggtgctcaggtgcaggtgggaaggggtggcaggatggaggttgtacagtgctttccccaggaccagggggcagggtgtggcgtgcttattcctgcctggccgtggagggtctctgtaggacaggctcccgctgagggcagccctgaggcctgtgagctgctggccccgcagggtggctgggcctggctggctcagcagctgctctgagaggcagccctaaaaatagccgagcgctgagaggccgtccctttctgctccgcaggcgcgcgccgatgtgtgctcagctcaggccgacttagcagggttgtgagagtgatgagagcgtggctgctggtcatggtgctggggtcgtcagcagctcctcgagggctccggcctgtggaggccggtggcgccccgtctcaccccacggatggggggcaggctctccaggagccccagggagcactggctactgctgggctgctctcaggcccgggacattcatggccgtagccccaggtcctctgcatggtcaggggccatgctgggtcccctggggtgcagatgccgctcaacagaggagtcaggacccaaaaggggcagaaatgggcaagggaagacactggggaaggggtgggtctgcccttcctgctgggggtgcacacgggcctggggctgagcaacccgctctgggcctggctgttccgctccactgccccaaccagcctttcctcagcaccccctggccaagctgtgggcaccccctgcccccggacacaggcagcacctggccaagtgcagagacactccagctggctcttcgcctgtgtcccagccctgagggcaccgtcgtagggtggtgggacgggggggggctcggacacagtggttgtggaggggtcagtgctgtggctcggggtggggtggggctgggggagggtttgcttcagggtagcggctctcttcaggggttcagcaaggagacagatgggttctaatgacccctgagtcctgagacaaggtggggtgagctggagcaggggaggggacttggaagggccttcagtccccatgcagcccttgcacaacctttcgggccaacatcctgggccttgcttggcagaggagtttgggatccacgggcttgaggcccaggtggtcagctcgctcggtgcaatgctgtgtctcgcatttctgtctctcgactgccccatccagcccgtgtcctaagagcagctggcagcagccgccacgcacaggcagctcagctcagcagccccaggagccaggtgtgtcttgagctgggcagcaaagtggccatgcagtccagcctcccttcagccttccccaggatgcctttcatcttggggagatggccattgtgggggtgaccagcactgtcccttccctggcaggccaggatgtggatccacagcgaggcagacctgcagatgcacatccctcttctcaaatgctgttcttgttctggtgagcacggggaacggcaccaagccaatgctgatgggaagggccctgaccttgggctgctgtcctgcgagcttggcccctctgctgggcccctcctccatgcctttgtttactctccaaccttctgggagtcccacatctgcatcaggacagaggtgaccagggaccagttgacagctaggatgccaccagcatcttttgtttaatttgagtctcatttcccagtgtaattctgtagctgaccttgcaggaggcattgacaatatttctttattgtatggccccagccaggacttccctctttttagatgcaaaataattgggcaagacttttcatgggcattgcatgctgggctcgtgcaggtgtctccagggccgcctcgagaccagcgcccgcctccctggtcctggatacaggtggggcgggggctcccccgcagcagtggagttgagacccgcacctgcttcctggtcctggacacgggtggggcgggggctccgcagcagcagtggagttgaggcttccgtatgagctcgctcctggtcagtttgagggtggacataccagacatcctgcatcttcccagtcgccccaggagcgcctcaggagggtgagtggcaggaggccgatgccctgctagcaggcagtccctcggggccaggccttcctggtgcggtgctgaattgggctgttcgttcctctgagcaccaaggagagggatggcggctcaggcttcaggcagtgcccgccggtgcctctagaaggtgctccgtggtggggcccgggagggtggcccttccacattctcgggctgcctgtgtgccacccaagtgtcaggtcatgaggcccctcggtctggcctagggctctccttcctcccccacctcaagcctggggtgtggcctagccagggaggggagcgggagctctggccgtgaagacccaccctgaggtctgggctctcctggcctgagcgtgctttctgctatgagctccacgttcaccctgcggccaggactctactgttcctcctggtgggagctgctgtggtgccctgggtggcctccagtcaccgccagcctgccccttgcagtcagtcctgctgttccttcggctcctgcagtttccagcttggccctggacttcctgtttttcccacctagctggacgtaaaggttgtcgcgccttggaaagttaagtcactacacccgaatcgacgcactcttggctcgcctggctatggcttcagctggaaacggagctgagcgtggcttatgtttataaatacagcacctatcaggtccagcgtcgctgtctcctgcgggaggtgtcagctttgggcgtgaagaacagctgcaaggccacagggccaaggggtatctcaccagctgggaggccggcgtgcctgacctggccacacagagcgagcctcagaagcgagggggaaggagggcaggccttggggaggggtccaggaaggtcgagaggctgcagtggtggtagcctgaggggatgtgcgcggccaggtcagtgcctgccgctactgcctgctgcgctgactgcctgagcactggggatcgtgggcctgaggggcggggaccttggctcccgtggatagctcctgcaccatcctcttgcttctcagaccctcggcaagtggtgacagggggctggggtggagttgttctcctgccgtggtcctgtcaaatggtgctgggggcggggccaggaatcacagcaggtgtctgccgctagcgctcggagcctgtgctgggggcagggtggtgcatctcatgcctctgccgcttgctcactgtacttgcctggggaggatgtggcaggggcagaggacagctggccaggctcttggactgcacctgactctggtgggctatcgaaggttttggaggtttctttaattagcaacatgatatccagagattgcgactgtggctcgagcggttccctgccagggagcaggaccattgacagccgagccttgactcaccggcccaggccacccgaggggccattgacaactgagccttggctcaccggcccaggccacccgatggaccattgacagccgagccttggctcaccggcccaggccacccgaggggccattgacaactgagccttggctcaccggcccaggccacccgaggggccattgacagccgagccttggctcaccggcccaggccacccgaggtttcactgcggattctatcagaacagtgcctccccccaggattcgtcaaccttcagtggaccaggccctgcagtggttccagttattccctgggaaaatttccagcactgattagggggtgactcttggtcagaggttgagtgtttccctaggtgtggaggtgcacggagaagagaggggtgcagttcttaaaggacacatggcttatgccacaccccctgccccaacccccggagtggccagctttcctttgactggggaggaggcagctgtccagggttgtcctcacctctcctcctggagaatgtggtcccttcagaaaggggacccagtagtgggtgacctggtgcaaaccacccactgcctcctctgggccttcctggggctcttcggctctcaggagaggagggagctcaggctgtggctgctctgtgagttggacacggacgctccagccgctgggcccagcagtgtgaatggccatagagaacaggggcccagaggctgctctcgaggacactggcagcagttgtgctctgggctcgccatccttgaagctggaatattccacaagtgccacgcacttgctggaggtactgcctgggggtagactgtggccaggccctcccagcagcccgagtcttggcgcgtgggctggactcccacactcagcacctttctgctgacctgaacacccagggcacagtggcagcggcgtcattaggatttccaactagctgtttctgttaagagtgaagaggaaaccttgtttgattagactcattgtaaaaaagattccagtgaatctcttgcctgctgtctttgcagttgcctctaagggtcacgaggcagggcggcgtcctctctcagtgccactgtgacctggcagcacctcttttgcatattattgacctagagagagaggtcaattgtaattcggagctgcacagtcggaaaatttgtagcaacagagaattataggcgctctaggcattcgatgaatcttctccaccttgctgtggggttaattcaggggagcagtggggagtgtgctgggagtgagattagagggaggactccctggaggctggccctgcgccctggaggccagcatggccctggtgctggctacatcctctggggctcttcctcatctgtctgcagaggaggcagctgtggagcgagggtgtgtacgggagcaggatgggctgcacagaagcctttccgggggtgcctgtggtttgcaggggcctggctgcagctgccctgtgtgatctctgtccccgtcttctcccggcttccttgggtcctgtgtgcccaacttggcacttcaagatttgctccctggcaactgttgcctttcccagaagagaagtccctggaaccaggaccagcctgctgtcacctgcctgctgctcctgccccaccagaaccatcctgagtccaaactggctgagagtcaagggggtgttcagggcctccaggagctctgggagagtctaggatgctctagatccttgggctcatggggcagtagagtggggggctgtggtcctgggcaccctctggagagaccgctctggtgtcagccaagtggcgggcaccttctgggcttgggggcggggcttctcacgatggctcagggaggtccagacagcccccttgtctaggtgcgcacctggagtcctttcctgcgtgacttgcaaacaggccttgcagggctctagtgtatcagctcccggactgcaggcagcagcaaactctgccgtgtggtactgcttctcatggacaggagaccaccaggctccttccaggagggtgaggtctctgcagcgggagcatccaggcctggaactcgagctgtggtgtggtggtgccagcccaggagccaagcacagccaggagatgaaacccatccctgtggtctgcacgtccatgccagggccgagcccccagctgggatgccctgggagggtgcagggtgggctctggatgcctgctgggggatttcagtgagaaccaggaagggttgagccagagcctccgagaagcctggggtccatgtgtgggaaggaacggggacagggagcctccgagaagcctggggtccgtgtgtgggaaggaacggggacagggagcctccgagaagcctggggtccgtgtgtgggacggaacggggacagggagcctccgagaagcctggggtccgtgtgtgggacggaacggggacagggagcctccgagaagcctggggtccgtgtgtgggacggaatggggacaggagcctccgagaagcctggggtccgtgtgtgggaaggaacggggacaggagcctccaagaagcctggggtccgtgtgtccgtaggaacgggggacaggaggttgtgaagggcgtgtgggttccgggaggctcactatagtgatgtcctgccttagacgaggtcacacaggggaaggttactgtgccgcagagttttctttccgagcactcaatgctcacctcctgggagggagtggggccgcagccagccctgacccagctgggtgtgtggccgctctctggacccccggtcccagggtggcagctagtgcagcctaggccacaccagcatgacccctcgcccctgtctccacggagcaccgtgggactctggcatcagaatcctggggccccacccaacacccacgcatttcctgtcttttctcaggcaatcgccatggtacccagggctggccttgtttcagcttcctgacgagtgccctgtggtcagtcatttctgtcctcgcctttacctcaaatcctgctttttgccttaagtgcgttcccaattccatctctgtgccagctgtgccccatgcagcctctaccggcatctcacgtgatgtcaaccttctgggtccttggggcctagccttgctctggtgaacggctttgttggatgctggggttggcattttttttttttttgagacagagtcatcctgttgcccaggctggagtgcagtggcacaatctcggctcactgcaaccttgcctccagggttcaggtgattctcctgcctcagcctcccgagtagctgggattacaggcatgcaccgtcacacccagctaatttttgtatttttagtagagacggggtttcaccgtgttggccaggctggtctcaaactcctgacctcaggtgatctgcctgcctcggcctcccaaagtgctgggattacaggcatgagccaccgtgcccagcctgggttggcttttaactggcaagtttagtctgtgtttctgtgcgatgatatagttgcatgtattcctgtcattttgatcattttgattgtgtttattacgtatttcctctcctaagttttgttatttcctcctcggaaattaaggaaggatcaagactgattgaatttatttgtatttttgagacaggttctcactctgttgctcaggctagagtgcagtggcatgatcatagctccctgcagcctcaaactctggggctcgagtcatcctcccatttcagcctcctaaagtgctgggattaacaggcacgaaccattgtgcctggcctgagttttatgtattacccactccaggaaatcactgtagtccttttaactgttactgatttgcttaaaatgtgaaaggcctgttgacatttaaggatagtcaacaaccctcccaccctccaaaggaaggagagctgaaatgcaggagaaacagcaatgcctttgatgagtatggctttgctgctactttgctcacctgtggccctgcctttcccaaggatagtttttgttttcctggagcacatccttcagaagctctttcagtctttcagtgcctgaagatggcgtttttgtccccctcatacttggtgatcacagagttcttctaggttgacagttttgtctcctcggtactttgacgattgttttattgtcttctggcctctgttgtggttttgaggagtctgcgatcagcctgctccttgttccttgtgggacacatgtgtgatctgtggttgcttttagcgtttttattttgatttggtgcggatttgttatcaacattgcttttgatcctccttgggacttactgaatatgagcatctctcttcttgttttggaagaatcctcagtcagacattgcatctccttccttgggtggaagctgctcagtcactgtcctgtgccttgccgtggggctgcctgtgcctctgtgcctgcttctccttccatggggagcccctcccagcccctcactggcgctgggaagcacagtggtcctcccctctgtgggctgtgttgagaaatgttgctggctagtcccagacccacaacacggagcacgggggttttgcctggtgcccgtgatatcagtggggagtgagaggagcaggtggccccctcggctgtgttcagggtgtgcctgtgtggccgaccacctccaggactgaggccacacaggaagcagttgggattgtgaaaacccccatgggaagctgtgctgatcctcccctgagcctgtgacagctgagggcacaggcaatggtggggctcggtgcctggggctgagttgggaaggtttggtgtctgacccacttcttcccaagtgggagctccctcctcgggcactgcatggcttctctgcggggcctctgcctggtcctctcgtgggcggtccaagacctggagcccaggaggtggattctgaggtctgagtcccccgcaggacagcagttccatcctctggtccctctcctgcccccaggggccagtaggttacagacaccttcctgaaactccctggaggggagcagccttgattcctaaacaagaagttggtcctaagtgcatcctcttgatgtggggcagagaagaaatctgagacagtctcatgcccccaccgccatcgtccccccacttttttgtgggggtgcccaatctgtgctctgccccctccccaggctccgctcctgtgggctgcgtcgtggtttctcctctctgtgggacgtgtgctgggcccctgggggtggatgcagaccgagcctgggcccatgtagaccaactggcgtgggtgtgagagagagagacgcatacccactcaggcacatacacgtgcacacacacacccatgcacgcgtgtgcacacacaccctggccctgttccctaccagtccccaccccctcctgctgcatgtgctcctggttccctctcttcacctgacagctggagtcatcctcctgcccacagccgtgccctgtgcagagcaggtgctggttctgccctcccctggcctgccccaggcggggacactacactgggaagctgccccgttgcaggcgttcccatggcgccactgctgtgttagctgcctgcagcacaggccggccagtcctggggtgctggacagaccctcctggaagccagtccctggccgtcctgtcctgctgggggcacagtgtctcggcagaaggttctggctgctccctggggtgctggcttgtgtcacctggctttgctgggtcccagtgacatgcagtctggggatgttcctgggacccgttgggcttgcggtggccacttgggaaagctgagcactgaaagtgccaaaacctgggacaccttcttgcaggcccactcttcagcctttgccccgtgggccattggggagggaggaggtgggaggttttggcaaagcagcccaaaggtccacacagacccagggctggcaaccggcccggcctgtcacccttctcactgagggtcacagcctgtggcccatggcagggctgcccaggacaggggcttggccccggaggcctgcagtgtgaggcgtggcccacaggccttcccagagggggttctgggagcctcccccagctgtcacacgcacctgcctgtgcctcacccgggctaaaatagcccctgcacagaaacgcccttgctgggcagggcccattcctgctgggagacacctgtcagggcccttcctgcctggggccatatggagtgtccagcctgggggtggtcgtggggtgtcgggggcctgggcctggatccacgatgccctgtctggtctagagcctggcctggcttccccttggcgtgactgcccacaggcagtggccgccgtctgctcagctgcatcctcctgcgttgggctcatctgtctgccttcccctgacacctcctcctgccagactccagggccaagggagtgggccccggctgcagaggcagtgccagctagctgagtgggtcaggccacagaccccacctgactccagggcagcgtggccaggagagcattggaaggagagagctgttcccaccttgaggctgacgcagaccagacctggctctgtcctgagcagcagaaagtatgtgcagggcttcaccctcttccctctgtctgtgtagagctccacctgaggcccagtgtgtgcgtagagtcccacctgaggcccagtgtctacgtagagctccacctgaggcccaatatgtgcgtagagctccacctgagggccagtgcctacgtagagctccacctgagggccagtatgtgcgtagagctccacctgaggcccagtgtctacatagagctccacctgagggtccagtgtgtgggtagagctccacctgagggccagtgtctgtgtagagctccacctgagggccagtgtgtgcttggtgcccacagctgagttagcccaggctcgtggtcatgctcacaggtgcacgtggccacacaagtcactgagcacagacccagatgggatgcagctcataacgtgcactgcgggggggagctgtggcatcttttcccagagcccctctggtctggcagcctcgggagtgtgtgcatggtatgggaggtgggaacagagctgggaggggctcccctccatggggtggggttcccctccagctgttggtgaggcacactgtacacctgcacacctgtgcctgggactgttgggctggacgtgtaggaacatggaatggcccctgggccttcgggtgactgagacagaagtacaggcccagcaggtctgaggacagggcctcctgatgactggacccagcctggacaatggccggcagctcccagccttgccacaggctgactggaatgcgtggtgtggtggagcccagcactgagggccggacgtgtgtttgcagcattgttctcacagccacctcggaggcttccctgctctggggcagatgccgttgctggagccgtggtgctcccagaggcaccctgggctcagctcagcccccataggccagtgcctggagtggctgtgacgctgtggccggcgcctggcgtggctgtgacgctgtggccggcgcctggcgtggctctgacgctgtggccggcgcctggcgtggctctgacgctgtggccggcgcctggcgtggctctgacgctgtggccggcgcctggcatggctgtgatgtgctgactccggcaccatcagttccttcccctattctggggcaggtggggaccacctcttcaccctccctcatgggcagggctggcctctgctgaggtggcccctcactgggcccaggcatggagacccagtggtcctagccctcggtgtagtctatccatgaggcacctggctgagcctgttcctctcactccacagcagcctccttggccctgaccactggccaacgaggacactgagaaggcaccctgaccttctgtcctcattagcagggagcagccatgtccagataaggctgtacatcagagaaagctgagtgaggctggcaagagctggcagccgccctcggccgcccgggcgagccttgggacgggctgggtggtaagtgctggtgatgcaggagcagagagccccgtggaactctctccatgaggacggcggtgccctggggcccagctacgaggatggctgtgcaggcacctggagcctggggatggcagggcgtgggctgagcatgtggagcaccagcctgtgacattcctctgcccaggggcagcagggcacggagcgtgtgtggccagctgccgccacaggcccccagctcccacgcgggcaggctcgcgaccgcaccaagggggcagctcctggagacaaaagctcctcagttttcccttccaacaaaacacagtcagcaggtttgggaccagctgcctggggtcttaaccatctgtgctctgtgcgcgcccccacccccttgcctgcctggaggaaagtggtggggttgacatgcgcctcgagggccagccgggcgctggtgcatttctcagaaatccgtgaagtgctcccttgtcctgctcgtgttctgtgctgtccttgggagtggcgcggccgcttgccagggctgcagagttggccacgcagcctctccaggaggccttgagccaagcacaggatgcagcccagcagtggtggcaccgtggagtggctgggcggaagagatcctggtccacgctgctgtctggagggcagggtcctcaggtgaccagagtccgtgcaggagcgagtgaggacagggctggggcaggcggcaggatgaggccgcccagagcaactcagtgagtgaatgagtgaaagcacgcacgccccatgctccagcggggccagagtgtgctgttgggtgagtctggccttccttcctggggttgtgggccctacttgtgggaggccactgtggggagggcgtccttgtagaagtgttaatcagagtgaaagccagtccctgtgcactgctgctgggaatgtagcatggtgcagctgttgcggggaacaggacggcagcccctcgggaaatgagacagagttaccgtcagagttactgtgtgagctagcagttgcacttctcagtagaacccgggagcactgacgcagggcctccaggggagatctccaccctgtgttcacagcagccttactcacggtgactgcgtgatggacgcagcctgtatccatcctcggacaaacaagtcagcaccatgtggccctccgcaccacccagcatcactgggccctcggtcagcaccgcgtggccctccacactgtggaatattacttagccctgaaaaggaaggaaatggacacaggctgcaacgtggatggaacttgagtatattgtgctgagtggaataagccagtcacaggaggacatgcactgtatgatcccatttgtgtcaggtccctagagtcattgcattcatagggacggaggtaggatggtgcagcctggtgatgccaggggccggggaaggtgggaatggggagttggggttgaatgggtagtttcagttgcgcaaggtgaagagagttctcgggatggatggcggtgagggctgcacaacagcatccacgcacgtagtgccactgacctgcacactgaaaaatggttcaaacggcaagttttacgttatatttaccacaataaaaaagagaaatagacatcgtcaagctgttctccaaaataaggctgtcaccgtttaccttcctaccagaaaaaaacagttaagtcccaaagccagggggagcaccagtgttaacctcctgggttggggctggctgagcccgtggctatgcctccctgggcttaggtggcaaccctgcgaggagcttgggcctctcgtcttttgggttcctgttcaaaatgggaagtggtctccaaaccccagggcccacctgagccccctgagatgggaacctctccagacctgcccctgagatcctgtcccacccctggacaagggcctctgtgcctctgaacaaaactggggggcctggtgcagagtcctagctcaggcttccagaagtcagtggtttgaaggggtgcccacccttgctccgttgggacatagggacgcaggtgcctgtctcagcccccacatgtgcacccccaggggcagcagcgtcccctccagtctctggtttgcatcatgcacaggagtgggtgggtgggagtttcagtctcccagagagcatactgttgggccatgctgtctctggcctcctcacccatggaggtcctgccccgcccccatctgaggctgggtggccgaggggtctgttctcagactggggcctggcgctggcccggtttcctggaggaggaagcgggggagtgacctgcggaggacttccagcctccccttccgcctgctgtgggctgcatggcgctggggctctgcccagccctggagagtgttggctgctctccttccagctgacatggaaatgccatgcagggcacgcacgtggggcactttctgctgagtcaggtttctctgaccttcctgaaatgtcacttgttctgtaactcacaaaaactggggtgctgggatatggtgccttccttctcccggaagtccctgccgaggggggcggtggtggggcattcccagggggtgtttgtcctttgctgtctttactttcccaccttgttccttgggcctcccctgacctattgaccctgccacagctcgctcaccccaggtccctgggggctgtgcaggattccgggtcctccagggccagtgtgatccttgctgggttctcagagtgaccctggagggaggtcccctgccgaccctcacctcccgttcccaggtcatctgccccagggccaggtgtccatccaccctgactgtgaccatgtgcctgtgacctgcgtgactgacccctgcccttgggtgcccaggcctagcagtgccccatgccactgggtccccaggcatctgccaggaaaggacagctctaaagtggccagggcagcaggggtcctgatgtctgttgaaggcccttggaattccctggcttcattgtgccatctccccgctcttctccctccctcctgcctcctgtcttcctactctctcccctccttccacccacccagctgctctcctctctgagcctggccccacaaccagaggtgctcactcctgccttcaactgactgcaggtatccaggcatctgggctgagggtgcctctgtggctttgttgaccaacccaggctgacttcagaggtgctcttcagcccctgctttgcaagttcctggggacccgtggctgtcactttggccccttgatgtttatggtggttcccgtagctaagtggatgctgccaaagatggaaagtgggggacgctattccactgccactcagagcgagaccaggtgcttcaaaaagactagcagggttgggtgtggtggctcatgcctgtaaccctagcactttgggaggtcaaggtggggggaccacctgaggtcaggagtttgagatcagcctggccaacatgagaaaagcccatctctactgaaaatacaaaaattagccgggtgtggtggtatgcacctgtagtcttagctacttgggaggctgaggcgaaagaatggcttgaacccgggggcagaggttgcagtgagctgagatcatgccattgcactccagcctgggcaacaagagcaaaactctgtctctataaaaaaaaaaaaaaaggaagaaaaagaaaagaccagcagggccaggtgtggtggctcatgcctgcaatcctagcactttgggaggctgaagggagaggatctcctgagcacaggggttcaaggctgcagtgagccgtgattgcaccactacactctagcctaggtgacagagcaagattctgtctctattaaaaaaaaaaaaaaaggaatggagatgacaaagaacaagtcttaattgaatattaacaaaagccagaagctgattggaaaagcttaataaagtagcaaacatgcctggctaatttttgtatttttagtagagaggagtttcaccatgttggccaggctggtttcaaactcctgacctcaggtgatcagccctcctcggcctcccgaagtcctgggattacaggcatgagccaccacatccggccaatttttgtattttttgtagagatggggtttcaccatgttgcccaggctggtcttgagctcctgggctcaggtgatccacctgccttggcctcccaaagggctgcgattccaagtgtgagccaccgcgtctggctaaggagtattttccttagcagatacaaatttatttaaattagctatgctagttaaaacaatatggaattggcagaagtataaacattgactaatggaatgtaccagcagaaacacatgcgatcgtaatgtgcttcagaaatggcctcattcatctgtggggaaaggatatacttctgggtaaatggtttggtgataactgaacattcatgtaggaaataaaatgcaatcacaacacacacaactccaaatggatggataatctcattgtgaaaaagaggaaggaacaaatgggggagtgggatggattaaagcagtggtccccaacctttttgccgccagggaccggttttgtggaagacagtttttccacagacggtgatgggaatggtttccagtgaaactgtcccacctccgatcatcagccatcagattctcataagcagcgtgcagcctggatccctcgcgtgcacagttacaatagggttcttccggagctcaggtgggaatgctcactccctggtgctcatctcctgctgtgcggccagttgctaacaggccaggaacctgtcctgggggttggggacctctggtctacagcacaggtgacttttctgtaccagagctaggaatgaagggctggctgagctggtgcttcctgccacctgtgtagtggtgcaggtgtccatggtccagggctggccaggggcatctcctgtcctggcttggcttctgcccctgggtccgtggtggctgcctgggacctgcccttgcagccagggtgaaaggagtgggcagggcctgctgcctctgctcagggcccctagtggggctgcttgctcagcacccttgccccgtctctggccacgtagccgtcacccagctagcatggggaggctcgctaccaaggggtggggggctggagaacggagcttggagacagctggcagtctcggccacacatagagacacccgctcctgagacctgcagtgcctgcagaggggaagaaacggggctggcggggagagcacacagtgcgtttctgtggtcaggcccctttatttcttcaaatagatcccaagtgtagagaacatgtgctcattcttgttggcaggcctgtgggtttttgtgtctcactctgaacttttcctgtatgcctctcgcttctctctgtcagaaaacaaaacagaagcctctattctctgggattcggattcaagtcggctcttttattcacctatttcgagcagacacaatgaaagaggaaacagataacactgtgggtattcagcaagttgtcttggatgtgaacattgagtttccacttgtcactgtgattttattttatattgagttgtttttaaaatatgctttgcttcactttcgttgctgttgaatctattacagctgcacggtgtcctgaacacagtggcaggctggtgatgaatcgtcttctgtaggttttctggtgtctttgttatgattctctcagggccaagtgtggtgcacctggcctgggcaaacctttaggcctcgctctcagaaccaactgtggataataagcaaataacatgttttgtttatctgcgcagtttctgaatgcaaatgattctttttattccttattttatttatttatgttttagagacagagtcttgccgtgttgcccaggctggagctttttattcttcgtgtttgcacagtggctgtagctatgtgtagtgacagcagagacaggcctgagaggggcagccacgttccccctgggcaggatctgtctgctacgggaccgcaagctgcgactttttccttctaagtgtgcggagaggagcccctgcctagggacggggagccgtagcctgctgtttttgtgacaagcatcttgggcgagggggcactgggctgtgctgcatagatggtgagcactggactcacccccagccccaagtcaaacgaatgtaaggaacgtgagcttctggaaacgagcgtggaagcctgagtggtgaggaagggaaatcttgcagtacctgcacactccccaaatgcctcttgtgggtttgcagtacctgcgcactccccaaatgcctcttgtggatttgtttgtttgtttgtttacaattagttcatccacagcaggatccaagctgctgcctgtgtgtgtgtgtgtgtgtgtgtgtgtgtgtgtgtgtgtgtctatgtgtgagagagagagagacagggtcctctgtcacccaggctgagtgtagtggtgcaatcacagctgactgcagcctccaactcctgggctcaggtgatcctcccacctcagcctcccaagtagctgggactgcaggtgcgccccaccaagcccagctaatttttgtatttttttgtagagacagggtttcgccatgttggccaggctggtctcgaactcctggcctcaagtgatccacccgcctcggcctcccacagtgctgggattacaggcatgattgtgcccagccacagtagagcttcttgtttgcagttggttggtgtgtgtcttgtggctgtctttaataaaacaaaaactttgcaagtatcgtctggtaggccaggcgcagtggctcacgcctgtaatcctagcacttcaggaggccgaggtgggcgggtcacttgaggtcaggagttcaaaaccagcctggccgatatggtgaaaccccatctctagtaaaaatataaaaaattagctgggtgtggtggtgcacgcctgtagtcccagctactcaggaggctgaggcaggtgaattgcttgaacccgggaggcggaggttgcagtgagccaagatcgcaccactgcactccagcctgggtgacagcaggactctgtcttaaaaaaaaaaaaaaaaaaagacagtattgttatggtaaaggttcacccctcacaccttttttcgtatgcagctctgagcttaacatccaccatacaaccaggcacagaacactgggcagtccacccaaaacagtccccagcagccaccctccctactgacctggccttgtgcccccagctctgccttttccagagtgccatagagatggacaaaaatggtgtgtgccctcttgacacgggcgtctctcactcaacacgatgccttccagatccatcctatcacgtatcgatctgttcctagctgttgctgaatagtaccaaaatgtccttgtctttgtgtgaaggacatcggggtttccagtgggtggcagttatgaatagagctgctgtgaatgtgcattagggatctgtgtagggacatatgctttcatttcccttggaccaattccaaggggtaggattgctgggtcctgtatgtttaactttgtaagaaactgccaaactgctttccagtgactctgccatgtggcgttctgcacgttcagagtatatggaagtcccagtggttttgcttcctcgccagcatttggtattagctttttttatttttcatgttttttaagccattctaataggtgtagttggtatctcgtttggttttaatttgcatttccctaataactaataattttgagcatcttttcatgtgcttatttgctatcaatgtatcttttctggtgaaacgtctgttcaaatattttgctcacttttttttttttttgagatggagtcttgctctgtcacccaggctagagtgcagtggcgcgacctcagctcactgcaacctttacctccctggttcaagcaattcccctgcctcagccttccgagtagctgggactacaggcttttctcactttttattaggttgtttgttttcatattgttgagttctgagagttcatatatttatatattctggataaaatttttgtcgaatgtgtgatctgtggccaggtgtggtggctcatgcctataatcccagcactttgggaggctgaggtgggcagatcactcgaggccaggagtttgagaccaggcctggcctacatgtagctgggactacagatgtgtgctgccgtacttggctaatttttatactttttgtagagacagggtctccctgtgtacccaggctggtctcaaactcctgggctcaagtgatccacccacctcagcttcccgaagtgttgggattacaggcatgagccacccttccctgcctcaacttttaatatatggttgaatttgcctggaagtttttttttgttttgttttgtttttggaagatttaattaattaattgatttatttttgagacagagtctcactctgtcccccaggctggcgtgcagtgatacgatctcggctcactacaacctctgcctccccagttcaagtgattctcccacacccggcccagaaaatttaacaattaattcaatttatttaatagttgtaggactataccagctatctatttcatcgtggggagttttagtagtttgtggctttctagggaaatgaaaattggtacattttatcaaagtagtcaaatttttgttcatgaagttgtttatagtatttcccagtagtctgtaaggtctgtagtgctttccttcttttacttctgataatggcaacttttgtctactttcttctttgtttgggtagaggttttatgaattttattgatcttcccaaagaactagcatttggttttattttattgtttatctattttcagtttagttgttcctctttatcattataatttccttccttttgcttacttggggtttaatatgttcttctagtttcttaagatggaaccttagggctgggcgcagtggcccagtaatcccagcactttgggaggccgaggtgggtggatcacctgaggtcaggagttcgagaccagcctggccaacatggtgaaatcgtgtctccaccaaaaatataaaaaattagctgggcgtggtagtgcacacctgtaatcccagctgcttgggaggctgaggcatgagaatcgtttgaacccaggaggtggaggttgcagtgagccgagatcacaccactgcactccagcctgggcaacacagtgtgactccatctcaaaaaagatggaatctggctgggcgcagtggctcaacgcctgtaatcccagcactttgggaggccaaggcaggcggatcacgaggtcgggagattgagaccatcctgcctaacacggtgaaaccccgtctccactaaaaatacaaaaaattagctgggtgtgatgtcgggcgcctgtagtcccagctactcgggaggctgaggcaggacaatagcgtgaacccaggaggcggagcttgcagtgagctgagatcacgccaccgcactccagcctgggcaacagagcgagactccgtcttgagaaaaaaaaaaatggaatctttagattgtgtatttgaatcttttttcttttctgacataagcacttaatgctataaattctcatttcagaacggctttagctgcacctggcagattgacgtgctgcgttttcatttacattccattcagagtgttctctgatttcctttgagacttcctttgatccataggtttttgttttttagtttcccaagcatcccaagaggatttccccgccatctttctgtgatagattgctagtctaacgccattttggtcagagaacgtattctttgtatgatatcagctcttttgtatttgtgaaggatttgtggtgtgacccagcctatggtctatcttggttcatatcacctctcttagtctctctcctctgtctttcttcctcttgcattgtgttgagtaagagagagtctgtgggaatccgggcagccccagtggagtggggtggaaccaggacgagggtccctgctggaggagcgccccctcaggccaggcccttccgcgtttctgccaagtcctaggagactctgacttaatgcctgacttattttgtgatatactgagttatgagaatgactttaaagctcacaggtggcctcagagtgcaccttgtgctcacaaacactgacgggcgacagtggacagtctgactgcagctcggggaatgagttgaaggactctgacagagatgtctgtagtaggcaggcttgtcacactcattgtttaagctccatgcctgtttacctaaaaagctggacttaaatacatcgaacttggaactcagaaaaataaaacatcttctgacctgggtaggtccgtcttccagtgttggaaagcagactcatttccgggttagtcctgtgctgctttttgacctacactgacccgatcttgtttggaacaggccgccctgtgcatgatttggtcccatgcagaatcacacagcccggttggtgactttgatggctgtcaggcactgctcgcgtctgcagccctgtctgcagagagcaccccgtggccctgcatgcacggctcccccacccccgcccacacaacatcccccccaccgcctgcacggctcccccacccacacccgcacaacttcccccccaccccctgcacagttcccccactcccacgcgcacgacttccccccctaccccctgcacggctcccccacccccacccgcacggcatcacccccaccgcctgcacggctcccccacccccacccgcacggcatcacccccaccgcctgcacggctcccccacccccacccgcacaacttcccccccaccccctgcacggctcccccacccccacccccacgcgcatgactttccccccaccccctgcacggctcccccactcccacgcgcatgacttcccccccaccccctgcacggctcccccactcccacgcgcatgacttcccccccaccccctgcacggctcccccacccccacccccacccgcacggcatcaccccctaccccctgcacggctcccccacccccacctgcacagcatccccccaccactgcatggctcccccacctctgcccacacagcttccctacccccgcctgcacggctcccccactgcctgttgtccgctgtccccgttgcacctcccacctgctgccctgctgtcaagtcaggcgcgtcccacccagagtgctctggtgtctgccccttggcttctctcagcagctcagtggagtgtagacagtgtagtagatcatcacctgagcagccaggatgggagtggggtctctgtggtctccattttacaaatgggttgacaggtgctcaggaagccctgtgatgtcctgaggccgcccaggcagtcatacacaggctgtacccatccagtgctcccgttgcctgggggcagggatgtgtgctggaagggcctgggactgccttcccaccgccatgtccacacccaatgcccaggggtggagacggaagcacgtggcggccactgtggcactggtgggtggctgcgttccatggcctgactgtgtctggcgcctgttctggtgttttacattcatactttgagggccaagcaccagcccaggaggtgggtgccacaagtccagacttccccaagggaaagtgtccccagcacagactcagccactcagaacttgttggtcttagagcctgaagccgggcagggcagacagtgccatccctatctggatggtggtgccttcacccttctgctgtcctgagcaagaagaaaaatgagccaagcttcaaagagagctgtgccaaagtttccggaaagcttgccagtgtgggtgttgcaccccacacaccttcaggcatgggtgggtggtgtgggcatcttcactggatggatttggagccctggcgcgtgtacggcagatgccccggggagatggcatgttcacacggggcagcactaggcagagtggagggtagggtctacacccctccactcctcagcaacagagccctggacactgggtgtgtccttcagactgtccctggcgtctccagcactcctgtggcctcaggacggaatgatggaggtgaaatgaacagaaggaaggttgggggaaagcgtatcccagctatgggcagggggtcctggggtgggcaggatttggggcggctgggcctggggctggatagggccgcgggagaggggaggcctgtgctctcacagctgggagctggctcaggactctcagatcttctctttgtggcctgtcatccctcctacctgcctgtccacaggcccacactgagtgagttccatgggagggaggctcaccctcaggggccttcaggagatgggacctctggcccggcagccaacggatgctgaggggtgcccaccatgtgcagggacagctggggtgatgtcttggagccctgtgaggtcctggggccgcccaggcagtcacaccccgccctgcaccccagggtgcaggctcccggggtgacacagtgctgggacggcacagggccgcgtcctgaggagagggcggagccccgaggctgagctgtgccttgcctcacaggttgtgcagcctgactctgaagaagctggtggtcttcaaggagctggagaaggagctgatctccgtggtgatcgctgtcaagatgcaggtgaggccgcttgtgaccccggctgtggctgggtgctgtgtaggctttccatgtgcctgggagacgagtcaggcggtgcgctactgtggggccttgtgccaaaacagcgggcagcccatgccatctccgggagcccggggggctgggaatgacaggatgctcctgggtccagtcctgtcccgcacaagggaggcaggcccggccttctgggatgtggaggtcacatgcatggggccttcccagggcagagctgccctcgagtcacctcacagtgatggacgggccccaagcacctggagccagggcttccctgctgcactcagcacccacttcctgcccactttttgtggggtggagggcgtcggtgggagaggggagcagggcactctgggaggcgagggcctagccagaactcccagcccctggtgccagggcctctctcctgaccctagtgggtcctgtgacctctcgaaggctttgaacaagtagcggttccagaggggtcatgctggtgtcttccccatgcctggcccaggccccgccccctccttggggtagagctgccatgacccttgcagcatggcctttgcccagtggcccagacagggaggtgtccccgccaactgtcagggccacccctgccctttcagggtcatacggttccaggtgtgtggcctgtatagggccaccgccagcgggctctccctagccggcaccactcatgggcaagtctcacccatgtcctcagcatacaggagtgtccttctgtgtggccgtccagcgtgacagggtggggtctcagtggctgttgtgctcctgaccccagcccatcagctcctcgaggatggggccctgcccttggagcccatgtccaaggccccacacaggtccctgcagctggccggattcttgacacctgctgtggctctgacacggggtctccgggtctccccgacctgcagagtagcacctgagcctcggccagtgtggctgaggtcaccagccaagcactgggtcttgagtgcgaggaggcctgaggcttgttgtctgtcccagtcaattgccactatgtgaaacctactgcatcttaaataaacgtctggagaaacccttttcctcgctgaacatgctcgtggattagcagcagcctacatctgcggcgtgtgctggtggccaggttccccgggtggtggggccttgccccaggaacttccaggagcgtgtggctaatagcaggaccccaagaacttccaggagtgcgtggctaatgcaggacccggagaacttccaggagagcgtggctaatagcaggaccccgagaacttccaggagagcgtggctaatgcaggaccccgagaacttccaggagagcgtggctaatagcaggaccccgagaacttccgggagcgcgtggctaatagcaggaccccgagaacttccgggagcgcgtggctaatagcaggaccccaagaacttccaggagtgcgtggctgatagcaggatggaagcgtctctccgcctgtcctgcccatgggtgtggccatgcccagggtgcccagtacctgctgcagtctggctgcgggtcgtccctggggaacagggagctctctgtgggccattgccaccaggccgtgaggctgtgtctggacctcttggcttggggggcaggggtcagggtctcattgggtcttcagagcaatgcagaaaggcatgaaggcaagagtcgacccctcactgacttctgagtctggtgctgttgacctctaacctctggcatggggccccaccccacactgaccctgttccttggccccattccttcctctgcctgtctctggtcctgccccagcctgtgtcttgaccgagagcttggccccagggcccctcagagccccacctctccagcccctctgtgtagcgcatggactggctgcccatgccctccctgcccaccccagctcagcagccacgtggcccttggcctcccttgatcaccccagctcctcatctgcttctcttggggtgtcctctccgcccaggccccctgtgggggaagcagccagcctggccccgcagccccacctgcccctcagccttctctggcgtgcaccttcgcctcactggctggtggcacacactgtccttttcccgacacagctgggtccctgcaggtcctctgaggggggaatgctaagagggacccgacgcagagcacatttgcagggaaacatctctgaagggtcaaggggaggagcagggagagtccagaccacaacgcaggggcagctggggagaggagaggggacaggagggctggccgaggagagccgcgctgcctcttgccacgctgcacgtgaggccccagcacaaggggaggaccagagtccgccatggacgtctcatggagcccgagtacggccatgcgggccgcccgcacctgtcctgaggccccgctgctcccacccgaacctgggctggccccgggctcccgttgtctgtcctggacccccgcccgccctccagccacctggcacctctcatccactgtgtcccgcgcgccggcctccgggaaccttgtgcctgggaccccgcagcggctgcttgtttctcggggcacgaggtccccaagctcatccttgttgggatggtcccatttaaaacagcactgcgataagcacgttcaatccattaggaatctattttgatataaagtttgcggttggggtcctgttgtctttcacgcaaatgactcgttatccatttagcaggtgcgtgtgatgtctcctgctggcctgaagctcactgggtatgaactgtgttttcaggtgctcatgcatttcctgcacctacatctaggcttctactaccctcatttttgtgacagcatctccgtattttaagtattgtatctctgtatgttttactttctgagaggaccagtcaggcctgatcattcttctttttagaaaatgctttaggccaggtgcagtggctcatgcctaatcccagcactgtgggaggccgaggagggtggattgcttgaactcaggagttggagaccagtctgggcaacatgactaatccttgtctcttaacaaaatacaaaaattattgtatatttttttgtggtggtacatgcctgtagtcccaggtgctagggaggctgaggctggaggattgcctgagcctaggaggtcaaggctgtagtgagttgagatcgagccactgccccacagcctgggtgacagagaccctgtctcaaaaaataaaaacaaaaaataaaaaaatgctttaagccaagcatggaggcacatgcctgtaaggctgagctacttaggaggctgaggcaggaggattgcttgagcccgggagctcaagtccagcctgagcaacacagcgagacctgtctctcaaaaccaaaaccagaagaggcttggtgcctccagatttgttctgccagacagacttgggcagcgcagtcaggtgctgctgcacctggccgtggaatctgttttgtgatcgcgttaacttcagcaggagccgctcctggtttctctctcatgtcttagggcagattcctggaggtggaacctgtgggccgaagggtctccatgtttttaaggttcttgggaaagatgccagggcacctctgagaattaccccagcctgtgcctaccacccccagactgcagggctgcaatcctgccagttttagagtgcaggagtcacggtgtctttgcctggtttcctgctgatatgcagtcctttgagctagaacaggtcttgcttaatcacagggctccaaacgaatcctgcggtcccatgagattgtgctgccccccagtggacaagtggagacagacctggccctgaccttctccttgcaggtgagtctttcaccagtggtgacgacaccctcatcactgtcccctggggagacgggcccccctcatcactgtcccctggggagacgggcccccctcatcactgtcccctggggtgatgggcccccctcatcagtgtcccctggggagacgggcacgcctcatcaccgtcccctggggagacgggcacccctcatcaccgtcccctggggcgacgggccccgtcatccctgtcccctggggtgacgggcccccccatcactatcccctggggtgacgggcacccccatcactgtaccctggggagacaggccctccccatcactgttccctggggagacgggcccccccatcactgtcccctggggagacgggcccccccatcagtgtcccctggggagacgggcacgcctcatcactgtcccctggggtgacgggccccctcatcactgtcccctggggagatgggcccccctcatcagtgtcccctggggagacgggcacccctcatcactgtcccctggggtgacgggccccctcatcactgtcccctggggagacgggcacccccatcactgtcccctggggagacgggcacccccatcactgtcccctggggtgacaggccccccccatcactgtcccctggggtgacgggcaccccctcatcactgtcccctggggagacgggcacccccatcactgtcccctggggtgacgggcccccccaatcactgtcccctggggtgatgggcaccccctcatcactgtcccctggggagacgggcacccccatcgctgtcccctggggtgacgggcccccccatcactgtcccctggggtgatgggccccctcgtcactgtcccctggggagacgggcgccctcatcactgtcccctggggtgatggccccccctcatcactgtcccctggggtgacggccccccctcatcactgtcccctggggtgatgggccccctcatcactgtcccctggggtgagagcatttgtctcatcattgccatcagtgtcctgcgttactgcagatcttctgttgattatggtttattcttaaatgattagaagatttgtatttgtttattaggttgagtttttctttgttttttctttgttttttgtttgtttgtttgtttttgagatggagtctctccttgtcacccaggctggtgcagtcttggctcactgcaacctccacctcccgagttcaagcgattctcctgcttcagcctcccgagcagctgggattacaggcatgtgccaccacgcccggctatttttcgtatctttagttgagacggggtttcaccatgtcggccaggctggtctcgaactcctgactgcatgatctgcctgcctcggcctctcaaagtgctgggattacaggcgtgggacaccatgcccagcctagtttttcattccttatctatgataaagagaatataaggccgggtgtggtggctcatgcctgtaatcccagcacttcgggaggccgaggtaggtggcaggagaatcgcttgaacccgggaggtggaggttggttgcagtgagctgagatcatgccatagcactccagcctgggggacagagtgagactccatctcaaaaaaaagagagaatataataacgagggcaaaaaaacacttactgagtcaaggctattttgctcttctatttaaaaagataggggaaactcagagttcacaagcaatcccagctcttcgggaggctgaggcaggaggattgcttgaacccaggaggtggaggtgacagtgagcccggctaatttttgtatttttgtagagatggggttttgccatgttggctagggtggtctcgaactccctacctcaggtgatccgcccagcttggcctcccaaagtgccgggattacaggtgtgagccaccgcgcctggcccaatgctccatggttcagtgggttttgataggcatgctcaggcatgtcagcaccaccgcagttagggtggtgaacagccccattttcccctaagtatttaaactgatttttatttgtgaactctgagtgtctaagagatacctgtgaacatcagcttgctggagccctgctggacagggagcctgtggtgagacgtgcaggcgagttgggtgaacagggggcctcggagggagagccctccccgccctgtgtgcccctcgcggaaaagcgtcctgggtcccaccttgctgattgcctcaggcacatgagccgccacactgtttccgagtgtccacaggcgcgctcggccatcccggacactgcagcacatagtccttgtccacctgccatggctgttagcgtggcgcggagccctcagggcctgagctctggcgactggctcactcttgattgtgttgggtaaaggatgggctctggggaccggcatgccactgggatgaacttgggggcccgtctgtgggtgcccttccgatctcatgggcagcaggttggcctggtcgcaggctgcagggtggctgggccgtcagaggccgtgatgctgcctggggccccggtgcaccctcagctgccactcgcacttgtgcccacagtatcctcacttcttgaagagggaaggcaacaagcttcagatcatgctgcagcgcagaaagcgctacaagaacagaaccatcctgggctacaagacgctggccgcgggctccatcagcatggctgaggtgagtgctccgtctggcgtggcctgcgtcgggctggccacctgggtgccagagcattcgcccgtgggagatggagatgtctctcccgggtccagatgtccagggatcaggtgaaaatgatgagaggagcctgggcggccgggctccgccataagggccaggtgcggccccaggtggtgcttcctctctgaccttcccttgccgcctagcatggctccccgcatgcctgcagccgcgcgcactcccctctaacgagcctgtcctgcccttcagtggaggctgggttttgggtcaggctgctctggagtccttcccatggaggaatcgctgctgtccccacaccacgggtgcgtcctgtgatgggttcgtgtctgcatcctgctcagcacgtgctctggcccaggattggctgagcaggagcaggacaggtgtcagttctgtgaaggggctagcgacaatacccgagcagggcgggggcagcacccagaggtcagaggggtggctggagttccctggaggggaaagaaggggaagtacctcaaaaggaaaagaaacagccaagcagcagcccaccttgctccagagaacccagcgttccaaggaggctgcagtagggcgtgggggcctgggagaagacaccccaggctgaggcctcggactttctcatggaccctttcggggctgcaagattggctctgggagaaggggcagcccagggccccagaccagtttgtctcttttgcttcagaactttccccatcgtggggttgtgttcaggggtccaggggctgcgggcgtgagtggtgcttggggcatgtgaagctgggttgctgcctgcctggggcctgggaaggtcagccagcgcagcccctcattgggagccggagatgccagagccccccagcccctcttcttcccactttgtccccctgctcctggggcttggggctgggacagtgggggtgcccacttgtagctggttcccccacacccccaggcccagcctgcaggcctcctgtctcccaggtcaagcgctaggtcccccagatcctcacacacccccacttacgcatccaggacaagtgccaagtactactctgggctcagccctccctgctaccccaggagatgggagcgtggagggtacaggaagcagcagtggcgtcccgaggcctcgcttctccgtgccgccgcagggcctcagacaagctttgcagtcttcccgattccttcggcaaaccacggacagcacgggtggaccgggcctccaggctgcacttcccagggccctgggacccctctggtggcctggagctgcccatcatcccagcctccctcctgcaggctgagcgatgggtgaacaggtagctcagggatgctctctgggctgtgagagcctcctgggagccaccgcttgcttcctgtggagcaggagggtccaggcactgtggggaggtcatgcaggctctgtttcccattagccatgcaggcgaggtcctgctgatccctgccggtccctgtgtttcccattagccatgcaggcgaggtcctgctgatccctgccggtccctgtgtttcccattagccatgcaggcgaggtcctgctgatccctgccggtccctgtgtttcccattagccatgcaggcgatgtcctgctgatccctgccggtccctgtgtttcccattagccattcaggcgatgtcctgctgatccctgctggtccctgtgtttcccattagccatgcaggcgatgtcctgctgatccctgccggtccctgtgtttcccattagccatgcaggcgatgtcctgctgatccctgctggtccctgtgtagccatgcaggtgatgtcctgctgatccctgccggtccctgtgagctcctgccccaggctgctccgcccacatctctcagtctgcaccccagtgccccaggcggctcctcccagcccctctcagcactggtgcttctgtgtttgacgtccttgccctgaatgctggcctctgctcccaggcccctccctcacctgtcctcccagccttgggctgtcccctcctgatccccggggagaggctggagcaaccttcccccaccccaggtcacaccagccacatcgtctgctgcttgaaatcccatcatctgttcttcactcttggcagaaaagccccacccctggatgtagttccagtgccctgcccctgagcctgtggcccccaccccaaggctccctcgccctgcacctgtggcttccaaagccgaggtcatctgactgctcctcgctctcccctccagcatctcctccaggccctcggggcatccttccaccttccactggcagcctggtcccagaacctagttgggtcctcccatgtgtccccgagcaccagggcggttcatgggctccctgtgtcctgccaccttttggggctggttcccacctgtgagcgttgctggcttgttgagagtatgagcacgggagattgcggaggcgggacagccccgagggcacagacggacacaggtggcagaggtggggggctctcaccagctgggctcaggcagctgtgccatgggggcttgctggctccgagactgcacgcctgagacgggggtgagggcatgggtgctgccatagggactgtcgtgagagtggggtgtcggtgaggctggcgccatgcatttgagagtagtgctcggcggtggggaagggtccttgagggcacagggtggggtgaggcgggctgttgggcggactcgaggccagggctgagagtgtggtgggagaggatgtggggggcacctgcccaggacctccaggctgtggggagaccaggaggcgatggctgtggggacacaggtgtcatctcccttcaaatgggtgcacacgcagggggcaggaggggctgggagcagcctgggcccctgccacaccatagctctgccctcacctggcactcattctgtgtgagctgaggcccagagccctggacttactctgaggctgaggaagtggagtccaaggtggcccagggtaggggccgggcctcatgggtgccaggagctggacgccggcgtggggtggcttaggtctgcaggctgaccagcagttctggctgggaccatcaggagtgaccgcagccccagggcctgctgggcacgcgcctctgcctgccacttctcaggaagcttgagctgactgcaggtggtccctctcagaggcagctccgcagaggcaggtgtgcggtgggggcagacgtggggccttctcctgtggtgtggctctcagaactcaccccagcacccgtagagggagtgtgtaggggtgggcgttcgtgtggccagaccaccctggggctgcagcctgggagacgcaggcatgccagctggtggccattgtctgaggctggggcctgtgggctccccgacaagacaggaaggttgacagacccatgaccaggcgaaggggtgacctgggagtgcggtggtggctgagggagcagccatgcttctttgcacagccggactcctcttgtggcctcgccacaagctgcacatgccactggggccaggtccagcccaaggggacctgtgaggggcgggcggctcatggtgggacacaggaagacctcagggtaaggacagcgcgggagcgtcaccctgaccgtttgcatgctggattccctttagtttctctctatgagtgtctgcacagccacaggctgctgatgacagcccagtcaggtgtgggctgcatatcaatgggtggccccgtgagaatatgatggcactggacacttcctatctcctgatgacatggtagccatcgtaacaccatagcacagttactttattcctgtgtgaactcagtgtggcccaggtgtccagggcctggtcacacacacgtccatccctacacggcggtgcatggcgacctcccaggccttcgcatccacacacacgtccacccctacgcggcggtgcgtggtgacctcccaggccttcgcattactcactcacccaccagcttgtccagagccacctccagccccgcaggctctgccatcgtcagtgccctattcacaggcaccacttaatgtcttttatactttatttttactgtgcttttttttttttgctttttatttttaaatttttttcgtgatgtggtttcacttttatagtgcagtggcgcgatctcagttcactgcaacctccacctcccgggttcaagtgattctccttcctccgcctcccgagtggttgggattacaggtgctcatcaccacacccaactaatttttttatttttagtggagacagggtttcaccctgttgtccaggctggtcttgaactcctgacctcaagtgatctgtctatctgggcctcccaaagtgttggtatttctttcttttttttttttttttttttttgagacagaatctcgctctgtcgcccaggctggagtgcagtgccgcaatctcagctcactgcaacctccacctcccaggttcacgccattctcctgcctcagcctcccgagtagctgggactacaggcgcccgccactacgcctggctaattttctgtatttttagtagagacggggtttcaccgtgttagccaagatggtctcgatctcctgacctcgcgatccgcccaccttggtctcccaaagtgctgggattacaggcgtgagccactgtacccggccaagtgttggtatttcaagcatgagccaccgtgcccagcctactttttctgtgtttaaatgtgtttagacacataaatacttaccatctgtaacaattgcctacagtattcagtacagtaacatgctttacaggtctgtggcctaggagcaggaggctgtctctcatataggctgaccttgaagatattgtgtgttcagttctaggccaccccaataaaaacggatattgaaataaagtgagtcacacaaatttcgtggtttttcagtgcatataaaagttatgtttacactgtactgtagtctgttaagtgtgcaatagcattacgtcaaaaaatatatacatacattaattttaaaatattgctaaagctgggtgcggtggctcatgcctgtaatcccagcactttgggaggccaaggcgggcgtatcacctgaggtcaggtgttcgaaaccagcctggccaatatggtgaaatgtcgtctctactaaaaatacaaaaaaaaattagccgggcgtcgtggctcacacctgtaatcccagctactagggaggggaggcaggagaatcactttaacccgggaggcggaggttgcagtgagccgagatcacgccactgcattctagcctgggtgacagagtaagacttcctctcaaaaaaaaaaaaaaaagaaaagaaaaagctaacaatcatctgagccttcggggagttgtaaccctttggctggtgggggtccttagtgtgggtgggtgctgaccggtcagagtgttggttgctgaaggctagggtgcctgtggcaatttcttaaataaaacaagaaagaagtttcctgcatacttgactcttcttttcgcagaatagttccctgtcgcatgcggtgctgtttggtaccatgttacccaccattatttcagaattggggtcagtcctctcaaaccccgttgctgcgttactaaccgagacggtggactctcccaagtcctgtgttgtcactccgcagtgttcacagcatcctcaccaggagcagattccatcttaagaaaccactttcgttgctcatccatgagaagccacttcttatcagctgaagtttcttcatgagactgcagcaattcagtcagtcctcaggctctgcttctaatcccagtcctcttgctatttccaccacatgtgcacttccttcctgcactgaagccttgagccctcaaagtcatccacgagagagttggaatccacttctcccaaattcctgtcaatgctgatatctcaactttttcccatgaatcacagatgttcttcatggcatcaagaatggtgaatccaggccacgcgcagtggctcacacctgtcatcccagcactttgggaggccaaggtgggcggatcatttgaggtcaggagttctaaaccagcctggccaatatggtgaaacgctgtctctgctaaaaatacaaaaaaagaaaaaaaggctgggcacggtggctcacacctgtaatcccagcactttggcaggccagggcgggtggattacctgaggtcaggagtttgagaccagcctggccaacatggtgaaaccttgtctctactaaaagtacaacaattagccaggtgtggtagaggacacctgtaattccagctactcagtaggctgagacagaagaatcggttgaacctgggaggcggaggttgcagtgagctgagattgcaccagtgcattccagcctgggtgacaagagtgagactccgtctcaaaacaaacaaacaaacaaaaaaattagtgggccgggtgcaatggctcacgccggtaatcccagcactttgggaggccaaggcgggcaggtcacctgaggtcgggagctcgagaccagcctgaccaacatggagaaaccccgtctctactaaaaatacaaaattagctgggtgtggtggcacatgcctgtaattccagctactcaggaggctgaggcaggagaatcgcttgaacccaggaggcggaaattgcaatgagccaagatcacgacattgcactccagcctgggcgccaagagtgagacttcatctcaaacaaacaaacaaaaaaaacgaattagtggagtgtggtggcaggcacctaaagtcccagctactcgggaggctgaggcaggagaattgcttgaacctgggaagtggaggttgtagtgagcgagatcgcaccattgcactccagcctgggcaacaagagttagaatctgtctcaaaaaaaaagaatgggccaggtgtggtggctcacgcctgtcatcccagcactttgggaggccacggtgggcggatcacgaggtcaggagatcaagaccatcctggctaacacagtgaaacaccgtctctactgaaaatataaaaaattagctgggcgtggtggcgggcgcctgtagtcccagctactcgggaggctgaggcaggagaatggtgtgaacctggaggtggagcttgcagtgagccgagatcgcgccactgcactccagcctgggcgacagagcgagactccgtctcaaaaaaaaaaaaaagaaaagaaaaaaaaagaatggtgagtcatttccagggggtttccaatttaccttgcccagatccatcagaggaatcactgtctatggcagctatagccttatgaatgaaatacattttttttaaataataagacttgaggccaggcgcagtggctcacacctgtaatcccagcactttgggaggtcaaggcaggtggatcatctgaggtcaggagttcaagaccagcctgaccaacatgttgaaatgccatctctgctaaaaatataaaaattagccaggcgtggtggcgggcccctgtaatcccagctactcaggaggctgaggcaggagaatcgcttgaacctgggaggcagaggttgtagtgagccaagatcgcgtcattgcactccagcctgggcaacagagcgaaactccaactcaaataataataagacttgaaagttgaaatgactccttgatgcatgggctgcctgatggatgtcgtgtgagcagccatgaaaacaacattcgtctcctgcgagtctccagcagagctcttgggtgaccaggtcatgtcaatgagcagtcatattttgaaaggaaccttttttttcccaagcaataggtctcatagtgggcttaaaacattcagccaattgtgctgtaaacagatgtgctgtcatccaggctttgttgttccattttcagaacacagacagtcgactttgcataattcttaagggccctaggatttcaggaatggtaaatgagcactggcttcaacttaaagtcaccagctgccttcactcctaacaagagaggcagcctgtcctttgaagctttgaggccaggcatcgacttctcctctctagctatgaaagtcctagatggcatcttcttccaatggaaggctgtgtcttctacgttgaaaatctgttgtttagtgttagccaccttcgtcaagatctgaactagaccttctagagaactcgctgcagcttctccgtcagcacttgccgcttcaccttgcatttctgttatggagacggctgctttactaaaacctcatgaaccaacttctgccagctccaaacttcttctgcagcctcctcgcctctctcagccttcacagaggtgaagggagtcagggccttgctccggatgaggctttggcttaaaggagtgttgtctggttcaatcttcatcccggccactcactctctccacaccgtcactgaggctgctctgctgattctccttcctgtgttcgctggagcagcgattttcctttccctcaggagctttctctttgcattcactgcttggtgatttagtataaggggcctcgccctcaccctgtctcggctctgacgtgccttcttcactaaactcagtcatttctaggttctcattgaaagagatgtgcaacccctcctttcacttgaacacttaggggcccgtagagttagtaattggcctaatttccatattattgtgtctcggaagagagaggccacaggagagacagacatgggaatggccggtgggctgagcagtcagacgcacacacctactgattaagttcactgtcttacatgggtgatgttcgtggtgccccagagcagttgtgatagtcacaccgtagctcactgatcacagatcaccatacagatataataatagtgaagaagtttgaaatattgggagaattaccaaaatgtgacacagacaccaagtgaacacgtgctgttggaaaagtggcgctgatagacttgcttgatgcagggttgccaaaagccttcactgtaaaaaacagaagatcagcaaagtgcagcagagcagagtgagggctgcagcccgggtgcgcggtgggcggcggcctgcgggtgtggtgggcgtcccgggtgcgcggtgggcggcggcccgggggtgtggtgggcggtgtcccgggtgcacggtgggcgtcccgggtgcgcggtgggcggtgtcccgggtgcgcggtgggcggtgtcccgggtgcgcggtgggcggcgtcccgggtgcgcggtgggcggcgtcccgggtgcgcggtgggtggcggcccgggtgcgcggtgggcggtggcctgggtgcgcggtgggcggcaccatccaggcttgctgcgatgttggcaagaggacgaggtctcctcaccatgcatgtctcagaacatacctctgtcgttacgtggtgcatgactgtttttgtaaaatttttattgtagtatttgtacaattaagtgtgacatcctgagcaattttcttttctttttttttttttttttttgagacggggtcttactttgccacccaggctggagtgcagtggtgtgatcttggctcactgcagcctcaagcccctgggcccaagcagtcctcccacctcagtcctcaagtagctgggactacaggtgcgcaccaccatgcccagctaattttttatactttttgtagagataagagtttcgccatgttgcccaggctggtctcaaactcctgagctcaagccatccacctgcctcaacctcccaaagtgttaggattacaggcgtgaaccattatgcccggcctcaattttcctagtcactaaaatctatttgaaaatggaagagggaggagcctgtcagggtcaggggtggagggagctgggccctggggccaccctccctggtgaggcagctccagccctttgctgaggattgcagagcatccacagagcatctgctggactaacccgggagggtggtctcagggtcagcaggggcaggagtgggaatggccacagtccaggacagtgacctgccggccagcatcaccccaggggagtgcccagctcaggggtggctggccccttggcaggaggacgcacgccccaaggagcactgtcaggaggagaggaacatgcagcctggagtgtcggggcctgggacttccagggcctgcagatatcaaaatagtgttcacatataggtcgaccacaggctgagtggagcgggggctaatcaacaacccgcccctggcccgctgcgggcccagcagagcattcccactacagccagctccagggatcccggcaaaagcatctttgataagaggccccattccttcctgccctcccacctgaaggaggaagcgagcagggttttcttaggagaaaaagggcccagacccctctgagccccgtggaggttggtatgagcaggtgcagcaccacctgagccccaccttgattcctccgggaccccagcccggcagccccctcccctctgagctcattttactgggatccccagcaagggctcagcatttctgaccgagggcttctgagcttccaggttctcacccctgtgtgacactgagaccctgccacatcagatgccactctgagaaggcgactcagggtgctgggggcctggacaacagcagcctccaagtacgtgaagctgcgtgtgccccggcgagttgtgggcacgagggcgtcagcagtgggtgcgagtgttggcagaagctgccagctgcccttcgtcattttctgaaatgaagatgagggcaaatgtaaacttttaaacatttttttaccttgattaattgaagaattagcagcccaaatcaggaccccacaatcaaaataaatctggtcggctgggcgtggtggctcacgcctgtaatcccagcactttgggaggccgaggcaggcagatcatttgaggtcaggagtttgagaccatcctggccaacatggtgaaactgtttctactaaaaatacaaaacttagctgggcgtgctggcagatgcctgtaatcccaggtacttgggaagctgaggcaggagaatcacttgaacccaggaggcggaggttgcagtgagccaagatcgcaccattgcacaccagcctgggccacagaatgagactccgtctcaaaaaagtaataaataaataaatctggtctataaaatcctaacatctggatgtgaaccgatagccccaaaaggcggcttctagagcacagctggccccaaggctgtgagtgtctgagagttgtcgtcatggcgtgtggttctgaggctggcgtggggcacggcggggctgtgcctgggtacaggtcgtggctgcaggaggggccggggcttgttctgcagctccgtggtttgagtgcctcacaacagaggagctggacctggcctgtgagccaggcctggtgggtgtctcctgctgctggagattccggcctggctgagagtgctgggctcctccttggtcccccacagacactggtccctgggcattggctcctgtgggttgggcagccggcttcacacactgctttgctgctgctgagctcttgggtgggtggagggtggaggcagggttggagcagggggccaggatcttcctgggtggcactgcatggacagcagtcgtgcctgagatcaggagggccgcggacacccctgtctgtccatctcagtccctcgtgactgtgcctggcactggcctctccagcacagcccagtgccctctgcttatggcccgttcgtgaaagctcccacgtgttcctctcgtctgtccgcctggctcctgtgtcctcctctcgtatctgtcccctctccccagtggccacgtttcctgtccactggatgctccctgccctgtggctgccctgctgagggtcccccttgctgtcactgagagagaaagcccttcagaaaccccagcccacacatcagggcaccggggctccttcccgtcgtgctgctttctagaaccgtgcccctggcctgcaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacgggtgagtgtggtgccagcccgctcctgcccctgctgtggggaggccctgccttccagccatggcacatcgggtggcagaaactgtccagcctggcttaaggagttgggggtccggagcacgtgtcagttgctctcctgtctggaagccacagcagaggtgcgcgctgttgtagggtccgggctgccacaggtccctgttctgcccccgtggctgcagctccttggtcaagaggcctgagtcctgagtgtcctcaaaaaggaggtgtggggtcgcactgtgatgcccttgctggtctgggtgcagggcccgccatgggcaggtgccacagctgccgccaccccagtggggtcaccagggcctcccctactcctcaggcgggggagacccagtcggtgcaaatccaggctgaaatgccagctggcaggaggggccgtggaggccggagcagttcatgtggccccctttgccctccctgcccctccccacttcctgccaaccccgacctggaccgttgccagtggacttgggggactcgggggctcggggccacggcacctgtgtctggagcccctctgtcctgcatggatccacctcctcgctgcccccactctgtgtccagggaagcctgggggtggtcactgcctggtttcccgggtggaatctcacggcaccctcccttctgtctgttcattccgcagataactactccgaggaggagtatgagagcttctcctccgagcaggaggccagtgacgacgccgtgcaggggcaggtgacctggggccggggctccgcgccctctcctggctcacaccgggtgtcctggggtctgtggggtcctcaccagctgtcaccagggcctcgtgagggtgggtgagccacgggcctggcccctggttggccgcccatctctcgtctcccgaccccaggggcccgagtttatgctcaggtggctctgagagtcttgggacacaggtgggctctcagtgccgggcctctcccatcgcccacgctgaggctggcagggtcctgccagcactatgcaggctgccgtggcctcagccactgcatatgtctctgcaggacttggacgaggacgactttgacgtggggaagccgaagaagcagcggagatcgattgtaagaacgacgtccatgaccagggttggtggagactgcttctatgaatgctggggaaggcgagggtcggggaggacgctgggagcctgggcgtgggggggacacgggcgtgggaagtgagatctcaccccaggtcacagcagcatgtcccgtggcagaccccctgattgccagtctcctgccgggtgccactgtctcccctgcctcgccacatctcctggctttagccttgtgtggccgctaggctcagtgggccctgagcaaggctgggaggctgcctcgctgccaggctcactccatgtgcagaaactccgggaggccatcctcccttttgtcccgtcaggtgcccacatacacctgagtgggctggttcccccatttttgtttgggatctggcctacctacctccacggtccccaggagcttggcagggctgttcagcattttttccctgaggaaagctcaggcagctctttcctcagaggccgtgtccggcactggcacagagggtccaccgcctggcgcctggacaccccaaggacaggcacggttccagggaggccagcgcaggtgggcggggagctctgtgcctggtgctgacaagggacatgggcacagcccagcccggacaccgccgcctcctctggcagcattcaagggggcgctgtgggcagacggtgccagggacgggcaagctgctcccaaagtggtgaagctgtgtcttgctggcctggagagcagcccccgctgtgcagaacaccagcttgagcctccattccagggcccccttgggcccaactgttgtgaagggagggcgtgggctgcctttgtagggttggtccccgagagggtggctgagggtcccgctcacccagtggctggagccgaggttctgcagtccagggtggcacgaggcacccacggggctcaggctcttggagcacgccccaccccacactcgcccacctgcccaccccacgtgggtgcccagcaccttccttctggggtcggccagggcctttcctgggagggggtgctgagggaagggccccgtgagcctgggaagggctgcagaggcttctggaagaaccatggagtccgcacacgcctccccgggtcccccttggccaggaatggaactgtcagacctcaggcctgttgggaagcctctgggagccacgagcgaatccatcagcgtggctggtgctgaggccttgctgctctcccacggcgggcctgggtgcggcctgggcctgaggaaggggctccagcggcgggtctgcagctctggcggcggctctgactctgcaccgcctgtcttgcagcaacagaacttcaagcagaaagtggtagcgctgctgcggaggttcaaagtgtccgacgaggtgagtgcgccgcgccttctgctcgcggcccccacgcctgcaacagcacctggtcgggaggaggcctctggggtctgtctccgggccacctctggttctgccgctcaccgtctgcacggccccgccagcatcgcacagtctgcgaggcgcagtgacagtggcactgcctcccgggctccaggtcacccgctgggtctctgctgaagtagaagtcgtgaataccctggaagtcggaaagtcattttcagggggatgtaaccattagtttgtgtgtttttttttttataaatagactttagtttttagagcagttttaggtttacagcaaaattgagcagaaagttcagagttcccatggacccctccccacctgacagccccccactattgacatgggccccccctccccacctgacagccccccactactgacattccatggatttttaatgttcatcttttagcttttctctaatctctgaattttctacaatgagcttgtataattttcataccgaaaagaaaaacatggctgggctcagtggctcatgcctgtaatcccagcactttgggaggccaaggcaggcagatcacttgggcccaggagtttgagaccagcctgggcaacatagtgaaaccccatctctacaataaaatacaaaaattagctgtgggtggtggtgtgcacctgtagtcccagctacttgggaggaaacctagtaggccaaggctgcagtgagtggagattgagccactgcacttcagcctgggcaacagagcgagaccctgtctcaaaagaaaaaacttcaaatctcggctcactgcaacctctgcctcccaggttcaacagggtttcaccctgttggccaggctggtcttgaactcctggcctcaagtgatctgcctgcctctgcctcccaaagtggtgggattacaggcgtgagccaccgcgcccagcctttgttgtttctttaacgtcagaagaaaaacgtgcctgggttcaggacctgaagtggagaggtggcgtttaagcgtctcagccttgaagcagggttgtcacccgtcggcctgagagcacactgcctgtagatggcgctgtgtcctaacatactcgggatgcatccagctcagcccctggggcacacactcagcgaggctgtcaggtccatgtgccgaaacaggtgctttgtggcccggtggggcaggcagcatttctgggaacagcgtaacatcaccaactggccgcagaggaagggcagctccgccactgggatggtcatcgggcccctgtgtcttttggtttgcatcttggattggaacattcccaagtgcagctgaagatgggacttagccaagtcggctccctggcctggggcttccttgagccctgctgagcgcctgtgggttcaggggtgggtgttcttggttgaatcttgaccgtggggttctgcactcacctgggcaactgaactgagtcccagaatgcatttcacttacacagattatggttctgagactcacaacccaaactgtgaaaagatgggccaacgtcacagacgctgttcagggagaggacatcgttttcatagggataattgcacagcgttgtgtgaaattcatgcaggtcaacacagtactttaatggagtgatgggatctctttccgtattttccacccatcactccctttcctgaaaagaccagaccatctccgccacagctctgaacctgtgtcttggccactaggagtgccacacctggcactgccccctgcccaggacttcacagcaaccctcagggggcaggagatgcacagtgagacgaggtcaccgcctggattacagccatctgagattgttcatgctgctataacaaaatactttagactgggaaattaataaacaaccaaagtgtatttctcgcagttccggaggctgtgagtccaagatcaaggtgccagtagactcggtgtcttgagggcccgtttcccatagagggcaccttctgtgtgttgtgtggtgagagggcctgacaagctccctcaagcctccctcatcagggccctgagcctattcagcgggcagagctctcgggccctaaccacctgttagaggccccacttcctaattctagcaccttggtggtcaggtttcagtgtaggaattttgggggtacaaacgttcacagcccccaggctgaccacagagcactggcatccaggctgccctgtgcccaggtgccacacagtgggtctggtgaggaggagagcagggctctgcttgggacccatcctgtgaggaggaaccagagtgaagtctgttccttacagccctcagcttcagctcacagcgaaagcgtccgctgagggctgccttctgaatttttcattgtaaaaggtggcacacctggatagtcagttgattttcaacaagggtgccaagttcattggagaaaatatcttttcgcaaaaaaactgaggcttgacaatgcacaccatgtgcagaattcagcttgactggatcatattcctaaatgtaaaagcctaaaatttaaattacctagattctaagccttaaaaaatatgaacttaaatcctgcactaatgccactgaactgtacacctaaaaatagataaaatggtaaatattatgttttatatatttttaacacaataaaaaaagtagaaatttgctttctgaaaggtactgttaaaagaatgaaaagatggccaggtgcggtggctcacgcctgtaatcccagcactttgggaggccgaggcagtacgaggtcaggagatcgagaccatcctggctaacatggtgaaaccccatctctactaaaaatacaaaaaaattagctgggcgtggtggcaggcgactgtagtcccagctacttgggaggcagaggcaggagaatgatgtgaaaccaggaggcagagcttgcagtaagccaagatggggccactgcactccagcctgggtgacagagcgagactccgtctcaaaaaaaaaagaaaaaagccacaggttgacagaaaatatttgcaaataacatacctggtaaagatttgtatccaatagatatattaaaaactttcaaaacccaataagaaaagcaacctgatttttaaaatgagtaagactcatacagtgaaactatgaaacattttttaaagaaagaagatataaataagtggaaagatgtcatatgttcatgaattggaaaacttagtcttgttaaggtggcaataatccctaaattgatgtacaaattcaacaaattcaagtgcgtatcagattcccagctgtgtttttgtagaaattgaccagctaaaatttatgtgtaaatgccagagactcagggcagacagaacagtcttgaagaaagaagacttatacttcccaatttcaaaatgtactacaaaaccacagtagtaatcctgaccatgtggggctggcccagggacaggcatggagatcagtggaatggaggtgatagtccagaagtgaacccttccatttatgggcaagtgatggtcaacaaagatgtcaagatatccatgggggaagaatagtcttcaacaaaggtgctaggaccactggatatccacatgcaaaagaaggaattacagccagctgtggtggcacatgcctgtaaccccagcactctgggaggctgaggcaggcagattgcataagtccacatagtgaaatcgcatctctactaaaaatacaaaaaattggccgggcatggtggtatgcacctgtaatcccagctactcggaaggctgaggtgggagaatcacctgagcccaggaggtggaagctgcagtgagctgagatcatgccattgcactccacctgggcaaccagagtgagaccctgtctcaaaaaaaaaaaaggaatttggacccctacctcacaccatattcaagaattaactaaatggatcagctgggtgcggtggctcacgcctgtaatcccagcactttgggattagtggccgaggcttgaggctcaagtgacccggatcacttgaggtcaggagatcgaaaccagcctggctaacatagtgaaatcccgtctctactaaaaatacaaaaacaattagccaggcatcgtggcgggtgcctgtagtccctgctacctgggaggctgaagtggaagaaacacttgaacctgggaggcagaggttgcagtgagccaacattgcatcattgcactccagcctgggcgacacagcgagactctgtctcaaaaaaaaaaaaaaaaacttgaaatggatcaaatatctccatctgtgagctaagattataaagctcttagaagaaaatgggccaatcttatgaccttgggttaggcaggggtttcttagatgtgacatcaaaagcataagcaacaaaaggtaagtttttctggaccacagcaacattttacagttttgtgcaccaaatagtgccatcaagaaaaccgaacagtagaacagaagaatgttttttgcaaatcatatatgtgataaggggcttgaatccagaacacataaagaatgcttataactgaaaaataaagacacagacagtctagttaaaagctgaactgtccattgctttgagaacgatgcagcctcaggtgccacggagctggggcccgcccactcctgccctgactcgctgctgtccacttgtactgagaagtcgaccaggaagccgcctcgtggccacggcttttaaagacaccgggaggacacctctggagcccgtggagtgattccttgaattagaattaccctgaccagctgcaatgtaaaatccctggaggtgtgtgctggcttatgaggggcacggagaaaaacaatctcaaagtgaaagaaccagttctgatgcctgccaagtctttgagaatcactaagagaaacacaccttgtggtgaaggttctcagacacaggatcacttccagacgagaatccataagcagctcgtggacctgcctggtccatcctggattgtgaggctgattgctctgttggaattgagctgcgagccgcggttgacatcaccattgcagatgcttaagccaagtgttttaataaagtgattatcacttgtcagaaccaggcacagtggctcacacctgtaatcccagcactttgggggctgacgtgggaggatcacttgagcccaggaggtcgaggctgcagtgaactatgattgtgccactgcgctctaccctgggcaacaaagcaagaccctttctcaaagacaaagaacagtgaattgtccaattaaaaaatgggcagggggctgggtgtggtcgctcacacctgtaatcccagaactttgggaggccgaggcgggtggattacaaggtcaagagatcaagaccatcctggctaacacggtgaaaccccatctctactaaaaatacaaaaagtagccgggcgtggtgatgggcgcctgtagtcccagctactcaggaggctgaggccggagaatggcgtgaacccgggaggcggagcttgcagtgagccgagatcgtgccactgcactccagcctgggcaacagacagtgcgagactccatctcaaaaaaaaaaaaaaaaaaaaaatagggatctttctaaatagatttcttcaaagacacacaagtagccaataagtacacgatcatcatgatcattatcactggtcattagggaaatgtaaaccaaaccacaatgagacactacttgatccccactaggatggctggaacaaatgaaatgcaacagggtgaggtgtaacagcaggaacccacaccctgctgggggaatgtaaggtggtgtggcagccacaggaagcagttgccagacacccagcacccctgttcttcagtgttgacttcagggaggtgaacacacacatgcatggacccactcagacgttcacagcagcttcatctgtgatggtcataatgcccgtcagctggtgatctgttagactggggtccacccactcagtggcgcactgcagaaccatcagaggaagtgaataaaggaaagaggtttagttgactcacagttcagcatggctggggaggcctcaggaagctgccaatcatggcagaaggggaagcaggcaccttctttatggggcagcaggtcggagtgggtgcctgcaggggaaatacaagatgcttataaaaccatcagatctcttaagatgtgctcattatcatgagaacagcgtggaggaaaccacccccaggatccagttacctccacttgtcctgcccttggcacgtggggcttatggggattacaattcaaggtgagacttgggtggggacacagtggaacatgaagtgtgccacgctgggtggatgacgccctcctccccccgccaccgagagctgcaggccacatgattccttttgggtagcactcgggaaagggcagaatgtacaggaacagagtgagattcgcagggcctggggctgagggaggggacgcactagaggaaggcaaaggggagcctcctgggtgtggggagcactttctgtcttggttttggtggtggctgcacagtggcccacacccgtcagagctcacctgcctgcacccaggccctccgtgcaccctggcagcccagatgactgcaccagcccaggggaggtggaggaatgccacacgcaccggtacctggggaccgggggtcctcggtgatcatcccgagctccaagacagaagctggactacagccgtgctgagtggaggggtttggtggctgggtgcccgcctcctattgctcctgcagactctggggtctcgggcgcccccagtggggcaatgtgggctgctgcagggaactcacgcgtgcctggcacccgtgcaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggtgagccctacagggcggggcggggaggaacagccatttcagatgccccggccactctgcgaccactctggcagacccatgtccagccctggagacggggtgggcagggccagctgcctcgaagcctgggaaggctctggtggctggaaggaggggtgtgcggctgcctggcaggcccaggctacggctgcactgagccaggcagctttcctttcataggccagggggtgcaagctctgggctggggaggaccgagaggggtcccccagggtgctggctgggctgggtgtggcaccccgttgtaggggatccgtctctgggggatgccctgggaactgcaggggacctccgttcactcaggtggggagtagagctcccatgctgggtgcccctccctgaggaggaggaggcagaggcaggtggggagggggagggcaggtgtctctgtggctggatgggaggaggggctggctggggtggcctggcctgggcaggaggagaggatgcagggcaggcagctctgtgcatgggtctgggtatggaggcctcggtcagctgggggcaggaaggcaagcacaccaggcagaaggcaggtgccagcctctgggcagctgctgaggagccagaggccccagtcagagtcaggaagcttggtagaccttttgctctcacacttttttaacctaaacaacacgaagaaggtggccttgctgcatgttggaggcgcggccccagttagccctgcagccacgcagcggcctcccacctcacctgccccggcctggcagccccagcccaacttgctgctccttcagttgccagcagccaccataacaggtgaccgcggatgtggccaccagaaacagcctctgttcctcctgttctggagattgccatcccgaggctgtggcctcattcttggccagggtctcgctgggctcgggtggaggtattggtggctgccctgactggggctccgaggtcatgcagtgcaggcccagcgtggtggttggtggagttcagctccgtgtggctgcgggatgggggtctggctgccctgccgcctggtggccgttggtcattcttgccttctggcaaccgtcctcgtaccctggcccagggtccctcctccaccttcggaaccagcaaggcccagtgaagtccccctcacactttgggcctccctggccttcctgcctcatctcttctgccttcagccggagaaagttttctgtctttaacggctcacgtgattccataggagacatctttgtggcccagatcctctcccatcttaaactccgtggtgttggctgtatctgcagagccctggccagctagcattcatagtttgaggagaggcgtgtgcgtctcggggctatgatcttgaatgggcacacacagcagcaagtttccacgtgggtttgtcacccagggtggagcagcagacactgctaagtcccgtctgtttttttagggggcgggggagttgtttgtttcttgagataaggccttgctctgtcagccaggctagagtgtagttgtgcagtcgtggctcactgcagcctcaaccacctgggcccaagcggttctcccacctcagcctcctcagtagctgagaccaatggcgtgcgccaccacacccagctaatttttatatttttgtagagacagggtctccctatgtttcccaggctggtctcgaactgagctcaagcgaaccacctgccttggccacccaaagtgctgacactacaggtgtgagccagtgcacctggcctcctgtcaaatttttttcacttgaaaggtcttttaagtcttattgaatctgtaggtctcccttcctcctttttcttcgtacatattatatcaaccagggatgagacattcggcctggatggcctggatcggccagatggtctgcaagggtctggtttgtctggaaaggcatgggtggcctggatcagcctggatcagcctgggtggtctggaaaggcatggatggcctggatctgcctgagtggtccggaaaggcatgggtggcctggatcagcctggatcagcctgggtggtccggaaaggcatggatggtctggataggcctggatggtcgggaagggcctgggtggtccggaaaggcatggatggcctggatctgcctgagtggtctggaaaggcctggatggtctggatttgcctgagtggtctggaaaggcatgggtggcctgcatcagtgtggatagtgtggaaaggcctgggtggtccggaaaggcctggatagtctggataggcctggatggtttggaaggacctggatgggcctgggtggtctgatctgcctggtgggtccggaagggcctgcttcatctgatgtgcccttgttgttttgtcgagcatgttcacctgtttgctgcaggctggctgcagatcccagggctgccctccagcaggattggccagtggagctctccccagagccccttcgtgtttgtggcagccttgcctggagctaaggctgcgagtttcaggggtgtgtgtttcctgcagctgatgtcagggcaggtggaagaaccaggacggggcagccaggttggcccagcgcttagtgttgccagctccagaatcattctgtgccctgtgctgcagctggtgcgagcggggtgtgcgctgacacgggctcttctctggacccagctctgctctgccgttggattctgcagtctgtccctccaggtgtggtgggagaactgcgctttcagtgcaagaagggtcctggaaattaacgtgtcccccacccctgttccctgagccaggccatactttgaaggcctgtcgcactcgagctcgcagacggagattgggagcatccacagcgcccgcagccacaaggagcccccaagcccggtgagtggggccacactgatctcccagagcagaccgtggtctgactgggctgtggtgtggcccaaatctcccagcatgtcctgggcccagggccctgtccagctgtcctggagccactctgcacccactgtccagcacactgccacgcaggtaccccgggcctccctgagtcccagcattcccagtccagaagtcagcgccttggcacctgcagttgagcacaagctgattcccatctcctcccccacaggctgacgtgcccgagaagacgcggtccctgggaggcaggcagccgagcgacagtgtctctgacacggtggccctcgtaagcaggcttgggccgcacccacccgttccacacatcaggcacaccaatgctgcctttaagggtctgacctggaggggcggggcccacatataggtcctcatgtcacacctggtgtgcagaggtggggtcagccctcaggggtggccaggctgccagatggtcagagtatcccaaaattcactccagcttcagggtcagggcgccctggactcaccccaccctcagggtcagggcagctggactccccccacccgcagggtccggatgccctggactccccccaccctcagggtcagggcagctggactccccccaccctcagggtcagggcagctggactcaccccaccctcagggtcagggcccctggactcaccccaccctcagggtctgggttccccagactcaccctaccttcagggtcagggcgcctggactcaccccacccgcagggtcagggcccccggactccccccaccctcaggtggatggcacccaggaacgcctggttcccccctgctgcgttgcatggggtctcctcagttaggaggtcctgggcccagggcaagtcaggtcctgggaggttgggggctggtcaccctgcatggcccggatgggagccctgtgcttggaatttggctcagctaggctccctggtcagcgtatggccgggtccacatgtaggagccacggcctagagaggcctaaaccctcacccgagccagaggccacagggctggagaggccgcagcacgggtgtggtttccacgggaggctccaggcccgtctctgctcagcagggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtgatgggggctgcacggcggggcggggcggtgatgcacctgtcgggggaggggccgtcacgggcatcagtcggggtgggtgcgtgtcagtccatcctgatgagctccctcgggtgtagacagcagattcagggcctcgtccttcttaaaaaggagaagcaaaccccctggcccggcattgggtgtcaagcctgcagccccagattccaccctacctgtttgagggcagggtcaggcgggtctgccctccagcaggtgcccccacatccccctgagtagcccctgcctcagccaaaagacacacatacaccagcttgattcttccaggatttcaatttcatgtttctgtgatatttgggactttttccaaagcagcgagtctgggcactggtttttaccttgtggtggcacgcaggtgcctgtgtccgcgctttggagccaggtcgccctggcagcctcagtgccctgcactggcctgcacctggctctgcccagctcttggcccgggcagggagggtgagctcagtcctcacggtggctccaagcctcctggcctggctcgaagtctcacaggcagagctgtgtggggtcccatcggaggcacggcctcacttgtactcagctgctgctgtggccctcccagggctggtgacctctctgtgcagcccatgttcccactgcccatcagtcagccctgtgctcacccttccctgtccccaccacaatgtgtaggccactgcaggcctgcccctgcctctgcccctgttcctgttcctgctgccacagccacttagcctgtcctggtccccaataggtccgaggggaagcaggctggccgacggggccggagcacatccttgaaggagcggcaggcagcacggccccagaatgagcgggccaacagcctggacaacgagcgctgcccggacgcccggagccagctacaggtgcagctgcaggtgggggtggagggcgtggcacgcccaggaggcagggctcgtggtcaccctggcaccaaccagagcagggcaaaaagagaagcacagggggccaagggtgctgggccacagagcatgcctgggctttggagggctcctgctacacagcagggcgggcgggccatgggttggtttgtcaggaagaccatgtggaccccagggcaagttctagtccttctgctgccctccctggtccagggcagcctcattgcttggctgatttagcccagggcagttctccaagctggccagctctcttcctgccaccgagcctctgtggctgcagggggagcaggggcactgcaggcaccagggctggcgtggtggggatgggcgctgtgcttctcttctgggtgtggacagggctctgtgcctccagatccccaggaagactgtgtatgaccagctcaaccacatcctcatctccgatgaccagcttcccgaaaacatcatccttgtcaacacctcggactggcaggggcaggtagaggggcagtctcttggagtggagggtcagggtgtaggacagaggagagtgggttcctgaagctgccccctacccggcacacctgggtgctggagctgctggctgtggtttgcctggacgtgcctggggtctctggagcccctgagagctttggtgagggtcaggtgctgggggtggcctgggcggctgtgccgaagtcagcgtctgcctgtcttctgccagttcctctccgacgtcctgcagaggcacacgctccccgtggtgtgcacgtgctctcctgcggacgtccaggcggccttcagcaccatcgtctcacggatacagagatagtgagttgggctccaccctgtactcaccacccaagtacccctcggggtccctgcacccccacctctgcccattgctccggggctaggtgcgtcctggacctggggctgtggctggtgtccacagaggctgacccatgcgctcttcgcagcctggcctcccctcagttgtgggcgggagcagcagcctggtgggtgtcctgccacactggagtggtggcctcctggcctgtccttggaagcctgggctgaggccatgactgtgtggtccctcagcctgggcacgtttgggcatgtgggggtcctgggcttgggcagctccagggcagttgtggcatgagcggccacaggcacggagccccctgggctcacactggcatccttggatggaggacggctcccctgaggcgtctgtcccctctccgtcccacctgcctctggattgcagctgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggtgagcaccacgccgtccacctgggcctgggcacagatgccacgggcagtgtggcgtggcatggagtggtgtggcgtggcgtggcgtgttgtgtggcgtggcgtggcgcggtgtgtcgtggtgtggcgcggtgtggcatggcgtggtgtccctgcttgctacacatttgttgtttttaaatgtttgtttgatacagtaacactttgttaattttaattatatgcaagataacttgattgccctaaaacagccatttgggtcaagataaagccatcgccctctgaaggggcctgagctgggtgtctcctccatcagtcgctgtgataactctatgccagtttcgatttccaaagtcagaagtgcaaagcagggctcgttattaatcctctcaaatcgtccaggtcctgtgtcgtcgaactccattacttctttaggtccatacgatgtgtcttaccacgaaacaaacccacccagccttaatctgttgaccagcagcaaggcctggaggcgacacctctcccgtgtggccctcacgatgccgacgtcagagccctgagccagccgaggcctctgcacggtcacatgtgccctgctgggccttcctcagtggcactcagggctctgggacctcagctcagggctggagctccttcagcggggccacaggcatccaccagggaggggcagtggtggctttctctttcggtggcaggaaagtgggcttgtctggaaggcagcagcacaggcctggggtcgggtggcccagcttttgtgccgcggtgggagccttgcagctccgagtcccccgtggtgacaccagccccacccctggcatgcaggctcccaccccgtggccaggtacctaggctccgtggactaccgctacaacaacttcttccaggacctggcctggagagacctgttcaacaagctggaggcccagagtgcgggtgaggcccgggcgcgtccacagcccacgccacggcgggaggaaggggccccggtttccccagatgctgtgcccaggaggccctgcacctgctcaggctcagcctcagggaagaggccatggacagggcctgctggggccttggccaggatgcctcctattcccctgagccttggaatgttggaagctgtggggcctgtctgggaaggggcgggcacagcccttcaggtcttcccacgcttgccctggtactgcctcgagagtagagcaccagggcccctcagctgcaaccagcgagccctgccgcgcttcggggtacgggaggcctgggcggggcaccggggaggcccagcttagccccgcctgcaaccccacctggcaccagcctaaccccccaccgcctcctccccctgcagtacaggacacgccagacattgtgtcacgcatcacgcagtacatcgcaggggccaactgtgcccaccagctccccatcgcagaggccatgctgacctacaagcagaagaggtaacgcggtgggcccaggcaccataccacaggctgccgccagccaccaaccctccgtgggcctccccacccgctgctgggcttggcctggtgggccgcagagccctgcaccgggcttagaccagagcctgggccagctgggcagctctgggcctccctgacagcaggtgcttccccgcaccccagatccctcatagtaagcgccatttccgcacctgtttctgtgcatgttgaaaccccgcgtgataagaagttgacagaatggatagctgtcatggggccagggtggcagtggcccagcccctccagtctgggcacctgttccttccacagcctgggtttctcgggctggggaacgaaggattccctgggcctcgggccctgtgggtgagtgatcagctcgtgtcctcacctgcccagagcaggacggtgctcaggagcccccggccgaaagtcctgcggagacctgtctgtcccgcccggcgcctcctccctgcacatctggcgccactgtcccacaccttccctagactacaggggagagagccgagtgcaaggcgcaaagccagcgctcacgggctctcccacgcaggagccccagtgagatgggagccactgagtgccctcggcggtccctggaggggtcctgagggcgtcgtaacgtgtctgttttctcttttggtggctttctgaaaaggaaaaagcattttcattttgactttaccctaaggtacggctctgtgggtctgcctcccaccctgtctgtccccaggctggtcttcagggcttgtttggcagagtcacgtaggaatcaccccgctgtcctctctccggactgggagtcaggccctgagggccaccagctgcaggctgagagcccgcacgggagaggggaagtggccccaacccgagtcactttttgctgacgtggacccttttcctccatccgatctctgacactgagtcaggagagcagcagatgggccctcctgtccctggccaggcccgtgtgctgggactccaccccagagccctgaagcctgcaggtcggccaggcaggcctttccccggctctgttttgaccctgggttttgatttaagaagtggccaggtttagcccctcctcgttttaaaccaggagcgagtggctggtgtggacaccaggatcacctgggccaggctgtttcccaggcccttcacgtttgtgaagctggcagcagcctagcaggggcacgggtgcacgccctacacacggggacgcccaagcaagtagttaaggagctggcctggtgacacggtggtcagcggctgtgccttgggccccctacacactgcagagcctggctcccagggctccctcgagcacctggggccagcagagaggggtttccagcatcttgtggcttacctggagacggggccaaactaccgagacctccaaatgggggtaaagagttttcattccgaggcagctccaccccctacaacctttcatgttcagagccaagtcccaggcacccccaaagctgccctttcagacagagccaccccttttccttggccaggtgtgtcctgctgcagggtgggggcccctgctggtcctcccatgggctcgttctctaccccgtgtcttctgccctgtgtgaggtcatttgctgtcctaggaaacccccccaaccccctgacctcagtgcagggtagttgggtccctggggcccccttgctggcctaggagctgctcgaagtgggcagcctgggaccacccacagctgtagggctgggcgctgggaagacacaggaagggggctgaacatcctatgtcttgtcctgctaaacaagccttcacaggtgaaagaccagccgtgggggcctcccctgctgacccccagcagcctccgcccttgccccctggctgtggcacgaggagcctgcagcatgttctggccgcccggccgccgcaggccgtggacgcagctgcttgtatctcccaggtcagctcttccaagcagcaagccagggccttagggggccttacacccactcccaccctgcacctcctgcccctgcctccgtgttgcaggggtgacactggctgcctccacgttataagggtgacactggctgcctggggtcctggaaggaacccagcaaaggccataagtgtcttacctgctctctgtacccagaggagggtcagtcgggaggctgagagagtgcaggcggtggcacagcccttgtgacgggggacctgtgcagagccctctccagccaggctcccctgcgagagtccctcgtgaggtgactcctgctggcccgccctcctctgccgagaatggcactcctcctatgagggcaggccaggcctggagggcggcctcgagccccagcctgcccgtgcagcgcatgggtggaaagggctgctcaggcatccggcagcttgcccagggccatgcggagtggcccccaaggcatctgtgccctccgtgcccgcggggcctccccacgccacggtggtatgctccttacactcctgaccacactgcctccacagacatgtgtgtgcctccagggtcaggatgagggtctcagtgtccagccggtgtcacccctgtcatattggcccatgtccagggctgggtgctgtctgcatggcccagaggcgcagcttggctttgagagttccagcaacatccctgtgttgtgacgtctcctgcattcggccctcatctgccacgcactgccccatgggcctcggagcagagcatggatgggaggccagcctgccatggctggctcggtgggggggtctggctcggcagagggcaggtggccctgggaattggagccacccatgccctggggaccagcagccaccacctgtcttctgtgccttcgcgtgcctgggaggacacagatgtcacagatttccaaacactggtctgctcaacaaggatagtgggatgtcaaaggccacgtccaggcactcctgcctgacagctgtggacacagccagggtgctggggggccaggaggccgccctgaggcagaggtgggcctcaacacaggatttgcatcgctttatgttatttgaaatggacaagaagaggggaaagtttcaactcttctccttagaaatggaactaggcctggggcatctttaatgggatgggaggaatctgtaggtggtttcatccagaggcatttgccaggtcttctgcagagggtgggccaggagccgtccaggttggcgtctggggagggtgggtcttgccagccgccgtctcctcacactggcgctgcgaagacagggaaggcacctgctgggaccagccgcagaggctgcctcctgggagtgtgctctggaccggctgccgggcagaggctgttttacttgtgggcacactttgtggggagcactgggatcaagcctctgccctgcagggctcttgaggagatagcgctgctggtcctgggagctggtgctccaggcagacggctgggctgggcctgtggcatcctccgctgggcctgtttcctgcaagggattctctctgaatgaccctgtgctggacgacaacccaagggagggccggggccactgtgcgagcccatgttctgcacctggtgccgggctgtccctgagggccaccctgctggcctggccattctcgtcctgcccccggcgctccaggggcaacaggtgctcctctgcactgtgtgtgcacagtctccgcctgtaagacagccacttgccggcatcagactctgcagtttggggaaatgagacagaagaaacagctgagggagctgcccagagagaaggcaccagttgctgatgcggtctggctgaggaagctgggcggggaggcacctctgtccctacgtgcaggccacggggggccttgaggccaggggagaggaggaaagaggagagccagacccagcccaccactcaggataggccctgccctctggatctttcctggggcccagaaggagatgccctcacctcaccctagctgccggcggggcctcatgctgtgctggccccttgtcttgtgggagagctccctgggcccaagcccaggctgcagtgggcacagtcagcaggagcctgtgcgagctggaccacaggacagccctgcttgagctgcacacgtcggaggggaagacagacgggtcccctcagcggccccgcggctcctgtcctccacccttggcatcttcgtgtggacgggctgtgaccagacttccaggagaggctgctgttacctgccagatgttgtatggggccaagtccaggcaaaacctccactgcccgctgagtacatcagctcacgcggggcacggcctggggtgtgctgggcctgcctgcaggctgtgcgtggggtgttctggtagaacatggaggcccactgcagccaaagcctggcctcttatgtgggcatggacgttacccagatagtctggagaaaacttctgcaccctggctttggtgctgctgattaccagagagggcccaggctcttcctgggagtcccagggcactggcagctgccctaaccccagcagagcaggggtgcccagcttggtggggaagtggaaatgcaagccggacagggctgagctggctgtgtgggcgtcgggcacctaggatggcagagtgaatccctccgtggagctgtgccctctggcctgtcctcctgaccatgggtgcacagagacccctttgtccttccagcatgtcagcatgtcagaaggggcccaggcgttggtcctgggggccaggccagggctggcagtggttggagatgggtggggccgggacacacagggcagggctgtccggcagggccatccggcagggccgcggccccagggctgcgccaggttctcaggccaagagggagctgtgcccaccaggcggggctgtgccctgaggagagcttaactgtctgtttccttgctcttagccctgacgaagagtcctcccaaaagttcattccctttgtcggggtgagtactggccagctttatgtgatgggaaaccgcacacctgccaacttgtcgtttacagtcagaacgtttggggattgactcgatatattccagaaccttcccacagatacgagctggggatttgccttcccatctggcctgtctcaaagctcgcttccttccctgctggagtggggtgtggggccagaggttgttagttccccttagctctgccttgggggctgataaatggaagcagagacaggtcggtggggcgaggcctcagaacacccaggaggcttggccccacgtctcaggagaggagagactgcctgcccgggttggggagggcgcctctgtcctttaggagcccaaggccccgggagcttcccagtgctcacttgggctgcagcctgcagtgtgtgggtttcacttcctgccctgcccagggttagggctgcttctgccagccaggccatctccctgccagccctgggtctccacagcctgtttcctgccatcttttcgctctgttgtgtggcctccctcccgccaggtgtctgctgtgagacagacccacagggcctggcagacaggttgcccaggcagcggaagggtctctgggcctcggtttccccactggtggaacagaggcctttttgtgcaccgtgcagtggttgggtctgctgagggctctggggcgatggctggccctctgggagggtggaattcgtcttgaacagcggctgcccaaagagctttctccggtgacaagagtacactgtgctcgggcacacaggccttcccatgcaaccaaggccctgcggtgtcactgggattcacggtagatctacgtagccgcctgtggctcgtggctgccaggtccggggcctatccccgtcggcccgccaaggtccctctcaccagcgtcctgtttttactgcacacatagtttgcagctgccctgagggccgactttagagagagcagtccctcctgctgaggccacgcaccctgagcactgtctgtccccacatggctgctctgagctcagctctgctccacagatggggagagaagggcaggagggagctggcaccacctggccgctccagcatcatgggagtggtggccacggtggggaggcgggagccccactgggagggcgctgggctagctgaattgcacggctttcaccagccagtgcctgttgttttctaggttgtgaaggttggaattgtggagccatcctcggccacatcaggtaaccccgtcccaccctgaggccttgtgagtggcccgtgggtgggctgcaggagcacggtcattcgagtcctgcagaccagatcaacctttcagggcctgagagccgccacgtcccagtcttgctgtggtgcttctgtcctgcggggggttcatcctccaaggactgctgtcacaaagccccacatcaaggctggcagggttgtcttccaaaaaccgaggagaatccgagaccctcccgtctctcacaggccactggggactcccaccctgcccacccccaggagctgcctggcctggccacatcctggtccggagggcctggtggcacccgggcagagcagcaggtgggctcagcctgccctgtgactcctccccaaaggcgactcggacgacgcggccccctcgggctctggcacgctctcctccaccccgccgtccgcatctcctgcggccaaggaggcctcacccaccccgccctcctccccgtcggtgagcggaggcctgtcctcccccaggtaaaggtgcctcacggctcagcacgtttcacttacccgccccaccacatgctgcctgattcagtcatcctcccctatgtcacatccacctcccagggcacctggcctgtcagccacgaaggcggaggggctctgcaggacggctgggtcctctctggccacctcctgccacagatctggtgtttgggggcaggacctctgggggacagaaactcctgcacagtgaataaacatgggcgttgtgctgggctgtctctcagctctgtacacagttggggcttttaaaaaacaagctgagggcagaaggtgcaagagacgtgagtctctagacggtcctcatgggatgagcttcgatagctgtgctgaggccccgctagcccgcccgggtctctccggagcagacctcactcaagtggaactaagccatggggggttgtgggccctgaggccaggcgtggtgctggtgctgcgtgcagggctcacaccagcagatacccccccgacccccctgcctctgtgtttccagccgccggctccttccaggctgcgcctgagggagctggttcgcacgggccctcacgactccaaggggcagcttggagagcaggtggacaggcctcccaggccgaggctctcctgtcgccagggtccctgtaatttaagcaggacccttgtgggggtgactgggcatgtgaacagctccacagagcatgctccaagcacccggccctcctctgctggcaagttggcacaggtgctggctgtcacctcctggcctgtcacagggacagtgatgtccccatcactaggcccaaagatgcaggtgtgaatgcctccctctgcctttcccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaagggtgaggtggggcaggctataaggccacacggcgcagaagggcggctctgtgggagagggcggctcgcagtcaacagggatgacagcccccgggctggcctcgggcagcccacatgcgcaggcaggggcgggtggggtgagggagcctgaatcctgagggcagtgagggtcaggtgcttctgaccagagcctcaggcggaggccagctgggtgggcaggagagcagctgtcctcagtcaccgtggaaggcaggtttcctaggtgagcagtgccatgaccagctgagcccccagtgcctcccccacacgtacccctggccctggccccagccccgaaggagcagcaagatgacagcagggcctcttttctcctcccagtgatgtttctgcccaagaaagcgaaggacaaggacgtggagtctaagagccagtgcattgagggcatcagccggctcatctgcactgccaggcagcagcagaacatgctgcggggtgagcaccaccggccccggggtctgtagagtgggacgtaggtgagagcacagcaaggctgctttggagcccagcctaggagctgcgggtgtctcgctgtgacacgcacattccacgattcaaggtgcaagcacattcgatgaagccctcagtgaggctgacaaccttccaaatgctgagaaagaattttttttcaaccctttttgctttttaaaaataatgacttgtttcgtttttcttgtttgttttttgttttggtttttttttttttgagacagagttttgctcttgttacccaggctggagtgcaatggtgtgatctcagctcactgcaacttccatctctcaggttcaagcgattctcctgcctgagcctcccaagtagctgggattacaggcgcgtgccaccacgcccggctaattttttgtatttttagtagagatggggttttaccgtgttggccaggctggtctcaaactcctgacctcaggtgatctgcctgcctcggcctcccaaagtgctgggattatgggcgcgagccaccgcacctggcctaaaaataatggcttgtagtttaaaagtgttggctgagcgcagaggctgaggcaggagaatggcgtgaacccgggtggcggagcttgcagtgagccgagattgcgccactgcactccagcctgggtgacagagcaagactccgcctcaaaaaaaaaaaaaaaaaaaggggttttggagaagatactctgcaagtaactgtttcagaaacggagctctgggaggctttcctctttttgagcacgggtcagatgacctccaggtcgacgtggccctgtctccccacaggggtctctgttttaagggggctcccactgtcttcttcccacacctgtgcaggtggaagtggatgtggacgagcagcgcctggcggaaggtggtggggtctgctccttccacctgcaggcagccctgggggaaatgctgccctccccaccccccagggctctgagtgtggagggcaggggcaggaatggcgtccctcaggagccagcatggccctggagcccccgagtccctgaggaaagtgttgatgccctccagcatggggctccttctcatcctgtacgcccggctgccacccagcctggtgggccaggcaggcaggtggatagggtgggcaggccgggcaggggggcaggcggtcaggcagccctctcccacagtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcagatatttttaatgcttttcaatacatgttctaatgtagctgccaaacatgttgctcttctgaagtccccctggggctgggcagagccagcagagcctgcccccacttccccagcccctgccccaccccgcctcacaccttccccactctcaggctgttcttgaaacaccatgaggcttctgcgtgtagtccctgccccaaacttagcaagcacaggggcctccacagcccaggtggccccagaaaatgttccagagcccagcttggtacatagtgagatgctgctggggttggcctgaggtgggggccacttcctccaccccagtgggtatgtctgaggtcagccatggggatatctgggttgagattcaggttttggtgaatatggggcaggcgtccagatgtgtttgtgtcacctgctgcaacgctgtagccaatgaagattccagcgggatggcctgaccagcggggccggcactttggagccgtgggtgcagccaggtaccccgtgcagggcctgggaggctctccaggccacagtcctcagagcgtgttgggtcccatgttgtgtgtgggttccatgccctccacacagcaggagagggcttccctgaccacacctgccccctcagtcctgcttctccccagtaagcctgcactgtggggtctccataggaggagctggggaagctggggccctcccaggggtcctgatcgaccctgggggctcttggcctggtttcgtaagatggagcactgcaaaaggccatgctcagaaagcaaacgcagggcagggtgggcctcgagccggggctggaggggtctccacccttgctggcctgagagatggcccacatttcttacttgtgaccgccctgctcttcctggccgccccccccaggtggctgaacagggtgattttgttgtggtgaggggccaggatgtggcctggtgtgcagcctcagctccctgggttcaggcctcagaggtagcctgtgtgcaggaggcagagccccagcccctcccagccagagcccctccacaccagggactcctccttcacctgggaccaggagcctggggcacaccccagggtgggggagagggtaggaaggtctcccattgaatcctggcttcaggctctgccccgagaagtgtctgcggtgagggtgtgagccccgggctgatggcctctgaccccggcaacaggtgggaccctgactgactcgttcagctgcccccaagctgggctgcagagcatctgtttttctgctctccagtttcttttctttttttttttttttttttttgagatggagtcttgctctgttgcccaggctggagtgcagtggcatgatctcagctcactgcagcctccgtctcccaggttcaagcagttctcctgcctcagcctcccgagtagctgggattacaggcgtgtgccaccacacctggctattttttttgtatttttagtagagatggggttttgccatgttggccaggctggtcttgaactcctgacctcaagtgatccacccgcctcggcctcccaaagtgctgggattacaggcgtgagtcaccgcgtcctgcctgctcttcctgtttctttcccaagggtcacactcagtagggagatgaaggtggaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccaaagaagcaccactgtagtttctgcagacccccatgcggttcattgtgcattgtttggtttctaggatgtatgtgttgctagttttttttaatgaaaccctggattaatgtaaatagctttttggggaacggattctaatgtcacgtatgtgaccgtgtggactatttcaaggtgctgatgcaacactaataaacctggaggggccggc

SEQ ID NO: 1490 - DNA, 83404 bp, Homo sapiens; identical to SEQ ID NO: 1488

SEQ ID NO: 1491 - DNA, 3563 bp, Homo sapiens
cgcgctcacagcggcccgcgggccgggcgtcatgggcggcctcttctggcgctccgcgctgcgggggctgcgctgcggcccgcgggccccgggcccgagcctgctagtgcgccacggctcgggtgagtggggccgcgcgccccggcggggacgcggaggggaggaaggggcgcgcgccgctcggcctttgtgcgcgcacgtgcgggctggggtccgactcccccagaggcctcggggcgcgggctgcggggtccgtccgagttggggaaggcgccggctcgcacccgcacgcccctccagtgcccgtccggctctgcggctccttctcgcctccccaggccccaggctgcaggcgcccggcgagttggcagcctgggcgggtccggggcgaccgagggcccgggagcgcaaggaaggcagaggccggctgcagcactgggcggggagggggtctcccggccggggtgggggtgggggtgtgggggggtgagggagtcggggggtgggggtgggggtgtgggggggtgagggagtcggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccgcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggtgaggacgtcttctgtttccctggcagcgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccagggctcacctggtggggaaagtgtgtttctccctggttccctgccactcattcacctcagacacagggtgggctctgggttcttcctcatgtggaaagtcggggcttcagaccatgtctgtcgtcatccagaagggatggagtcaaaagtgaggctggagttttgcaggatctccagacttccctgaggccactgagctgggctgtgcctctgtggacctcagggtggtcgctgagctgggctgtccctccctggaccttgaggtggtccctgagctggctctgcctctatggaccttgcggtggtggtccctgagctgggcagtgcctccctgaacctcggggcgatctcaggcagcctctgcctctgctgggaggagccatggcccctgggagaggctagaagccctggggacacattgccttgggtgtccctgacagggactatcatgggggtgtttgtggctgtgggcaccatccctgtcccttccagagtgccctgcatagaggcagacaccctgaagcctggtgacccctgggctctggctgggaaacccgggtcgtggggacgtgaaagggtgaggtggcagtgcctctgacctcttgccttttgaaggagggccctcctggacccgggagcggaccctggtggcggtgaagcccgatggcgtgcaacggcggctcgttggggacgtgatccagcgctttgagaggcggggcttcacgctggtggggatgaagatgctgcaggtagtgggactctgggcttgtgggtgtccctgtggggatggggttgggggatccttctcggcctttcacatcccagccagcgccggggcagggcctggctttggcagttgaaggggcaggagggatctattctgcggtgggggtgctgcccatgctggtgttatctgcaaggtgcctgaggtcagggcatcacagctgctgtgctagtgcccacgtttactgtctgcggctcctccttacctcaatgccacccaggcaccagagagcgtccttgccgagcactaccaggacctgcggaggaagcccttctaccctgccctcatccgctacatgagctctgggcctgtggtggccatggtacggcagggcaggggtggtggaagggcctgtgggtaaagggcgtgtgggtgtgtctttccccccagcaaagggaggggccctggattgagcccaggggcccttggtgttccccacttctccccaaccattatctctcgctgcaggtctgggaagggtacaatgtcgtccgcgcctcgagggccatgattggacacaccgactcggctgaggctgccccaggaaccataaggggtgacttcagcgtccacatcagcaggtacgggggtcctgatacaccaggctgctgctgggggcaaggagggccatcacttggggtggtggcagatccacgagacctggctgtcttgctgtgctaggatgaagccaggtcggacatgacagctcacactggtgagagccgtgttctcccagggcacacagggcaatgaggtgttccctttgtgttgtgtgtaccgtgccatcgttgcctgttacctgacaccccaaggggttggcacggggcaacttggggggaaatgaggctcccaaaagctggggcctgggcgggtccacgaggctgtaagaggccgaggccaggctggaacccggtttcccagctccactgttactccttccctgtctgcagtcacaggcttgctcccctagacagagggcaacgggagcagcagatggtccctgggattcctcagggtgcacatgaagcctgagcctcacattgctcctgtcctggcacaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccca

SEQ ID NO: 1492 - DNA, 27829 bp, Homo sapiens
taagatttataacattttattatcatatggaagaagtgtattaaccatgttttcagtaatcactctgaacacagcattctcagttcacagtgtaaaaagtgaagtagaggttcctcttcaaagacttttctacctaattatgaatagtaacttctcttagaagcaaagtttattcaaagacctgtgctaacattcttaaatatctgctaagcacaattaaaaaatcaatgtactttatgttcttagctcccacaatttagcctaaatatttgccctggcatgcttatactaatccaagcaagcattaggtcatagcctgttcctcctccttatttgaaggtatttttacctttctcagcattccacaagttacttcctccttcctttgttctcctctgcctttgtctcttttaaaaagttctaagttgctaaacaattgggacatacagaatgtgaggtcccattccagccaatgaaaaccagacacagcagtagggtggacacgtcaagttataaatgactctgtctcctctgttcagtgtactcgtggcaaaactgctttctgcaaaaagtaaaaatggccttgctaagaaaaattaaatttattttcaagtgctatttctttacagctccagagaacaaacatttctaaaaccattatggaccctgagtaattcagggggaattggtatctctgtaaagagacagtaaggaaatgctgagtggaggcaccacactgcacatcaatgctttccacatgcacccaatagagtcttaatttaattgggctgttatttgcatagctagataattaccaactttagtcatactattttttagcaactaatggcatctgttacccattaattttatacatttgcttttttgaaaaacaaatcttttgttaattcactctaaattgagactacatttacaatcttcagtttttcagtgttaaagcaaatcagagaagagcaatgtgtgtacataatgtgcattttcctgcctaccaaaattattctggctgggaaaagtggctcatgcctgtaatcccagcactctgggaggctgaggtggatggatcacctgaggtcaggagttcaagacaagcctggctaacatgatgaaatcccatctctactacaaaaattatccgggcataatggcgggtgcctgttatcccagctactcaggaggctgaggcggaagaatcacttgaaccagggaggtggaggttgcagtgagctgagcacgtaccattgcagtgcagcgtgagtgacagagtgagaatccttctaaaaaaaaaaaaaagaaattctttcttcaattacttggaaaccctgggaagcccctataaaatactccctttgaatactttagccaggatttcagatttcaaaaggtcaaaaacaatcattgagcaaagcttaaatcttgcctttgtttcttgttagtcatctggccatttctgtaagtacggcaattatgcgaagccattgaaaaaatgtggtcttggtaaattttattccatttcaaatgttttctctaatgttaccttggtcatgtgaatctaaaagaaactatctacataactaatcatggattcaaaaaatattcatattaatgtgtttacagtttaatcttgtattacagtatagtagaatcctctataattagaagttaattatttataaattcattgtttttaaggtttttcaaatatgaaaacagacaattaggtatactttttgaagtaagttcaattttaggacattacccactggtcttcatggcatttctgtaataaatagtgtaaacctgtgtcaccagaatggtgcagacatgctgattgaattagaatgagttcagccttgttggtagactattggtatcccagaggctgatcattcactacagcttactaaatactgttccataatgccagtgagcacttttacccaggttacctttttcctcccattaatgtggacctgttgtggtctcctgtttctcttaagctatcccagatgagaggtgattatttcttgaatgaatgagattcccttttttttccctctgccatagaatcctcttatgttccttactggaagcaacatggaggaggcagaaatgatggcaagatacaaacatttttcccgccatgtggccaccataagcagcttacaacatgttctacctagaagtcacttactttcaggccagcaggggtgtttttctgtgatgtgtctctttctcttaaaagcacctctgattaagtttagcacaatcaggataatctccattttgataaacacaaagtctacggatgagtaacctaatttcataagtgatttcccaccacagtcacacattttttttacactcaagaggaaagtatgacacagcacgtgtgcaacagactggtaatccagggtattatcttagaatgttgcctacccacctaaataaatgtttaaaatcatcttttgctgggcacggtggctcatgattctaataccagcaccgtgggaggctgaagcaggcagatcatgaggccaggagtttgggaccagcctggccaacatgatgaaaccctgtctctactaaaaatacaaaaattagtcagacgtggtggtgcatgcctgtaatcccagctacttaggaggctgaggcaggagaattgcttgaacccaggaggtggaggttgccatgagctgagatcacgccactgctctccagcctggaagacagagcaacactccatcatggaaaaaaaaaaagagtctttctgctgcttttgttatctacataaacaaagatatcaactggatataataattaactactttttagttttattcattacaaataactatttttctggcttaaattattttttatgcaccatttatacattcacacacacatagaacaataaaaatatatccaattattcaattttggttgaatgttcattcaaataagtgttaaaaatgatttttttttcctgttttaagagggcttttattattgtactcaagagagttgtttctggagacaaagttgcctgtgctttaataggcagactctggggagaatccgaatcacaggccagaacattttatattaataaattcaatacaaagcagaaagtatagatttgctttcaccattttaaaagtgtttagttttgttaatcacctaaataacataatttgttttgttgcagtaattgcttttattctgaaaatatgtacaaacctatactcacacaaaaacactcaattcataattttcttacacctcaggtttatcttcagagtaatatgtgtatatttaactctatgtaaattaaaactaaaagtctatgtgtttgcaggcagagaccacatgttcaaggaaaactatattacaagtatttataatttttcaggactcagaaatgtatggattttatttttattttattttttgagatggagactcactctgtcagccaggctggagtgcagtggcatgatctcagctcactgcaacctctgcctcctgggctcaaacgattctcctgcctcagcctcctggcatgtgccaccatgcctaatttttgtgtttttagtagagacaaggtttcaccacgttggccaggctggccttgaactcctaacctcaagcattccacctgtctcggcctcccaaagtgctggaattacagatgtgagccactgtgcctggccgtattttatttacatttttgtataattattatgatcatagaaataattctgtagtcaataacaatttaattgtacattttaaaatgaataaaagcatataattacactattggtaatacaaaagataaatgctagaggtgatggataccttatttaccataatgtaattactacatattgtaggcctgagtcaaaagatgccatataaggcataaatatatacacatattatatacccacgaatacaaataaaaaatttaaataataaagagtcaaaatttaatctatgggaacaatatttaactcatttgcagtttaaagccactgacagtgattactaaagatgttattttacaatgtatgaaatagtatattcctacaatattgtacctacacccttgagtaaagtgggatacagttagtggcacaataatggttcattaaacgcacggtagtcttaccatggtaaaaataaaataaaattaagttcacaaataatctaacaaacttttttttttttgagacagagttttgctcttgttgcccagactggagtgcaatcgcacaatcttgccccactgcaacctctgcctcccaggttcaagtgtttctcctgcctcagcctcctgagtagctgagattacaggcatgcaccaccatgcctggctaattttttttgtatttttagtagagactgggtttctccatgttggtcaggctggtctcgaactcctgacctcaggtgatctgcccaccttggcctcccaaagtgctgaaattacaggcatgagccatcaagcccggccctaacagttttaaaatgcactgcattttattacataaaagtacaagtagtaaagtaatatactcatttattttaatatacttttaattatttctttgtgtcactataataaagtattgctctgaacatttacgttatacattacttaatagaattttactacaaacagcttctccacttgtattttcattatgcgtcttacattttaatgttcttactattttatagaaaaagtcataatgtccaaataatgtaaaaaaatcgaatatctctgatgcagaagccactgatcacatgctttctcacatgtgaatagaaataaaataacagcataatttgaaagctgtattacatcattattcagctttcaaaaaattttattcaaggaaacaagtatactttcaacgtaattacaatgcttccaaaaatctactccttttaaagttaaatagaaatcatttacctaaaaactgcagttgtggattagtttttatattcaatgctctgatttagtgtaatgtctgaagtgtcggggccttagttattctactgtaaactctcttgatatttatatacaatctattttgaattaaatattttttaatatttactgcatctgcaaaattatattttagcataaactctctgttgttttctaagctgtagtttctggggaaaaaaaagtgtttctaaacttaatacatttgtaggactcatctccaatataaattccctgatgttgaacaaacttgagcaactgctttaggattttcctccagtacaaaatgtgtgcaataagatctgtgatactagtaaatgtactatgtaactccctttatatttgtaatgcttgtcttcacaataaatactcttcttcactttaaaggcttatacttgctgaaagttttgacagtaattgccattttaatgcttttattaaaaggaagatttttatgttgagttagatgtgagtaggaattaataggttttccatattccttctatttgtacaatttttctcaaggatactagcttttctgtgagataaggtgtaagaactgattaaaagttttgccacattcttcacacttgtaggagttttgccagtatgaattatccaacctacaatcaagagtggcaaccatataaaggctttgtcacattttatatatttctagggtttcacactagtataattattgttatgtgtagagaagttggaggtgttcgtaaaagcaatgtcacattttttagctttgcggatttcctcttcaacatgaattattgccatgcctcttaagaattgagaacttgtggctgggcgtcgtggctcacgcctgtaatcccagcactttaggaggccaaggtgggtggatcacctgaggtcaggagttcgagaccagcctggcaaacatggcgaagtcgcatctctactaaaaataaaaaaattagctgggcatgttggaggacacctgtaatcccagctactcaggaagctgaggtaggagaatggcttaaacccaggaggcagaggttgcagtgagccgagatcatggcactgtactccagcttggatgacaagcatgaaacttcatctcaaaaaaaaaaatattgaaaacttgttataggatttgccacattcctcaaacttgtaggatttttgtccagcatgaattatgtgtaagaagggttcagaacttcctaaaagcgttgtcacattctttatatttgtagggtttatgttccatataaattctcatatttagtaaaagttgatagctggttaaaggctttccgacattcatcaaactcacagggtttctctccagtacgaattatcttatgtctagtaagggcagaggtgtccttaaaggctttgctgcattttcttatttgttgggtttctttcccgcatgaattatctaatgtctactaaggtttgaggatgaaataaaggctttgccacatttatcacacttgtacagtttccctccaatatgaattttcttatgtgaaaaaagcatagtgggatagcttaaagctttgccacattcctcacatttatagtttctctccagtatgaattaccttatgtgtagtaagggtagaggggcacttaaagcctttgccacattcttcacatttgtagggtttctctccagtatgaattctcttatgtctagtaaggataaaggagcgcttaaaagccttgccacatcgttcacatttgtagggtttctctccagtatgaattctcttatgtgcagtaaggtgtgaggacgagttgaaggctttgccacattcttcacatttgtagggtttctctccagtatgaattctcttatgtgtagtaaggatagagaagcacttaaaggccttgccacattcttcacacttgaagggttgctgtccagtatggattatcttatgtgtagtaagggaagaggagtacttaaaggcttcgccacattcttcacatttgtagggtttctctccagtatgaattctcttatgtgtagtaaggtgtgaggaccagttgaaggctttgccacattcttcacatttgtagggtttctctccactatgaattatcttgtgtgtagtaagggatgagaagtacttaaaggctctgccacattcttcacatttgtagggtttctctccagtatgaattcttttatgtgtagtaaggacagaggggtgcttaaaggctttgccacattcttcacatttgtagggtttctctccgctatgaattatcttatgcgcagtaaggatagaggagcgcttaaaggccttgccacattcttcacatttgtagggtttctctccagtatgaattatcttatgtgtagtaaggttagaggagcgcttaaaggccttgccacattcttcacatttgtagggtttctctccactatgaattatcttatgtgcagtaaggtatgaaaaccggctaaaggctttgccacagtcttcacatttgtaccgtttctctccagtatgaattctcttatgtgtagtaaggtgtgaggaccagttgaaggctttgccacattcttcacatttgaagggtttctccccagtatgaattttcttatgtgtagtaagggttgaagactggttaaaagctttgccacattctatacatttgaaaggtttttttccagtatgtcttatcttatgtctgtttgaatttgaaaatttatgaatgactttcacatatttatcacactgaaatattttgctttgagtagttgtcaaatattggttaagtccattataacctcttttgtgcaccttacactcatctacactttcacagccctttttaaactgtaaattgtcatgtccatagttttcatatcttctcagtgtcactttttggaaagaatcttttatgctctgctctggccaaagatctcgggcaaaatgagaacacgtaactgaaagaaacaataaaagcacattacttcaattggtagactcagataaatatactttacagatctaacctatataattatacaaactacataagcaagatgacacagcaaaataccacaaactgtaatttcttcctggatacataaatgtaacaaaagtggactgcccaaaatacatttgtaaaaaatttataagtgagttaagtgtatgaagggccccaggtgagcacaatgcaaagagccacatagaataaaaagaaaattctgttacttatacccaacagagctcttcctgctctccagtataatattgtgcctttaaaagtaaatttccagtcggatgcagtcgctcatgcctgtaatctcagaactctgggaaggtgacacatgggtggatcatgagaaattcgcccccatgacccaaacatatcccaccaggtcccacatctaacagtgagaatttatattgcagcatgaggtttgaagaacatagacatccaaaccatattatagaccacctaggattcacagccacacacaaaactctccagtcaaaaccaagataatacacagtattcctatttgcatctggtgtattctgttaggacacatatgaagttttattaaattaaaaatactatgtgctgtagctcttggctataatcctaacactttgggagatccactggggccaaaagtttgagaccagcctgggcaacatagtgagatcctaatactacaaacaagcaaacaattatccagacatggtagtgcatatctacagtcctagatactcaaaaaactgaggagaaaggatcacttgagtccaggaggctgaggttacaatgagccacaattatgccactgcactgcagcctgggtgacagtaagatcttgtctcaaaacaacaacaaccaatcatttttaaaacactaaaattacacactgtgtgttttctaacaaaaactgaatgaaactaggaattaaaagcaaaagtcaaactggcaaattctaaaataagtgaatatgaaatacactctacaacatattcttgctcagggggcaaaaaattttatttttcaaagttgtcaatacaacctacagttaaaacctacagtaacatggccaggcatggtggctcatgcctgtaatcccagcacttttggaggccgaggcaggtggatcacgaggtcaggagattgagaccatcctggctaatatagtgaaaccccatctctactaaaaatacaaaaaattagccgggcatggtagcaggcgcctgtagtcccagctacttcagaggctgaggcaggagaatggcatgaacctgggaggcggagcttgcagtaagctgagattgcgtcactgcactccagccagggtgacacagcgagactccgtctcaaaaaaaaaaaaaaaaaaaaacaccacctacagtaacataaacaatgtgacactgacacaaagataaacaaatgaaagaacagaatagagaactcagaaatgaacccttctgtatatgatcagatgatcttccacaaagttgccatgcatacaaaatagaaataatctcttcaaaaaatgaagttgaaaactgaatatcaacactgataaagttgtttatttccttgaatgacacaataatacattttaaataaaatgcttaaacataaaaatacacaagtgaggaaaagcatttgaaagaacatacaaaatcattaatttatacagaaattaaaaaaacacacaatgacaagatcaacttacacccattaggtgcaataaaaataaaacccatgttgattgctggtggaaaacaaagacacagccattattttaaaatgttgtaaatgttcctcatttataaatctctatccaaaatatgtaacacaggccaggtgcagtggctcaagcctgtaatcctagcagtttgggaggctgaggtgggcagataacctgaggtcaggtgtttgtgaccagcctggccaacacaccatttctactaaaaataaaagattagcttggcgatgtgacgtgcacctgtaatcccagctacttgggaggctgagacaggagaattgcttaaacccagaaggcagaggttgcagtgagccgaaatcgtgccactgtactttagcctgggcaacagagtgagactccatctaaaaaaaaaaggaaaacaacagcaacaacaaaaatatgcaacacaggacctggaagatataattgaaaatccatgtgtattgtaccagtattcacaaaagccaaaaggctgaagcaacccagatgcctcttgatttataaacatatcaaaaaatgtaacatatacatatgatgaagtattattccaccttagaaaaaacaatcttgtcaattttaagatgaactttgagaatattatgtcacctgaactaatccagtgacaaaattttggatactgtatgattccacatatatgatatatcttaagtagtcaaaatcataaaatcagaaagtggaaggtttgtctgtcaaaggctggagagagggtaaaatgagcagttgttacttaatggtcaatggcttttagttttacaagatgaaaactttctaaaagtcttttgcttaacaatgtgaatatacttaacatgactgaaatgaacagcttttttttttgagacacggtctcactctgtcacccaagctggagtgtagttgtacaattttgacttcccttaaatctcccaagtagctggggccacagctgcacatcactatggctggctattattattattattttttatagagaggtgtcaccatatgttgccctggctggtctcaaactgttgggctccatggatcctccagtcttggcctctcaaaatcctgggattacaaataagagcctccaccaagcctggccctgaaatgcacacttcaatagatttaaggtggtaaattttatattacgtgtttttaagcaattttttttaaagaaaaactgaaaaaaaaaaaaaaaaaacaattatgtatctttttgaaatttactttcaaatcatagaagtgtctctcacaaaagcaaatatatattcattgttaaacacatggtgataataagactatctccataagtactcacttagacaagataaaactaccatcaaaaatcagctaagaaagaatataagccataactaaaattggggtcatatttatagataaatacacatacaaatgtaatctgattatgatagatatgcataatttatctcttaattaaaccttaaattgacttaaagtgtacaaaaagaactgcaaattgtctaaaattataatacataagtaaaaccaaaacacccaataaactaatcttaagaaacctacactgaggccagaggcagtaggtcacatctgtaatcccagcactttgggagaccaaagtgtgcaaatcctgaggccagcagttccagaccacattggccaatatagtgaaaccccatctctgctaaaaatacaaaaattagctgagcatggtggctcatgcctgtagtcccagctacccaggaggtcaaggcagaagaatcacttgaacctcggaggggttcaaaacttcaaaacaacaataagagaaatgtttactcataaaatcttgtatgcaacattgaagtataattaaaaaaaaattgtcaggccgggcacagtggctcaaaactgttatctcaacactttgggaggccaagatgagcagatcacctgaggtcaggagttcaagaccagcctggccgaagtggtgaagccccatctctactaaaaatacaaaaattagctggggacggtgacacacgcctgtaatcccagctacttgggagactgaggtatgagaatagcttgaacccaggaagtggaggttgcagtgagccaagatcataccactacactccagcctgggtgacagagtgtgactccatctcaaaaaaaaaaaaaaaaaaattctagataactgcaatatttaactgttggtgtgtactcacaaaatgcaagtattctgaatcattagcatgcactgtgtggcagtaaaatttcagagattatgcagtataattataaatagaagattctaatgagaaaataaattagcatttaaaagaaactagttccttttaatgtcttaaatatatggtattcttacacaaaatgaaactgctgtaatcaaacattggaagcaaagagtacccttacattgttaaataagaaatatatattttgtagaatggggttagaccctctgatatgtaaaacaaatattaggaaataaactattttattatggagatataggctgaaaaaagtagatgaacatcctataattcctttttacctgcagcaaatttaaatttataaataactattttagtaactatgggtgcctactaattatgtaatttacttcaggcatatcatgcaaattctagcatattgtcttcaatatttgaatctaaaattacagacaaatctgaaagagaacatagaaagtaaaaatatatagggagagtgacatcagtaaaatgaaaagattaaaagtgccctattttcatattcccttacagcaaaacaagtcagccatcgctgacaaaaatacctttatgagagaaccaggattatgactcacacctgtaatgacagctccatggaacattaaggttggaaaattgcttcaggccaggattttgagaccagcctgggtctcaaagaccagatcaaagatgtagcaagatgccatttccaaaataagtgcctctaagggagatttgagagctagggtgggagttgtgaaatgctgttaaagcgtaaggttgagaagtgttctattcagaaggcaggctctcattcacgtgggaaactacagtacccctgttcatggctacagaccaggatagggtttacccaagttggtcccacagagaattctgaacttactctgtaaccagctcaaactcccagccacagtctggcagaggtcctgccattccagagacctggatgaaggcacccatttacagcaatgtaggcaggcttgcagactttggcctttactggggtccctgaagaggttcaatgactcagtttcggttacctgagccacagtttatggtcagttctgcctacatagaagcccacacaattgggccgggcggggtgcctcatgcctgtaattccagtactttgggaggccgaggcaggcagatcatctgaggtcaggagtttgagaccacccttgccaacatggtgaaacccagtctctaccaaaaaaatacaaaaaattagctaggtgttgtggtgagcaccagtaatcccagctacccagcaggctgaggcaagagaactgcttgaacccaggaggcgaaggttgcagtgagccgaaatcacgccattgcactttagcctgggcaacatgagtgaaaccccatctcaaaaaaaaaaaaaaaaaaaaagaaagaaagaaagaaatccattgcaattgaagaaaaataagtaaaagttgctgtttgtggatcatacatcttacattttaaaaaccataaacagtacattaaaacctgtctaaactaatgaatacactgagtaaattagcaaaatataaaattaacacacaagtacatgtattgtttcatacgcttaaaacaaactatctgataaaatagaggaagaaaaaatcttatttaatatagcattaaataataaatttctgagaaaaaaattaaccaagaaggtaagaaaatgtttacaataaaaaaatgaaaaaattagaagatccaaacaaattttaaaatattttatgtctagggattgaaagaataaatattattaaagtttcatattatccaaagtgatctatagattgcataaacgtcctgtcaaaattgcagtgttttttttttacagaaatggaaaatacaattctaaaatttacatgaaaataaactctgaatagccaaagcaatcttgaaaaaaaaaaagaacaaagcagaaggatatcatacgtataatttcaaactatatttcaagactataatagtaataaaaatagaaaggactacatagaaaaataaacaaaaaaattggacagaaactactactctcacacatcagacctgatgcaaaaagagaaataattctcaaaatcatgcagatatttgtgtgtccccaaaacaatgaaaaagcagccagactgtgcagtattttatatgccatgaagaggactctggctctcactgtgaacttgaagggagctcaccgaaagaaaagtagaatttttacagaatttaaaagcataagcagaagatgcccctttataagagcaaaatttaaaaaagaaaaaaaaaaaaaaaacagctcccaggaactattttctttggagcacagcttcccaaatcacactttaaggactggctttctctttgactttgggacctcttatctgtgtcgtctgctatattcattttcacttgcacctacctgaggggttggctaccatctcatgtttcttcatggtcaaaggtttttttccttgctccagacaggtgatgaggtctggcttagagacaacaatacctgttttattaaaaataaataacatgaatcttgctcatattctccaattacaagctagtaatgtgctcgcaaagacaatgtaataaaatattatagtaaattaataccaaaatacaaatttataacagaaatttctaaatatttagaaaatactttaaatttgccaggtgcagttactcacgcctgtaatcccagcactttgggaggccaaggtgggtgaatcacgaggtcatgagttagagaccagcctggccagcatggtgaaaccccatctctactaaaaatacaaacattagccaaacacggtgacttgcccctgtagtcccagatactcatgaggctgaggcagaagaattgcttcaacctgggaggtggatgtttcagtaagctgagatcacaccactgcactccagcctgggtgacagagtgagactctgtccccgaaaaaaaaaaaaaaaaaaaagaaaaagaaagaaaatactttcaatttgtaggtttcttaattttccttcctggtactactgaatcaaaaattggtggtggcatttagattttcaggtggaagctacaatagtttatgtcagtaaatttctggaattaccactaatttggagtgaagattacagctcacctcacaaatatggaaaatttggattaagatgaaacatcttgaagaaatttttttcttttctttttttttccccttgagacaaaatcttgctctgttgcctgggctggagtgcaatggcattatttcgactcactgcaacctccgcctcctgggttcaaggtattctcctgcctcaccttcccaattagctgggattacaggcatgtgccaccatgcccggctaatttcttgtacttttagtagaaatggggtttcaccatgttggccaggctgatcttgaactcctagcctcaggtaatacccccacctcagcctcccaaagtgctgggattacaggcatgaggcaccaaagaaattattttctaaatgaacaaattctgaagattttcttgaaaaagtggatctgaaactcttttataaaagaataaattactaaaaaaattctacaagagagagaaataaagtcttttgtgtatattatgaattatgtattaaagtttttctcaccaaggaagaccaggtttctgtagttctctaacatcacattcctatataaattccgctgtgcagtgtccaggcaatgccactcctccagagagaattctatggccacgtctctaaattgcaatggcccctgaaacacacacacaacatacgtttttaccaagtagccaagggtggaatttttaatttgacttaagttcaaatgagagagtaaagacaaatggttctgacttataggactgactaaaattatccaataaaataactttcaacacagaaatattctctaaagtattctctgagaaaaaagaacagcataagatccacaacatcagttcatgtatttttctagatagtaaagtgtaaaattaagggtatgaacacgaacatgtacatttttgagtgctatgtttacatcatatggaatgagctgtgaatatttttcagatgacaaagacatgttgagtttagaaggcacctctaaaatttaaatatatacaataagttgaagaccttgttatgcagggtttttttccagaagatctggaataaagtttgattttttgaatttctaacaagctcaccaatgatgtcaatgtttttggcccaagaaggatattttgtcaaacatccagtaagtggaagagcctgtttttcccagtttttctggcctgtaaacaaagataagagtcttcattttccaaagaaaaatatgtagaaaaaattaagaaaaaaggacaactgccagattaaatgtggtggtttattcacatcagctgcataaagatacttaataatgaagagaaaaataatcagctacatagtgaaaaatatctgtcacagagctatttaagcaagtgaatcattaaccattaacttcactagaagaaatttttatgttgtgctaatgcacatagaagaacacagcatcactgttgaaatattcctcttttaaaaaagtaaataaaatctgattcaatcataaagaaccatcagttttatgcaaacctcaaaatacagataactcctgtgttctgtaatttttagtagtaattttaaatagacttcatttagcaccctaaagagcaggtatgtcctaataagttttttcagaactttctgggtaataaatggcatcccatttaaataagcatttctttttttttttttttttgaggcaaagtctcactcttgtcccccaggctggagtgcaatggcatgatcttggctcactgcaacctccgcctcctgtgttcaagtgggtctcctgcctcagcttcccgagtagctgggattacaggtgcctgccaccacgcccggctagtttttgtatttttagtagagacagagttccaccacgttggccaggctggtctcgatctcctgacctcaggtgatctgcccacctcgaccttccaaggtgctggaattacaggcatgagccattgcgcccaatctaaataaggaatttcttttcttttcttttcttttttttgatatggaaaatcactctgttgcccaggctggagtgcagtggcgcaaccttggctcactgcaacctctgcttcccaggttcaagctattctgctgcctcagcctcctgaggagctgggattgcaggcacccactgccatgcctggctaattttttgcatttttaatagagacggggtttcactgtgttagccaggatggtctcaatctcctgacctcgggatctgcccgcttcagcctcccaaagtgctgggattacaggcatgagccactgcacccggccaataagcaatttcttaatcctgttcggcatacagctaatggaacacactaatggagcctcaacattacatgttctccatctttactaaggaccacagttttccccaatagaacatgagaagttatgatgtagagaatgaagaaaaggctctgggatacagcaaagaaacatttttcagacacctttgactatcgtaagaattttaagaagtacttaaaccaaactccttagggaggagaaacacaagtagagaagtaaaggtttgtgagtactaaacgcatggcagtccagaaggcagagtggacacagcttttcagctgaggcacgtttacctaaagaaaagccttttttttttgttctcctatctcctccttcactggaattccttctcagatgagattctttggacaaattacacctgaatcttgagaatatgcctttaaaggtgtcagtaccacaagtatacctgctagcatgacatcaactggcagaaaaagacagaaaaatccacccatttctgtcctttaaaacagaagaggttcaggaaaaatgagctgctccataaagatgaaaatataagtttctcctttcctgtcctcaggggccctcccctaccacagacaccatccatttctgctacagtaatggaaatatgtgccactgacctgtccctaccaaacccaaacagaacagaccctgtggccaccctttagtgcaaaggtggaacttaacgctcatgaatgtattttgcagccttcatacctgattctggcctcaccttacagtcacataaggcccttcgttaaaacaacatggatgcttccacccagaacaataaacagaagctgtggggagggcacaagagatttctgcaaattggccatgtgatcctaatgagaggcctgggctgataaccactaagctaagcattgcctctcaagctttaacgagctaagctaagcattgcctctcaagctttaacgagcttataattcacttggtaattttagctccactttatgtaatgtgattctgcaggtttgaaaagggtccatgaatgggtgtttcaaaaacaagttccctgtcaatgctgatgttgctccccattggctcattattaccattagtcagagaagcagtcacagcacatagtcccttatacttagcactcttgtcacaaccaaatacttctcatacaaacaaggacaacccatctccatcctaaagttttatattatttgatggctctttaaagtttacagaggaaacaaggcagcaatgtctgaataagtctgtttttaaaaaacaacatgtacacatgtactaatgcactgtttgttaaacaggtactatgtgcacaatagtatgatacagagcactgtgctgggtataacacattaggtgatttaattctcataacacccggggagctggtactaagggtttaatagttttcaagatttagttaaagggcccagcatttttatttcttcttctgtttctctctcatcaattttttaaaattgtacagaataaaagctaaatatagccagatgaaagagatagaaagaaagaggttaatgtagtttagacaattttattctgtttatatttacttttttgtgacttatggagcaactactggatctgcaggaatagaaaacaagtttctaaataaatgtctccgcaagcactggttttaatagaagattaaaaaactaggaccctaaaatacatactttatttatcccatttatctgtttgtggtttcaggaaattgtgagcaccagctctagaaaggcagcaggattcaccagccaaaactttgatctcttctaatcagttatctgaagcaagactacaagatagggtcagacctaaataaggcctccaaaaagggtgaatctgaacaggtctgggtctggctcagggtgaggaccctatgtaaaattctgctctctatgtcactgcagtactaccagttttgttttttctaagcttacctaaaaaaaaaaaaaaagaaaacttaaatcccagagtttctgtaattttagtattttctagccactgccctgtcaactttgtactacattctaatacgcaatttaaacaaatcctttaaggttttctagggtaattttttttttttttttgagatgcagtctccctctgtcacacaggctggtgtgcagtggtgccatctctgctcactacagcctctgcctccagggttcaagtgattcttctctctcagcctcctgagtagctggaactacaggtgcatgccaccacgcccagctaatttttgtattattagtagagacagcatttcaccatattagccaggctggtcccaaactcctgaccttgtgatccacctgcctcggccccacaaagtgctgggattacaggcatgagcaaccatgcccagcttttctagggtaattttattagaaaataaatatgtacatgtagcaaggtaaaagaaatagaaattatatggccaggagtggtggctgatgcccataatcccagcactttgggaggatgatgtgggtggatcacgacctcaggatttcgagaccagcttgaccagatggtgaaaccccatctctactaaatatacaaagattaaaaaaaagatatatataaattagctgggcatggtggctggcacctgtaatcccagctactcaggagcctgaagcaggagaatcgcttgaaccagggcagcagagggcagcagtgagccaagatcacacaactgcactccagcctgggtgacagagactccgtctcaaaaaaaaaaaagaacctataataacaattcttctgttcataaatatgccttcagatgtagacatcagaagtctcaaaaatataaagaaagtggcctaaataaagcccaaggtgttggacacatctatgtattgcaccaaccatatgatgcacaattcaattatttatccagttgctagtctagactaaaagcttctggattgtaggaaaaaagactgctgcatagtttttttttaatggccatataaaatggaagcaactagtttatccatttgggtctccagatcttttccttctttaccatccaagtactaggaaactggagaaactctcatctgggtaccaaccaaagacacctcttgtatgaggggatgaaaaaacacaggatgactcatttcccttacactgagacagaagcagaattaaccactcttatcagcctaacacaattctgctctgaacatcctcaaatgcctcaaagacacccaggtgattgtgagggaatttccagtgaccctgggctgatggcccaatgataagccaggctagagagactcaggctgaagaccaatgcaacagaatagagagcccagaaataatgccaccctcctataaccatcagatttttgacaaagctgacaagggaaatgtgggaagaattctctctttaataaatggtgctggaataactacctagcactatgtagaagactgaaactagctcacttcattacagcatatacaaaaatcaactgaagataaacacttaaatgtaagcttaaaattataagaaacactgcatgaaaacctaggaaataccattctagacacagaaactggcaaagaattcatgaggaagctaccaaaagcaactgcaacagaagcaaaaattgacaaatgggacctatttaaactaaagcgcttcttcacagcaaaggaaactatcaacagaggaaaaagacaacctacagaataaaagaaaatttttgcaaactttgcctctgacaaaggtctaatatccagaatttattagaaacttaaacaagtttaaaagacaaaaccaaacgacctcattaaaaagtaggcaaaaaagatgaacactgcttttcaaaagaaaatatacatgtggctaagtacctgaaaaaaatgctcatcgctaatcacgggagaaattaaaagaaaaaccacatgtggctaagaagtacttgaaaaaaatgctcatcactaatcactagagaaattaaaagaaaaacaacaacgagatatcacttcacaccagtcagaatggctattttcaaaaagtcaaaaaataatagatgctggcaaggttgcagagaaaacggaatgcttatactctgctggtgggagtgtaaatagtttaacaactgtaaaaagcagtgtggcggttcctcacagaactaacaacagaattatcatttgacccagggatctcataattgggtatatacccaaagaaacataaattattatattataaagacacatccacatgcatgttcactgcagcactattcacaatagcaaagataaggacaggccctaaatacctatcagtggtagactgggtaaagaaaatatggtatggtcagatgcagtggttcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaattggccaggtgtggtaatgcccgcgtgtagtccaagctacttgggaacatgaggtaggagaaaattgcttgagccagggaggttgaggctaaagtaaaccaatatcatgccatggcactctagcctgggcaataagggagactctgtctccaaaaataaaatgaaataaaagatttagtcaaaataaaatatggtatataaacctcatggaatactctgtggccattaaaaaaaaaaatcatgtcctttgcaataacgtcaatgaagctggagaccatcattcttagaaaacaaatgcagaggcctggcgcagtggctcatgcctgtaatcccaccactttgggaggccaatgtaggttgatcacttgaggtcaggagttcgagaccagcctgcccaacatggagaaaagccatctctactaaaaatacagaattagctgggtgtggtgccatgtgcctgtaatcccagctactcaggaggctgaggcaggagaatcacttgaaactgggagacggaggttgtggtgagccgagatcacaccattgcactccagcctgggcaacaaaagtgaaactccgtctccaaaaaaaaagaaagaaagaaaaagaaaatactgtagaaacagaaaaccaaatgcatgtttttatttataagtaacagctaaataataagaacacacaaacacaaagaggagaacaacagacgctgcggcctagttgagggtggagggtggaagactaagagaatcagaaaacatacctgtttggtgctatgcttaatacctcagtgacaaaataatctgcacgcaaaacccccatgcaccaaaacaaactcatgtgtaccccaaaacaaaaataaaagctaaaagaaaaaattaaatccctgggtgggagagattgcaatgtaggtgagaggactgatttttgctacagatagttgtcctggtgcagctgtactctgatttattactgtgtgcacgcagacatatgagattatgaacagctgattcaaaatgctaggttggtggagaaaacagattgctgctgcagatttagtgtctgggggtggggatacgccaggagacttgtagagacttgtgggttcttggcaagaaacactaggatcaaaaacgccgtggtgaaggtcctgagggtggtgcctactcctgggaggagggtggacatgtcaatgtctagtgtgtgtgtttgtgagtgggtgggaatcctgtggtggcagctgtgggaaaagggggtctgtcatcagagctcctttcttctaagttttcagtcctctgtcaccctgggagaagacctggaatcacaggacaatgggcagtgtgacagcctgtgaccagacagcagagctcccattcccaaacacctagagttttattccaggccagacttctgtgatatctttttcctggcaccaaatctgtagagtttgctgaacattaaacaattctccaacaccaactcattgtctaacatttgaattctgacaccaccgagagtcaacacagaccctgattcagggctcagtcccacaacactgtcctcactgcagatgccaatcacaaaccccatgggcttatctatgcttctgagctactgtttaaaaactggggagtcccataacctccctgaagttcaataatttggtagagctactcacagaactcagcaaaccactgcagtgatgtttaacagtttaatatataagatgcagcccaggaaaagccaaatggaagaaatgcacagaacgaataaaagagatggggaaagatgaaacacacagataatcctggaaaatatttgtgattaataaaattctccatcttttgtgtgctccaggaacagtttatggaaagaaacactgttcccattatgacttagtgctctcttttcttatctatcacacaggcacacacacacactgcacattttctcctttttctcattaaaaaaatcagctgaatttgtcttcagcgctcaaaatatttcttcactttgtcacccaggctggagtgcagtggagcaatctcagctcactgcaacctctgccttccaggttcaagcaattctcctgcctcaccctcccaagtagctgggattataggcacccaccaacacacctggctaattttttttttttttttttgaaatggaatttcactcttgttgcccaggctagagtgcactggtgtgatctcggctcaccacaaactttcaagccatttcccaggatcaagccattctcctgcctcagcctcatgagtagctgggattacaggcatgcaccacaatacctgatttttctttttctttttttttttctgtagtagagatggggtttctccatgttggtcaggctggtctcgaactcccgacctcaggtgatctgcccacctcagcctcccaataatttttgtattttagtagagacaggatttcaccatgttggccaggctggtcttgaacacctgacctcaggtgatccgcctgtctcagcctcccaaagtgctgggtttacaggcatgagccaccacacttagcctaaaataaaatatcccttaatcgaactcttcttaagcttatctccctccctcaggctcctgaactttgagctaccctcagtctgagtcagcatacaaccccattttatgtccctcctaagaacatgctgatttcagggtaagacatcctctgatctaaaatatgactttttcactctccgtttgccattcacctcccacctcctttctaatcttgtttgctcctccctaaaaaagaaagcccttttctgcttacatctttgcaagccataaagatcttaaattagttggtattttctgctgttgcaattttttttggaattcatttttttaacataaattaatattttttattttacaaagtgtagaaagtgccacaaaacataacaacttcatcatcaataagaccctctaagtttcctttcatcttaacctcagctgcatctgcctgtggggccccagctttccagggctctgtagcttctctcaggataaagcctccttctatggctggggtgagcaggctgggacatgtgcaggggaggctccccagaaaaaaactgagtctttagtaacatcctgttgcaggcttaatatcagccttagcttggagtcactaggttcaagctttgatttccatgtcagagttattcacttggtttttgaaactaagtgttagaaaaatccagggaaattactcaaacacagtgtttacataagaaggaagtgcttactttttttttttttttttttgagacggagtcaccctgtggcccaggctggagttcaatggcatgatcttggctcactgcaacctctgcctccccggttcaagaccttcttgtgcctcagcctcccatgttgttgggaatacaggcgtatgccaccacacccggctaatttttgtatttttagtagagatggggtttcatcatgttgggcaggctggtctcaaactcctgacctcaagtgatccactcacctcggcctcccaaagtgctgagatgacaggcgtgagccactgcacctggctaaggtgcttgcatgtgatacctccataagaaaagtaaatatatctacttctttcagaaaatatatgtattattttattatttatcttaaaaataagtaggcctggtgcggcaaatcatgcttgtaatcccagcactttggagggccgaggcaggtagatcacgatgtcagaagatcacgaccattttggccaacatgttgaaaccccctctctacttaaaatacaaaagaattagctgggtgtggtggcacgtgcctgtaatcccagctactcaggaggctgaggcaggagaattgcttgaacccaggaggtggaggctgcagtaagccgagatcacgccactgcactccaacctgttgacagagcgagactctgtttcaaaaaaaaagtaaataaataaaataatgtagtaaaaaattagtcatatgggaacacttctagaaggtaccatgtttcatcacatataatttagcatttaactcagaactcaacaggatatagaactgagatattcactgtcacaaatttcccctgcaaaaagaggaactaatgtgttgacgaatctatgtaactcatcaattatctaccacattttcctgtggaaatatattcattgtctacagccaaaatggaagagagattttccctatttttttccttggtaactagcattcctggctaacatactgaaactccatctctactaaaaatacaaaaattagctgggcgtggtgtcgcgtgcccatagccccaactactccagaggctgaagcagaagaatgcttgaacctgagaggcggaggttgcagtgagccgagatctgacactgcactccagctctggcgacagagcgagactccgtctcaaaaaaaaaaaaataaaaataataaattgaggaacatggggtacacttgaggccttgcttgagacacatgtggaaaatgccagggaaaatcagtccgctgtggcgtgtgaaaataattaagtggcaggcaattagactgaagaagctctagtccctggatttctacctcaaaaaaaaaaaaatctaagctcatgtgcattttttgggaaattactacattaggggaaacaaaattcaggcttaagcaactataaactgccaattaaactgtaattacataaccaggaattttttttttttttttgagacggagtctcactgtcgcgcaggctggagtgcagtggcaagatctcagctcactgcaacatccacctccggagttcaagcgattctctcacttctgcctcccgagaagctgtgattacagacatctgtcatcacacccagctaatttttgcatttttagtagacatggggtttccccatttgggccaggcttatcttgaagtcctgacctcaagttatccgcctgcctcggcctcccaaagtgctgggattacaggcgtgaacgactgcgcccggccccataaattttgaatagcagaaaacagaaactgtgaactccacggaccaaagctcttcccattcatgaacctgcaccccgagtcaggattctcccctgacgaccctctggtggtccctgcacattctgggagagacgggaggctgcggttgcagagctgcccacggagcgctccaggccagagcagtcactacgcagggaagacacaggacgccagggggcccggctgtcagcgtagccgccaaattatggctgaacgggactgaggccgagctgggcaaggagaactcagggtgcagattgtggagctgactgcgcagaggcctgagtcccgccacagccacttcccaccggttccaaccagcctatccccctctctcgggatgtcggaccggcactctcaccatttctaggcttccaggggctcccgggcgtcttagctgtggatctcccaatacctgcaggacacagggccacagaggctgggcctctaggagcagaggacacacagcagtgaagacaagacctggagctccggctgcagagacaaaggccccgcaaaacccggaagccttccgcttcactct

SEQ ID NO: 1493 - DNA, 30902 bp, Homo sapiens
agaggcccaccctctgtggccctgtgtcctgtaggtattgggagatccacagccaagatgccgggaccccttagaagcctagaaatggtgagagtgcccattggacatcctgagagaggggagggactggttgatgggaagtggctgtggagggactcaggcctccccgtagtcagctccacaatctgcgtccggacttctccttacccagctcggcctcagtccccttcagccataagatggtggctgcgctgacagccggtcccggggcgtcctgtctcttccctgcgcagtgaccgtgccctggcctggcgccctctctgtgcagcagctctccacccgcagcttcgggtctctcccagatggtgcgggaaccacgagaaggtcatcaggggagaatcttgactcggggtgcgggttcacgattcggaagagctttggtccgtggggttcacagtttctcttttcttttgttaaaaatttatggggccgggcgcggtggttgacgtctgtaatcccagcattttgggaggcgaaggctggcggatcacttgaggtaaagggttgctaggacaactaaattcctcttcaaagactcaacttcctgatcagaagttgtaaaagttgtaaaacaaccctacccctttttctcccttttccttttctcgcaaatcgctcgtttatcctatttggaaaaagtttgggtctaagccaaccgggatcagcttagattgtgcggtctgaccccagccaataggggaaggacacaaaaacaaaaactacgttggggttaaaaacccattcctggtcgggcgcggtggctcacgcctgtaatcccagcattttgagagacctaggcgggaggatcttgtggtcaggagttctagaccatcctggccaacaccgtgaaccccgtctctactaaaaatacaaaaattagccaggtgtggtggcaggcacctgtaatcccagctacttgggaggctgaggcacgagaattggttgaacccaggaggcggaggttgcagtgagctgagaccgcgccatcgtacttaagtgtgcgtgacagagcaagactccttcacacacacaaaagaagggccaggcgcagtggctcacgcctgtaatcccagcactttgggaggccaaggcaggcggatcacctgagttcgggagttcgagaccggcctgactaacatggagaaaccctgtctctattaaaaatacaaaattagctgggcttggtggcgcatgcctgtaatcccagctactcgggaggctgaggcaggagagttgcttgaacccgggaggaggaggttgcggtgagccgagatcgtgccattgcactccagcctgggcaacaacagcgaaactccgtctcaaaaaaaaaaaaaagtaagaatcttaaaattttcttcctttatgtaaacactgtttgagtaatttcactggatttttcaaacacttagtttcaaaaaccaagtgaataacactgacatggaaattaaagcttgaacctagtaattccaagctaaggctaatatgaagtctgcaaaaggagggggttaaaaaaaattttttttttttgagacagtcttgctttgtggcccaggctggagtgcagtggcgcgatctcggctcactgcaacctccgcctccggggttcaagcagttctcctgcctcagcctcccaagtagctgggactacaggcactcgccaccacgcccggctaatttttgtatttttagcagagacggggtttcaccatattggccaggctggtgtcgaactcctgaccttgtgatccgcctacctcagcctcccgaagtggtggggttactacattttttttattttgacatggagtttagctcttattacccagtctggagtgcaatggtatgatctcggctcaccgcatcctctacctcctgggttcaagggattttcctacctcagcctctggagttactgggattgcaggcacgcgccgtcacgcccggctaattatgtgtgtttactaggggtttctccatgttggtcaggctggtctctaactcccaacctcaggtgatccatccgccttggcctcccaaagtgctgggattacatgcttgcgccaccgcgcccggccaacaggaggttattaaaggcctagttagttttttctggggagcctcgcctgcagatgtcccagcctgctcaccccacccatggaaggagcctttatcctgagagaagctacggagccctggaaagctggagccccacaggtagttaagattaaggtgaaaggaaactgggagggtcttactgataataaagctattgttttgaggcactttttagactttttaagataaaaacgtcagatttatgtaaaaaaatgaattagtattggaacaggagaaagtaccaactaattataaggtctctgtggcttgcaaaaatgtaggcagaaaagggcttttttcctagggaggagcaaacgagattagaaaaaagcggggaggggaatgacaaatggagggtgaaaaagtcagattttagctcagagaatgtcttaccctgaaatcaccgtgttcttagaagggacataagatggggttgtatgttttttttttttttttttttttgagacagtctcactccgtcgcccaggctggagtgcagtggcgcgatctcggctcactgcaagctccgcctcccgggttcacgccattctcctgcctcagcctcccgagtagctgggactacaggcgcccgccaccacgcccggctaatttttttgtatttttagtagagacgggtttcaccgtgttagccaggatggtctcgatctcctgacctctgaccttgtgatccgcccgcctcggcctcccgaagtgctgggattacaggcgtgagccaccgcgcccggccaaaatggggtgtatgttgactcagactgagggtagctcaaaattcaggagcctgagggagggagataaataaagtttgattaagaaatattttattttaggccaggcgcgatggctcacgcttgtaatcctagcaccttgggaggctgaggcaggccgaacacctgaggtcacagcctggccaacacggtgaaaacatggtgtctactaaaaatacaaaaattagccaagcgtcttggcaggtacatgtaatgccagctacttgggaggctgaggcaggagaattgcttgaacctgggaggtgaaggttgcagtgagcagtgagtcaagatggtgccactgcactccagcctgggcagcagagtgagacttcatcacaagaaaaaaaaaagaaatttgaccactgaagacatattcagctgatttttctaatgagaaaaaggagaaaatgtgcagtgtatgtctggctgtgtgacaggtaagaaaagagagcaccatctaagtcataatgggaagggtgtttctgtccatcagctttttctggagtacacaacaaatggagaattttattaatcacaaatgttttccatgattatctatgtgtttcatctttcctcatgtcttttctttgttgtatgcatttcttccttttggcttttcctgggctgcatcttatatattaaaccggtaaacataactacagtgttttgttcagttctgtgaatagctctaccaaattattgaacttcaggaaggtttcaggagtcccgagttttcaaacattagttcaaaagaatagatgggcccatagggtttgtgactggcatctgcagtgaggacaatgttgtgggaccgagggtctatgctgactttaggtgctgtcagaattcaaatattaggcaataagtttgtgttggagaaatgtttgatgttcagcaaactctacagatatggtgccagtaaaaagatatcacagaggcctggcctggaacaaaactctgggtgtttgggattgggaggctccactctcctgtacacaggctgtcacactgcccattgtcctgtgattccaggtcttctcccagggtgacagaggactgaaaacttagagaaaaggagctctgattacagacccccttttattgcagctatcaccacggtgttcccacccactcacaaacacacacactagacattaacgtgtccacactcctcccaggactaggcatcaccctcagaaacttcaccacggcatttttgatcctagtgtttcttgtgtttcttgtcaagaacccacaagtctctacaagtctactggcatgtctccaccccagacactgaatctgcagcagcaacctgttttctccaccatcctaggatctgggccacatgtttataatttcatctgcctacatgcacacagaaataaatcagagtacagccccacctgggccactatctgtagtgaaaatcattccattcacctacattgcactctctcccacccaggaattattttttttcttttagcttttatttttggttcgatgtacacatgtgggtttgttatacagttaaaattatgtcatggggatttgttgtgcagattattttgtcactgaggtactacccatagcaccaaacaggtgtgttttctgatcctcttagtcctcacaccctccaccctcaactaggcctcagtgtctgttgttctcctctttgtgttcatgtgttcttattatttagctcttaataacatgcatttggttttctgtttctacgttagtttccttttttttttttcctttcattttgttttgtcttttgagctggacttttgctcttgttgtccaggctggagtgcaatggtgcaacctcggctcaccacaacctcaacttcctggttcaagtgattctcctgcctcagcctcccaagtagctgggattacaagcatgcaccaccatgtctagctaattttgtacttttagtagagacaggatttctccacgtgggtcaggctgatcataaagttccaacctcaggtgattacccggcctcagcctcccaaagtgttgggattacaggtgtgagccactgcacctagcttttgcctactttttttttttgagagagagttttgctcttgttgcccagactggattgcaatagcgtaatcttgaccaactgcaaccttcaccttcgagtgattctcctgcctcagcctcctgagtagctgggattacaggcacctgcaccactcccagctaattttttgtacttttagtagaaagggggtttcaccatgttggccaggctggttttgaactcctgtcctcaagtgttctgcctgccttggctttccaaagtgctgggattacatgcatgagccaccatgcccggcctgcctactttttaatgaggttgtttgtttttttcttgtaaacttgtttaagttctttttttttttttgtgagatggagtcgcttagactggagtgcagtggcactatctcggctcactgcaacctctgcctcctgggttggagtgattctcctgcctcagccttctgagtagctgggattacagacatgtgccaccaccacaccctgctaatttttgtatttttagtagagacgaggtttcaccctgttggtcaggctggtcttgaactcctgacctcgtgatacacccgccttggcctcccaaagtgctgggattacagtcatgagtcaccacgcccagccaagttcttaataaattctggatattaggcctttgtcagaggcaaagtttgtaaatatttttgtttattttgtagattgtttactctgttgatagtttcctttgctgtaaagaagctctgaagttcaaataggtctcatttgtcaatttttgcttttgttgcagttgctttgggtagcttcctcatgaagtctttgccagtttctgtgtctagaatggtatttcctaggttatcttgcagggtttctcataattttgttttacatttaagtctttaatttatcttgagttgatttttgcatatggtgtaacgaaggggtccagctttagtcttctaaaaaatgctggctagttattctagcaccatttattaaagagagaatccttcccacatttctcttgtcagctttgtcaaaaatctgatgattataggagggtgacattatttctgggctctctattctatttcattggtcttgtgcactcatggattttatataacatctttctctcttctggttttaaccccactaacgttctttcaagcgcatacagtatgcaaaactcaggtgtccaagagttcaaaactccttaaaaacttccaaaaaaaggccaggtgtggtggctcatgcctgtaatcccagcacttttggaggctgaggtgggtggatcacgaggtcaggagatagagatcatcctggctaacatagtgatacccatctctactaaaaatacaaaaaaaaattagtcaggcgtggtggcgggcgcctgtagtcccagctacttgggaggctgaggcaggagaatggcgtgaacatgggaggtggggcttgcagtgagctgagatagtgccactgcactccagcctgggggacagagcgagactccgtctcaaaaaaaaaaaaacttccaaaaaaatttttgccattgtctcatttcttaagggatttagattatatatagttatttttctctgatttttaaaaatatatgtaaattatattaacagctaaataccttttgtcttttttctgactccagattatctagaacttcagatttattgctttgtttttggttccaaaaagtttattttttaatttttagtcctttaaatagacacagatttatttagataaaagctaattttaagggcacacagaagcttagcacaaagataggatcaaatttagcaatacataatggtaaacattaaaagatactatgtttctttgacagaaaccagattatccaaggaaattatccaatatttgcaggctgaagtacttatactgcaaaaagaagaacagttcagtgcgtaaactgaacagtggagtctgtagttgtgcctggctttctatttattacttcagaataattagcatagttatgtgtaatgtttgtagacaagctgcatttatatacatttaacagtattttgtttttctttctttctttcttcttttttttttttgagagagtctctgttgcccaagctgcagtgcagtggcatgatctcatctcactgcaactgctgcctcccgggttcaagcgattctcctgcctcagccttccgagtagctgggattacaggcatgcatcactgttcctggctaagtttttgtatttatagtagagatggttgtcaccatgttcgccagtttgatcttgaacttttcacctcaggtgatccacccatttcagcttcccatagtgctaagattacaggtgtgagccataaacagtattttctaaaatagtatgaatataaagccacaatacttactttgaatgaatcacttaaatggttattttaatattgtaatttatacttttgaaatatagtgttttggctgaagtatagttttaattattaaaaatgctacatatattatgactagtgagtaaacacaattttagtgtcttttatttcattaaattggtatgctgctattacaggacaaataaagacatgtgatgtggccacccaaaaaccataatagctcttcagtttgctatgttgcaagttctaatatattccactatatgaacatagtcagattctatttcttcatcaaaaagtgttgttggaagttgtcagatgtatttcaatatagaacctccattcaatggctaggagatgacagaacagcagagatgggaaagaaactttataaaaattcttctgaaaatctgccacctttcttcataatgctcatgtttctcttgctgagagtagctgtgcgctttgggtgtttagagagaaattgcttttaggagaatattttctggcagacatgatcaattttatatctaatctgagctttttcctaatatcattttaacttttttctctccagtgctttgggtgtctgtttcagaagccctattaatttttttttttttttttttattgatcattcttgggtgtttctcgcagagggggatttggcagggtcataggacaacagtggagggaaggtcagcagataaacaagtgaacaaaggtctctggttttcctaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaacactgagtggacacagcacatgtttcagagagcacagggttgggggtaaggtcagagatcaacaggatcccaaggcagaagaatttttcttagtacagaccaaaatgaaaagtctcccatgtctacttctttctacacagacacggcaaccatccgatttctcagtcttttccgcacctttcccccctttctattccacaaaacagccattgtcatcatggcccgttctcaatgagctgttgggtacacctcccagatggggtggtggccgggcagaggggctcctcacttcccagtaggggcggctgggcagaggcgcccctcacctcccggatggggcggctggccgggcaggggactgaccccacctccctcccggacggggcggctggcctggcgggggctgacccccacctccctcccggacggggtggctgccgggcggagatgctactcacttcccagatggggcggctgccaggcagagggtctcctcacctctcagatggggcggccaggcagagacgctcctcacctcccagacggggtcgcggctgggcagaggcgctcctcatatcccagacggggcagcggggcagaggcgctccccacatctcatacgatgggcggccgggcagagacgctccttgcttcctagatgggatggtggctgggaagaggtgctcgtcacttcctagatgggatggcggccgggcagagaccctcctcactttcagactgggcagccaggcagaggggcccctcacatcccagacgatgggcggccaggcagagacgctcctcacttcccagacggggtggcggccgggcagaggctgcaatctcggtactttgggaggccaaggcaggcggctgggaggtggaggttgtagccagctgagatcacgccactgcactccagcctgggcaacattgagcactgagtgaacgagactccgtctgcaatcccggcacctcaggaggccgaggctggcggatcactcgcggttaggagctggagaccagcccggccaacacagcgaaaccccgtctccaccaaaaaagtacgaaaaccagtcaggcgtggcggcgcgcacctgcaatcgcaggcactcggcaggctgaggcaggagaatcaggcagggaggttgcagtgagccgagatggcagcagtacagtccagcttcggctcggcatcagagggagactgtggggagagggagagggacagggagagggagagtcgaagccctattaattaatcccatgatttctgattaagctaggctgtcacagtgagaacttttggagctatctctatctggactcatgctggaaattcagcagtattttttccttgtcaccattataagtagaaactgaggttgaaacactgctctcattttcattattgtgaatgtgtaattctacccaggaggcctgcaggctctcctcctgcagctcaggcctcactctctgatgtgacactagagtgctgctgtggcaaatggggttcatataaaatgtgagctgtgctctgggctgtgcctcagtggcagatggtagaggtcaagagagcatactagcaaccaggagaaagcaagcaggagtgctgtagcccactgccagtgagtacagagccactcctctaaactgtaactagccaaaatatagaacactattcaaccatttttgtagcagagtgaaatcttagcttcagcaggtacctgacttcaagctgctaaaataactcctgttatgaagatgtgaaaagtttatttgtcattgaatataagcaattagcatacacagatggcctcttcaatttccaggtagatttaagatgaacgatgtatgacatggtgctttaaattcttctacttatggactaattatgttgaccatctttctgtcattgcagtctcttaagcagatggactatgatgcatgtcacattcaagtttaattgtaaaataaaaacgtttgttttttgagatggagtttcactcttattgcccaggctggagtgcaatggtgcgatctcagctcactaaccccgcctcccaggttcaagtgattctcctgccttagcctccctagtagctgggattgcaggcatgtgccaccatgcctggttaatttttgtattttttagtagagagggggtttgtcagtgttggccaggctggtctcaaactcttgacctcaggtgatccacccgcctcggcctcccaaagtgctgggattacaggcacgagccaccacacccagccaaaacgttttctttctgttctattattgtggagtttttctggggctgtaaacatttgttctttttttttgagacgaagtctctcatcccccaggctggagtgtgatggcgcaaacttggctcgctgcaacctctgcctcctgggttcaagagattctcctgcctcggccctttgagtagctgggattacaggtgcctgccaccaggcccggctaattttttttttgtatttttagtagagatgggttttaccatgttggccaggctggtctagaactcttgacctcaggtgatccacccgcctaggcctcccaaagtcctgggattatagacatgagccaccatgtccagcgaagaaaattgttcttctcttttttttctttttgagacaaagtctcactctgtcacccaggctggagtgtgctgtggtgccttctcggctcactgcaagctccacctcctgggttcatgccattctcctgcctcagcctcctgaatagctgggactacaggctcccaccaccacacctggctaattttttgtatttttagtagagatggggtttcactgtgttagttagatggtctcgatctcctgacctcatgatctgcctgtctcggcctcccaaagtgctgggattacaggtgtgagccaccgcgcctggccaaagaaaattgttcttctaattattgtttccaaacactgtctagaattaccagacatgatataaacacataaggtgccaaccagaatttagcaaggcctttccctgtcaggcttccagtcaattcacacttgtgcagcaaagtgcatgctgtcccctaaatatgcaggcagaattgtgtctctatttgttatctatagtcctgtacattcacttctagagaggctagatcagatttctacaaatttcatagggcagcaatcaatcattttatctctttcaatgactcctgtatcttcagacttgaaacagattcagagaccatggggcccacaaacccagttagagtaacatgtgtgcattgagtagacatgttgacaagagaatctccactttcaccttcctcctcttgctaaaatgctcacaaatgtgcaggtaacacctgctgctcctcctgccattcaggccctaaatctacagctctatattttgaatccagatcttgagatttgggaaataaaaaacttttgtctaaataaagcaggttcttttggttatcaaactcagagacatgttaaaatgaaagtgcagttatgtctttctcccactttgaacgatgtattcatctattgaaactgttcactattggcacaagtgactataaattaaactaatgatgccacattggacactatcccatgccctaaaacataatgatagatatctaatcaataatcaatgttatttatgtaaataaataaaaacttttgacaaacaactctgcatcagcccactttctgtccctgtcttgtcttgacatatcttcctgtaaatactactaatcaaagtgtagattccaggcaacttgaatctttgctcccaggttataacccttaagcttgacccaaataaactgtctacttatattcatgttatgtcaccttttttttaaatgtagacttattatttagaatgtgttagagcagcctctatgagagctctcttttgactgtactccacttggtgtaacacaaaaggatgcagagccaagttgatcctacctagaatttgcagataaggtctgccctctgcctgggatttaaaaaaaaaagccagactttggatagagaatgtacagaaaattaacaaaagtcattttctgcattgtaagttgtcaagatagatatcttacaggccccatttgggagtgtggcattttgagatttttcacatcttgttcattggcctgctacagtgatgtgagaggctccaggaggaaatagaatctgatggcagaatctgtaagtgtaaataatcatcttaggagtgagagatcaaggccacaaagtatccagagccttgatcacaactataattacctgtaaaatgtgatactggagtagagtatttttgtttctttctctcatccaagagctagcaaatcaggacagatgatgtaggttctggagctccaccaaggcagttgttttctattcagaatcagcctgagtttctccagatggcttatcattgggccaacagccctggttcaccaggaattccctcacaatcacctaggtgtctttgaggcatttgaggatgtccagagcagaattgtgttaggctgacaagagtggttaattctgcttctgtctcagtgtaagagaaatgagtcatcctgtgttcattcatgccctcatacaagaggtgccttttttggtacccagatcagagtttctccagtttcctggtacttggatgataaacaaggaggagatctggagacccaaatagataaactagttgcttccatttcatatggccattaaaaaaatacgtgaagcagtcatggttcctacagtccagaaacttttagtctagaccagcaactggataaataattgaattgtgcattgtatggttggcacaatatatagatgtgtccagaaccttgggttttatttaggccactttatgccgttatgacttctgaattgtacacctgaagggatatttatgaatagaataattgttattataattttttttctttagtcagaatctcactgtgttacccaggcatgagtgcagtgacatgatcttggctcaccgcaatttctgccacttgggttcaagcgattctcctgcctcagcctccaaagtagctgggattgctggccccagccactgtggtcaggctggtcttgaactcctgacctcgtgatccacccaccttggcctcacaaagtgttgggattacaggtgtaaggcagtgcacccagctgtataatttctacttttttttaccttctaaagtgtacatattgattttctaataaaattaccctagaaaaccttaagggatttgtttaaattgtgtattagtatatagtataaagttgacagggcagtggctagaaaaattaaaattataggaactctgggatttaagtttcttttaggtaagcttagaagaaacaaaactggaagtaccccagtggcatagagaacagaattctacataagtcctcacactgcctgagacctgatcagattcatgctttttggaggcgttatttaggtctgaccctaccctggagtcttgcctcacaggactgattagtagagatcagagttttggctggtgaatcctgctgcctttctagagctggtgctcacaattccctgaatcccaaaagcagatgaaagggaaaaatagtccgggcgcggtggctcacgcctgtaatcccagcactttgggaggccaaggcgggcagatcatgaggtcaggaaatcgagaccatcctggctaacacggtgaaaccccacctctactaagaatacaaaaaattagctgggtgtggtggtgggcgcctgtagtcccagctactgaggaggctgaggcaggagaatggcgtgaacccaggaggcggagcttgcagtgagcccagatcgcgccactgcactccagcctgggtggcagcgagactccatctcaaaaaacaaaaaaaaaaaaagggaaaaataaagtacgtattttagggtcttagtttttaaattttctgttaaagccagtgtttgcagagacattctatttagcaacttgttttctattcttgcagatccagtagttgctccacaagtcacagaaaagtaaatatgaacagaataaaattttctctaaattacattaaattattcctttctatctctttcatctgtctatattttgcttttacagtgttttaaaaaaattcatgacagagaaacagaagaagaaataaaaatgccgcaccctttacctaaatcctaaagtttattaaacacttagtaccagctttcagggtgttatgagaattaaatcacagaatgtgctatgcccagcacagtgctctgtatcattctcttgagcacaaagtacctgcttaataaacattgcattagtacttgtgtacatgttgttttttaaatacagacttactctgtcatttctgccttcagtttcctctataaactttaaagagccagcgaagcatataaaactttagggtggagatgcgttgtccctatttgtatcagaagtatttggttgtgaaaagagtgctaaatgtaagggaccctgtgctgttcctgctttctctaactaatgctaataatgagccaaggggaagcaacttcagcattgacaggggacttgtttaaaacacccattcatggacccttttcaagcctccagaatcacattacataaagtggacccaaaattaccaagtgatttataagcccattaaagcttgagaggcaatgcttagcttagtgattaccagcccaggcttttccttaggaacacatggccaatttgcagaaacctcttgtgccctccccacagcttctgtttgttctgcatggaagcacttatgttgttttaatgaagggtctcatgtgactctaaggtgaggccagaatcaagtatgagcacttcaaaatacaatacaaaggagttaagttccacctttgcactaaagggtggtcacagggcctgttctgtttgggtttggtacagacaggtcagtgtggtgcataattccattactggaaattgctggtgtctgtggcagggagggcacctgaggacaggaaatgagaaacttatatttctatcttcatggagcaattcattgttccctgaatctcttctgtttcaaaggacagaaataggtgggctttttctgtcattttgccagttgatgtcatgccagcaggtaatcatgtgttactgatacctttaaaggcatgttctcaagatgcaggtgtaatttttccagagaatctcatctgagaaggaattccagaggaggaggaggagaaaaaaaagtggctcttcttaaggtaaacgtgtctcagatgaagagctgtgtccactctgcctcctggacccccatgagtttagtactcacaaacctttacttctctacttgtgttttccctccctgagtttggttttactacttaaaattcttatgatagtcaagggtctctgaaaaatatttctttcctatatcccagagctttctctgcattctctatgtcatagcttcttatatgccatgcagaattctcagcaagaatttgtaatctgcaatattaaaaatgttccctttgtggctgttgaacatggaaagatgtggatactcaagatttctgttggggaaaattgtggtccttagtatagatgaagaacatgtaatgttgaggcttcatctgtatgttccattagctctatgcagaacaggattaagaaaatgcttttttatatggaatggcatttattatccagaaagttctgaaagaaattattaggagatacctgctctcttgggtgctaaatgaagcctacttaaaattactactaaaaattacagaacataggagttatcaaaaactttgaagttagcataaaacatgtttctttatggttaaattcagattttatttactttctttgggaggaatatttcaacagtgatgctgtgttcttctgtgtgaattaggacatcataaaaatttatcgtagtgcagttaatggttaatgattcagttggtgaaatagctctctgacagatttttttcactatagagataattatttttctattcattattatgtttatgcagctgatatgcataaacctcacattaaatctggcagctttcttttttaaacatatttttcttagggaaatgaagcctcttatctttgtttacaggctagaaaatctgaaaaaaacacaggctcttgcacttactgcatttgacaaaatatcatttttgggacaaaaacattaacattattggtgagcttgttagaaattcaaaaaatcagactttatgccagatcttttggaaaaaaaaatcctgcataagaaggacttcagcttattgtacatgttaaaattggagagatgacttctaactcaacatgtcttttctgtctgaaaaatattcataactgattctgtatgatgtaaatatagcactcaaaaatgtacatgttcatgttcatgccctttattttatactttattatctagaaaaatatcattatatgaactaatgttgtggatcttaggctgctcttttttttcagagatagagaatacattagaaaatatttctgtattgaaaattattttattggataattttagtcaatcctataagtaagaatcagttctcttactctctcatttcaccttaaattaaaaattccaccaacggcgacttggtgaaaatgtgtgtgtgtgtgtgtttttcaggaatcattgcaatttagagatgtggctgtagaattctctctggaggagtggcattgcctggacactgcacagcagaatttatatagggatgtgatgttagagaactacagacacctggtcttccttggtgaggataacttaaatacataattcataaaaaaccccaaaagttttatttctcttttttgcagaatgattttagtaatttatcctttgcataaaagagttccagatgtcctttttccagaaaatcttcagaatttgtttatttagaaaagaatttcttcaagatgtttcatcttaatccaaactttccacattgctgagttgagctttattcttcactctaaattagtggtaatttcagaaatttagtggcataaaatagtgttgccctcagctgaaaatctcattgccaccatcagtttttgattcagtagtatcaggtagtaaatttaaaaagccttcatgcagggccaggcgcagtggctcatacctgtaattccagcactttgggaggctgagacgggcagatcacctgaagttgggagtttgagaccagcctgaccaacatggagaaaccccgcctatactaaaaatacaaaattagtcgtttatggtggcatagtcctgtaatcccagctactccggaggctgaggcaggagattcccttgaacacaggaggcagaggttttggtgagccgagactgagccattgcactctagcctgggcaagaagagcaaataccactctaattttgataggaagtttattgaatctatagatcactttggataatgtggcaatttaaaaatctatttggatcttctcttcgtagatttttattgtaaagattttttaccttcttagtaattttttaaagaaatttattatttaatggtatagtaaataagattttttctttctctattttatcagatagtttaagtgtttgagaccatacatatacttgtatgttaattttatgttttgctaatttgctgagtgtatttgtcagtttagaaaggttttaaggtattgtttatgttttttttttttttttttttttttgagatggagtctcgctctgttgcccaggctggagtgcaatggcatgatctcagctcactgcaacctctgcctcctgggttcaagcaattctcctgtctgagcctcctgagtagctggtactactacaggcacgtgccgctgcacccagctttttgtattttagtagaaatggggtttcaccatgttggccaggctggtctcaaactcctgaccttgtgatccacccatcttggcctcccagagtgctaggattagaggtgtgagccactgcaactggccctatttatggtttttaaagtactgcttaatgttttttaaatataagattgtatgatctataaacagcaactttttacttattttactccatctccaaaaaaaaaaaaaagaaaccttaaagttgaaagtattttctaaatatttagaaatttgttatgaattagtattttggtattaatttactagaatattttattacattctttctgctgagcacattactagcttgtaattgagaaatataagcaagattaatgctatttatttttaatgaaacaggtattattgtctctaagccagacctgatcacctgtctggagcaaggaataaaacctctgactatgaagagacatgagatgattgccaaacccccaggtaggtgcgaatgaaaatgaacacaacagacaatgcagataagaggtcccaaggtcaaaaagaaagccagtccttaaaatgtgatctgggaagctgtgttccaaaggaaatagttcctgggcagctgttttatttatttatttatttatttaatttttctctcacaaagggacatctgtctcatgcttttaaattctctaaggattctactattctttcggtgagcttccttcaagttcacagtgagagcgaaattcctctttatggcatataagtgattgcacaatctggctgcttttccgttgccttggggacacacaaatatctgcgtgattttgagaaactaaaacccttttttaagttgtctttttgcttcagatctgaaatgtgtgacagtattagtttttgttgcattttttgttcattttttctgcacagtccattctgtttttattactatatagtcttgaaatatagtttgaaattataagtatgatatccttctgctttgatctttttcctcaagattgctttggctatcaaagttattttagtatcacgtaacttttagaaatgtattttccattactatgaaaaaaataccactgcaattttgataggaggtttattgaatctatagatcactctggttaatacggcaattttaaaatttatttggatcttctctaatattttcataggtttttttttttttttttgagaaggagtcttgctctgttgcccaggctggagtgcagtggtgtgatcttggttcactgcaaactctgcctcctgggttcaagcaattctctgcctcagcctcctgtgtagctgagattacaggtgcatacaaccatgcctggctaattttttttgtattttttgtagagaggggtttcaccatgttggccaggctggtcttgaactcctgaccttgtgatccacccacctcagcctcccaaagtgctgggattacaggcatgagccaccccgcccggcccatagtttttttattgtaaagatttttttacctccttggtttttttctaagaagtttattacttaatgctatagtaaataagatttttttcttcctctattttatcagtttgttttaagtgtatgagaccatacatacacttgtatgttaattttatattttgctaatttactgagtgtatttatcacttcagacaggttttaatgtactatttattgatttttaaatacaagattatacgatctacaaacagcgactttttacttatttttctttaatttcaatggatttttttatttctttgactaattcttctgccacatgcttccagtgctacattaaaatagaagcattgacaatgggcacaatatagttttgtattggtgcctaaatttgatggagcaaacacctcttcaagtttttttttttttttttttttgagagagtctcactctgttgcccaggctgcagtgcagtggtgcagtctcagctcactgcaacctccacctcccgggttcacgccattctcctgcctcagcctcccgagtagctgggactacaggcgcccaccaccacacccggctaattttttaaaaatttttattagagacagggtttcaccgtgttagccaggatggtctcgatctcctgacctcgtgatccatccgcctcggcctcccaaagtgctgggattacaggtgtgagccaccacgcctggccttcaagtttttataaactgattttagaaggtaaagatcttttgttgggcccttagggtgatgagatgccctctgaatttgtagtggagagggggtgtagcttggtgacaaggctgctgggtctgcactagggtccacctttagttggcttgttacaggggcttgggtagttgtacttctcattttatttttggacagactgcatatccttcagggctttgctccgtagttaaaacactagggtatgtttttgtagtcaggtctgcatatggtgggccttatatctggatattgatgagtatggcttttattgagtatcagagagcattccctcagataactgtgggtttctatataggcagaactgaccataaactatcttgtttaagtgagtagtcatggagatagtcttttttttcaccatgtgtttaatgatgaatatatatttccttttgtgagagaaatacttgtttgatttgaaggtaattttcaaaaagatttataattctggattttttttcagtttttctttaaaaaaattgttttaaaaacacataacataaaatttaccatcttaattcaagtgtacattttcagggccaggcatggttgtggctcccatctgtaatcccaggattttgggaggccaacacaggaggatccctggagcccaaaagtttgagaccagcctgggaaagatatggagacccctctttataaaaataatttaataattgccaggcatggtggtatgcagctgtggtacctgctacttgggagatggagggggagtcaaaattgtgccactacactccagcttgaatgacagagtgagaccctgtctccaaaaaacaaaaaaaagctgttcatttcaggcatgttaagtatattctcattgttatgtaaaatacttctagacactttacatcttgtaaaactaaaactcaatacccattaaataacaactgctcattttaccctctctcaccctcgacagacaaaccttccactttctgttttatgatttgactacttaagatatccataattttgttactggattaattcaagtgacataatattctcaatgttcatcttaaaatgtgacaagattattctttttaagatggaataatattccattgtatgtatatgttacatattttgatgtgtttataaatcaagagacatctgggttgcttcaaccttttggcttttgtgaatactggtgcaataaacatggattttcaaatatgtcttccaggtcctgtgttgcttttctttttttctagagatggattctcactctgtcacccaggctgaagtgcagtggtgtgatatcagctcactgaaacctctgcctcctgggttcaagcaattctgcttcagcctcccaagtagctgtgattacaggtgcccaccaacacacccagctaattttttgtatttttagtattatggggtttattatgttggccaggctggtctcaaactcctgatctcaggtaatcacccaccttggcctcccaaagtgctaggattacaggcttgagcacctgggcctggcctgtgttacgtattttgtaaatagatataataagtgaggaacatttataacatttttaaataatggctgcatctttgttttccagcaagaagcaacatgggtttcatttttattgcaacatcaacagattgggtgtttttaaaaaaatttacagtggccattctaatggatatgaggtgattttgtttgtcattgtgtttttttaatttctctacaaatcagtaattttgtgcattctttcaaatgctttttcccatttgtgtagttttttgatgaaaaatctttttgttcatttttaaatcaagttattgaactttattgattagttttaagagtttttatttattttgaacattaacttccttcacatgaaatctgcaaatgttttcatccattttctaagggatgttgccacttttgaattttcttttgatgtacagaaattttgatgtctagtgtagttaaacttttcttgtatttgttgctcatgcatttaatgtcgtatctaagaaaatggtggcaagaccaatgtaatgtccttttcctgtattttttctaatagatttgttagtttctttatgtctaagtattttgtttaaaatatatttttgtatcgttcaaggaaataacccaattttattttatcagtgttgatattcagttttcaacatcattttttgaagatattacttttctctattttgtactcatagcaactttttgaaagaccatttgatcatatatagaagggttcatttctgagctctctattctggtctttcatctgtttatctttgtgtcagtatcacattgtttatgttactgtagcctttaactgtaggttgtattgacatctgtgaagaataaaattttttgacccctgagcaagaatatgttgaatcagagtgttttatattcacatatttttgaatttgccaatttaccttttgcttttaattcctagtgtcattcagtttttgttagaaaacacacaatgtataattttagtgtttttaaattgatttgttgttgttttaagacaagatcttaccaacaccaaggctggagtgctgtggcataattttggctcactatagcctcagcctcctgggctcaagtgatcctttcacctctgttttctgaccagcttggactacagacatgtactaccatgtctgcctaattgtttgcttgtttgcagtgttaggatctcattatgttgtccaggctggtctcaaacttttggccctaatggatcctcttacctaggtctcccaaagtgttagggttataggcaagagccactgcaccccgtcagtacttttaaatttaataaaacttggtatgtgtcctaacagattataccagatgcaaataagaatattgtgtattatcttggttttgactggagagttttgcttgtgtctgtgaagcctagttggtctataatatggtttccatgttcatgttctccagacctcatgctgcaaaataaatcttcaatgttggatgtgggacctggtgggacatgtttgtgtcatggaggcaaatttctcatgaacggcatggtacatcctcttggtaaccaaaactttacactctattaattcaaatgagagctggttcattaaaagaacctggatccttcacctcacacttgctctgtttcattaacatatagtatgtccaattactctttaccttccaccatgattgtaagtttcctgaggccctcaccagaagcagatgctagcacacacttcttatagtctgtcaaactgtgagccacataaattatttttctttaaaaattatgcacttggctgggcacggtggctcatgcctgtaatccctgcactttgggaggccgaggcgggtggatcatgaggtcaggagatcgagaccatcctggctaacatggtgaaaccccgtctctaccaaaaatacaaaaagccgggcgtgctggtgggcacctgtagtctcagctacttgggaggctgaggcaggagagtggcgtgaatctgggaggcggagcttgcagtgagctgagattgctctactgcactccagcctgggcgacagcgagattccttcaaaaaaaaaaaaaaattatgcactcggctgggggcggtggctcacacctgtaatcccagcattttgggaggcccaggtgggtggatcacgaggtcaggagatcgagactctcctggctaagacggtgaaaccccgtctctattaaaaatataaaaaaattagccgggcatggtggtgggcgcctgtagtcccagctactcgggaggctgaggcaggagaatggcgtgaacctgggaggcggagcttgtagtgagctgagattgcgccactgtactccagcctgggcaaaagagcaggactctgtctcaaaaacaaagaaaaaaagaaaaagaaattatgcagtctcaagtattcctctgtatgcaaaataatatggtctataatgttgcgtaagttgtctgtttctcattttttctctgaattttctatttattattgcaaatggggtcttgatgtctacaatttttatgttgctatgtatgccttgcttcacttttgtcaatatttgctttatatattttggagccctgatgttatatacacatatacatatagatagataaataatatagttaccgattcctggtaaattaactcactttaccataatataatatcattctttgtctaatggtagtatttgacctatagcatattatgtctaatataattgtgaccacctcactcaattgtggttactatttttatgatatacacatttttttccttctgttactttcagcctatttgactcaatgctacaatgagtctcttgtaggcagcatactgtatgcttttaaagaaaccactgaggcattctatagctttttcttcatatgtatatatttatttatgtatttattttgagacagagtttcacttttgttgcccaagctggagtgcaatggcgtgagctcactgcaacctctgcctcccaagttcaagtgattcttctttgtcagcctcccaagtagctgggattacaggcacctgtcaccatgcccagctaatttttttgtattttaggtagagatgggattccaccatgatggccaggcttgtcttaaacttctgacctcaggtgatctgcccgcctctgcctcccaaagtgctgggattacaggcatcagccaccacgcctggcctcatttaactttgagatagggtctcactctgtcaaccaggctgatttgcatgattcactgatgccagaacctccaaaactcagatgatcctctcattttagcctctcaaacagctgggttacaagtatgtgtcatcatagccatctatgttttttgtattttttgtagagacagagttttgccatgttgcccaggctggtcttgaactcatgggatcaagtgatgagcctaccttggccttccaaagtcctaagattacatttgattttattaagtagtataattaatttatatttacaatgaataaacaaatgaagttgtcattagcagttagattgttactgttttatgtgtttctagtagttatatttttctcatctcctgttttactttcttaattttcattttattttgtactggcatgctttcattactttttatcttcttttgcatactttctataaatattatctttgtaatcatcttgaaaactggagattacatacatcttaaagttaaaacaatatgtttcaatctcataacttcaactgaatacaaaaactatgcctctatattttatggtttgttactgatataaaaattattttatatggtgtatctattaacatttatgcagatttacatatttcttatattttattaaaaaactttaaagtttttatgtaccatcttttttttttttttgaaactgggtctcactctattgcccatgatggagtgcagtggtgtaatcttggctcactgtaacctccaccaggcatggtggctcatgcctgtgttctcagcactttgggaggccgaggtgggtgaatcagaaggtcaggagttcgagagcagcctggccaacatggtgaaacgctgtctctactaaaaaatacaaacattatccgggcatgctggcaggtgcctataatcccagctcctcaggaggctgaagcaggagaattgcttgaacctagaaggcggacgttgcagtgagccaaggtcacaccactgtactccagcctggacaacagagcgaaactccgtctcaaaaaataaaaaaaaatatgtcttttgattggaaagatgattatatatatatttaaatcgttttctgcaatagaaaaacttactgttatttttattaattgttttatttgattcttctatctttttcactcattttctgtcttttttgtgtttttttaattttttgtattgatatgctttcagtttcttattttcttttgtgtatctatacagctattatcttagtggtaacatgggggattacataaaacctaaaagatccaacaatatatttgaatgtggtaaaaaaattaacttcagttatatactgaaattcttcatcattacatttgccttcaactttgttactgattttgctaattatattttttatgttgtatatttattaacagatgttaacaataatttctatacttttatcttttaaatttagagagtattaaaaatgttttctgtaccattatgatgttaagaaattccatttttgtgtatgtggatatcttttccagaaagttatgtattttcatagattatctgttgttttcttgcattatgttattttcagtggaagaaactccttttagcatctttgatgtgtatggtgtatgcagtgccaatatactttctcaggatttggttattttggaagcacttgttttatttggtagtacaattttgctgatggcattattgcatttgacagctttttaaaaaaattattataactttagcaatatcacagtttttttctgacgtgtaagaatgttttaaataaattcactggtgccggttgtggtggctcacgtctataatcccagcactttgggagactgagacgggcagaccacctgaggtcagaagtttgagaccagccaggctaacatggtgaaaccctgtttgtactgaaaatacaaaaaagtagccaggcatggtggcgcacgcctgtaatcccagctactcaggacgctgaggcaggagaatcccttgaacccgggagttggaggttgcagtgagccaagattgcatcattgcactccagcttgtgcaacaagattgaaactctgtctaaaaaaaaaaaattctctggttatctcatgagactatgcttataaatggaacatcatttttatcttgtagcacccaaaattctattcttatatgtgatttttgaaattttgcttatatatgtgtttgttataaatatatttgtgtgtatctaagtttgttcattcagctttttcatgtttacatcatattttcttttaataaatttttcagttttttatattttttatatccacgattttcggttttttggtattttagtatttctttttatagttgtctgggtttctatttttttcttatacagagtctttttctgtcaccgaggctggagtgcagtggcgtgttctcagccaggctgatcttgaactgctgacctcaaatgatccacccacctcagcctcctaaagtgctgggtttacaggcatcagccactgcacccaacctttttaattttatttttgagacagtgttgctctgtttcccaggccgcagtacagtggtacaatctccactcactgcaacgtttcccgcctggattcaagcaattctcctgtgtcagccttacaagtagctgggattacaggcacatgtcaccatgcccagctaatttttgtatttttagtagatacagggtttcaccatgttggccaggctggtctcaaacttctgacctcatgtattttcccaccttgatcttccagtgtgttgggattacaggaatgagccaccaacagtgggatgttcaattcatttggaattttaaaaattactttgtatactttttatggttgcttttgaaaagtttataatttttttgatggggccatgttctaatatttggtatacattatcatctttgatagagatttggaaattaacaaaaagctacctgttacaatctttataatatagctttgtcctggcgtagcatgaaatcaattgtcttggctagagattctgggaatttttcaaacatgtttttaggatgagtcttgtctaaaattttgtgtttattgtttagttaaatcagcttattcatatctcttcttaatagtcagtaatcacctgctacacccattccctgtttgcagtttctctgcttctctataatttacctttagactcagcaaactcaaactgtcattccaatgtatatcaccatttttttttagcattttatgtcatgggacacattatctggtgtctaaaaaagcccctagaagacaaataaagatgtatgtgccaatgtttcttgttttttaaaaaggaaaccaggagttggcaatttacatttttgtgtgtatgtgtgagacagagtctcattctgttacctagtctcaagtgcagtggcatgatcttggctcactacattctctgcctccacagttgaagcaattctcctgcctcagcatcccaaataggattacaggtaactgtaaccatgcctggctaatttgtttgtattttagtagagatggggttttaccgtgttggtcaggctggtctcaaactcctgacctcaggtgatcctcatgctttgccctcacaaatttctggaattacaggcatgagctatcatgccttgttggcaatttactttaaaaaaaaatttttttttgagatgaagtcttgctctgtcgcccaggccggagtgcagtggtgcaatcttggcttactgcaacctccgtctcctgggttcaagaaattctcatgcctcagcctcctgagcagttggaattacagcggcccatgaccatgactggctaactttttgtaattttagtagagatggggtttcaccatcttggccaggatggccttgaactcctgacctcaagtgattcacccatctcagcctccgaaagtgctggtattacaggaatgagccactgcaccaggttggcaatttacttttaaaggcacaatgttatactggagagcaggaagagctgttgcatataagtaacagaattttctttatcttctatgtgactgtttgcattgtgctcacctagggactttcacacacttaaaactcacttataaattttttacaaatgtattttggtcagtatgtttttgttacctttatatgtccaggaagaaattacagcttgtggcattttgctatgtcatcttgcttatgtagtttgtataattttataggttagatttgtaaagtatatttatctgagtctagcaattgaagtaatgtgtttttattgtttctttcagttgtgtgttctcattttgcccaagacctttggccagagcagagcataaaagattcttaccaaaaagtgatactgagaaaatttgaaaaatgtggacatggcaatttacactttaaaaaaggctgtgaaagtgtggatgagtgtaagttacacaaaagaggttataatggacttaaccaatgtttgacaactacccagagcaaaatatttcaatgtggtaaatatgtgaaagtctttcatcaattttcaaattcaaagagacataaaagaagacatactgaaaaaaaacctttgaaatatatagaaggtgacaaagcttttaaccagtcctcaacccatactacacataaaaaaattgatactggagagaaaccatacaaatgtgaagaatgtggcaaagccttcaaccggtcctcacaccttactacacataagataactcatactagagagaaaccctacaaatgtgaagaatgtggcaaagtctttaagtacttctctagctttactacacataagaaaattcatagtggagagaaaccctacatttgtgaagaatgtggcaaagcctttatgtacccctatacccttactacacataagataatccatactggagagcaaccctacaaatgtaaagaatgtgacaaagcttttaaccatcctgcaactctttcttcacataagaaaattcatactggagagaaaccgtacacgtgtgataaatgtggcaaagcctttatttcatcctcgatccttagtaaacatgagaagattcatacgggagagaaaccctacaaatgtgaagaatgtggcaaagccttcacccgctcctcacaccttactatgcataagataattcatactggagagaaaccatacaaatgtgaagaatgtggcaaagcctttacatggtctgcaggcctccataaacataggagaactcatactggagagaaaccctacaaatgtgaagaatgtggcaaagcgtatactacatcctcaaatctaactgaacataagacaactcatactggagagaaaccttacaaatgtaaagaatgtggcaaagcttttaactggtcctcagaccttaataaacataagagaattcatattggacagaaaccaagaacgtgacaaaggattattttattattattatttttttgagaggtaattctgctgttgtttcccaggctggagtgcaatg

SEQ ID NO: 1494 - DNA, 79814 bp, Homo sapiens
atgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacggccgtaggctcccgaaaaggttgcttgtgtttggtatggggctgtgtcttgataggacaggagacgtagtttgggcattgtggagtagcttagggaattctttttttttttttttttttttttgagatagtctctctctgtcgcccaggctggagggcagtggcgcgatctcggctcactgcaacctctgcctcccggattcaagcgattctcctaactcagcctcccgagtagctgggattataggggcccgccagcacgcccggctaatttttgtatttttagtagacacggggtttcgccatattgacgagactggtctcgatctccttacctcaagtgatccacccgcctcggcctcctgaagtgctgggattacaggagtgagccaccgcgccaggacgtcttttgttttgtgcagttgggtgacctcggttcactgcagcctctggcctcccgggttcaagacttcctctcacctcagtcttctgagtagctgggattacaggctcgcgccaccatgcctggctaatttttgtatttttagtagacatgggttttcaccatgttggccaggctggtctcaaactccggacctcaagtgatctgcccgccacagcctcccaaagtggttggattacagacgtgagccactgtgcccagcttgttttttttttttttctttctctgtggcccagtggagtgcagtggtgggatcacagctcactgtagcctcaacctccaaggctcaagggatattccctcttcagcctcccaagtagctgggactacaggcgtgccccaccacatcatccgactaatttttgtttttttttttttttgtaggatggggttttgccatgttgcccagactggtcttgaactcccaagctcaagcgatcctcggcctcaagagatctccccccatctcagactcctaaaatgctgggattacaggcatgagctaccatgcctggcctcattgatcaatatttttacttagcctggacgcagtgactcacacctgtaatcccagcactttgggaagctgagttggggggaggggacctcttgagcccaggagtttgagactagcctgggtaatgttgccaaacccagtctctacaaaaaaatacaaaaattagccaggcatggtgacataagtttatagtcccagcttgtcaggagactgaggtgggagcatcacctgagcccctgggaggtggaggttgcagtgagccatgatcacaccactacaccccagcctgggtgacagagtgaggccccgtctcaaaaaaaaaaaaaaaatccacaagcgtgtgtatatgtgtcagttattaaaggatggtgaagtgagagggttgttttgataggttggccagggaagggctctgaagaggtaacattgagcctcagacttatatgggaaagagccctgtggtcatctgggagaactttcctagctaagagaacagcaagtgcaaattcccagaggcccaggcatgattgtcaaattagagaaataaggtggcaggaaccaaatgatttgaggagtagcttttattctaagtgtgtgggaaaacctgttggagtgttttgagtgtgggagtaacatgatctgttttttgtttgttttttgagacggagtcttgctctgtggcccaggctggagtgcaatggcacgatctcggctcactgccattgcagtgaatccgcctcccaggttcaagcgattctcctgcctcaccttcctgagtagctgggactatcggcatgtgccacaacacccggctaatcttgagtatttttagtagagacggggtttcaccatgttagacaggatagtctcgatctcctgacctcgtgatccgcctgccttgggctcccaaagtgctgtgattacaggcgtgagccactgcggcctggcctggtttgtgttttaaaatgatcgctccagaataggttaaagtggtcagaaatggaagtaaagattctggctggactgttgcagtaatccagttgagataaaaatattggtggcttgaaactcaagagaaggggtcaaataaatatattctggatatattttgaaggtagaagagggaacagaatttggggcagaagtccaggatgacaccactgtttttggcttgagcacctacctggaacgatggaattgccattttgaaagatatggagagctgtaggtttggtggggtcggggaagagtcagttctcttttaggtttcagatttgttttttttgtttgttttttttttttttgagacggagtctcactctgtcgcccaggctggagtgcagtggcatggtctcggctcactgcaacctctgcctcccaggttcaagcaattctcctgcctcagcctcccgagtagctgggattacaggcgcccgccaccatgcccagctaatttttgtatttttagtagagacggagtttcaccgtgttggtcaggctggtgttgaacccctgacctcgtgatccacctgcctcggcctcccaaagtgctgggattacaggtgtgagccaccatgcccggcctcagatttgtttttttatacaactaagtagaaatatgtgaggggttgagttcagaggtaaaatttgggtgatggtgggtattgtgtgagtacagagtatagaattaatggaggggttggggaggcagacacgtcaggagaatttagtttgagggggtgggagctttcagaaggttttagagggtgcagtggtgggatgggaattacctcaggctcatttcagatctgtggggtcttctttgatggggtggggggatgtcatcatgaggcattaacattggtgggagggttgaaggcacctggaatagattgggaattaagtgatgagaatgtgcctctggacataggtggactgcattgattttagggactgctattttctggatggagtggaaagaggatttatgtgagttggaggaaactttgaggaagcttggtgtgttctgagatcctaaagggttggggaggggattctaaggtactggaagggttaatcgaaggggtttgcggcagcagatagctttgtttgaagtggggcaaagttggtgaggtttaaactggaatgtagttagggaactttcagagggatggggatgatttttctgagaagcagtgaagaatggatgggggcctctgagtgggagatgacctaagggacaagtcagggtcagggcatggaatttgtgggaggtaggaattattctgagggagtggagctgtaccaaatttggtggagaacatgaaaaggattggctgggggttgcaggagggagggaagaggttgtttgtaatttgtactctatttttagacagtcttagagagtttattaaagtgttttttgtccattttcagccgaggtttttagaaattaaaaatttttttgtgtgagtacatagtaggtgtatacattttgggggtatgtgagatactttgatacaggcatacaatgggtaataatcacatcagggtaaatggggtatccaccaccttaagcacttatcctttgtgttacaaacaatccaattatattcttttagttgctttgaaatgtacaacaaattattgttgactgtagtcaccctgttatgctatcaaatactgtatcttattcattgtatttaattatatttttgtatccattagtcatccctccttcccctccaccccccactacccttcctagcctctggtaaccctcagtctactatctgcatgagttcaattgttttaatttttttagttcccacaaataagtgacagcgtgcaaagttttctttctgtgcctgatttatttcacttaacataataacatccagtgccctccctgttgttgtaaatgacaggatctcattcccttttttttgtagacagggtctctctgtcgcgcagactagagtgcagtggtgtgatcacaactcacttcagccttgacttcttgggctcaggtgatcctcccacctcagcctcccggtagttgtgactatagcacgtgtcacaagcccagctaatattttagtacaggtggggtttcaccaggctagtctccaactcctgggctcaaataatcctcctgcctccctgcaaagtgctgggattagaggcgtgaacagcaatgcccagcctttgtaccacaatttctatttttttttttgaaacggagtctcgccgtgtcgcctaggctggagtaggctggagtgcagtggcgcagtcttggttcactgcaagctccgcctcccaggttcacgccattctcctgcctcagcctccctagtagctgggactacaggtgcccgccaccacgcccggctaatttctgtatttttagtagagacggggtttcaccttgttggccaggatggtctcaatctcctgacctcgtgtaccacaatttctttatccatttgtctgttgatagacatatgggttgctttcaaatcttggctattgtgaagagtgctgcaataaacatgggatttattgcagttttttttcttttgagaccgagcctcgctctgttgcccaggctagaggacagtggcacgatctcagcccagtacaatctccacctcccaggttcaagcgattctcctgcctaagcctcccaagtagctgagattacaggcacctgccaccacgcccggctaatctttgtattttttagtagagatggggttgctgtgttggccaggctggtctcaaactcctggcttcaggtgattggccctccttggccccccaaagtgttgcaattacaggcgtgagccaccacacccagcctgatttattttcatttgggtatatacctagcagtgggattgcatttttacccgagtcttttttttttttttttttgagacggagtttcgctcttgttacccagactggagtatggtggcgtgatctcagctcaccgcaacccttgcctcccaggttcaagcaattcttctggttcagcctcccaagtagctgggattacaggcgtgtgccaccatgcccggctaattttgtattttagtagagacgggattcctccatgttggtcaggctgtgaactcctgacctcaggtgatccgcccgccttggcctcccaaagtgctgggattacaggcatgagccacagcccccggccttcacctgagtcttatagcagctctctggagtcggaagggcagtgatttccttctctgttcagatgaggaaggaggctccacagagcaaattgacttgcctctaagagggctctaggtgggataggagggttctaggtgggataggagaactctggagactggagttcctttatgaaacagaagccctggaaatgggcaggctgataaaatgtacaaattgtggggcattttataagacagttatcctacttctcttccaaaagtcagtttcatgggaaaaataagtgaagggactgttgtggattaaaagagagtaaaggccgtcacagtgactcagcctgtaatcccaggactttgagaggccgaggtgggtggatcacctgaggtcaggagttcgagactagcctggccaacatggtgaccgtctctactaaaaatacaaaaaaaattagccaggtgtggtggtgggtgcttgtaatcccaactacttgggaggctgaggcaggagaattgtttgaatccaggaggcagaggttttagtgagccaaggtcacactatcgcactccagcctgggtgacaagagcgaaactctgtctcaaaaataaataaataaaataaaataaagtaaagaagcagcttcctagagcagatttggttgcttaaattgaggccaagtttctggagtttttattgatagttgacaattacaactaaaatttttttttctcgctctgttacccaggctggagtgcagtgacgcagtgacgtgatcttcagctcactgcaacctccacctcccgggttcaagggattctcccgcctcagcccccaagtagctgggaccacaggcgtatgccatatcactcagctaattttgtgtgtgcatggcgtatgccgtaacactcagctgattgtgtgtgtgtgtgtgtgtgtgtgttgttttttttttttttttgtgatggactctcactctgtcgcccaggctggagtgcagtggcacaatcttggctcactgcaacctccgcctcctgagttcaagcgattctcctgccttagcctctggagtagctcggattacaggcgcgtgccaccacacctggctgatttttatatttttagtagagacggggttttaccatgttggccaggctggtctcaaactcctcacttcaagtgatctgcccacctcggcctcccaaagtgctgggattacaggcgtgagccactacacccggcctatgtgtgtgtattttatttttttatttttttgagacggaatttctctcttgttgcccaggctggagtgcaatggcgtgatctagactcactgcaacctctgcctcccgggttcaggcaattctcctgcctcagcctcctaagtagctgggattacaggcgcctgctaccgcgcccagctaatgtttgtatttttagtagagaccaggtttcgccatgttggccagggtggtcttgaactcctgacctcaggtgatctacccgcctcagcctccttaagtgctgggattacaggcatgagccactgcgcctggccagaagttaccttctttgtgcctgttttctcagctgcaaaagaggggtaacaaagtgccagcccattagattgtcatgggaattaaatgacataatacatacaaagagcttagtagaacagtgcttggcacatagtaagtgttagataaatgttggccattattattttattatgtaccagatttctataattctgctgatggacacaggtttgttttggtgtgtctattaattcacagccatttgagtaacagtatgtcctaaatgccaaggaagttactggttctagtgatacagtggtttctggagtttacattctaatggaggagggggcagtaaacatataaacaagtagtgtagcttagcacagtggtgtgtggctgtgatcccagctactggggaggctgaggttggaggatcacttgagccaggcaattgagactagcttgggcaacttagtgaggccccatttcaatcaaaacagtgggcaacacagaccccatcttaatcaaaacaaaaacaagtagcataattcgagatagaagaggatgtggacctattttaaattaggtggccagtatggacttctctaaggaggtgacaattgagctgagacctaaagaatgtgtcccttaagaagttgagggaagaagcaatgggaagcactaatgccaaggtcctaaggtgggagcaaggatgggagcaaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagctgagattacaggcgcctgccaccactcccggctaattttttttttttttctttttgaaacagacccttgttctgttgcccaggatggaatgcagtggcgccatctcggctcactgcaaactccacctcccgggttcacgccattctcttgccttagcctcccgagtagctgggactacaggcgcccgccaccatgcccagctaattttttatatttttagtagagatagggtttcaccttgttagccaggatggtctcggtcttctgacctcgtgatctgcctgtctcggcctcccaaagtgctgggattacaggtgtgagccaccgtgcccagcccacgcccggctaatttttgtaattttagtagagatggggtttcaccatgttggccaggctggtctcgaactcctgacttcaggtgatctacccaccttggcctcccaaagtgatgggatttgtaaacccagcactttgagggaggcagaggcaggaagattgcttgagcccaggagctggagatgagcctgggcaacatagtgagaccctgtgtctacaaaaaaaaaaaaaaacccataaatcagccaggtgcagtggtgtgcacctatagtcccaggactcaataggccgaggtggcgggatcacttgaacctgggaggttgaggctgcagcgagccctgatcttgccactgcccttcaatctgggttcacagaatgagaccctgtttcaataaaacaaaacgtaaacatggtatttggtgttgatggcagttgagtatttaatttaatttaatttaattttttttgagacggagtctgtcacctgggatggagtgcagcggcacagtcttggctcattgaaacctctgcctctcaggttcaagcgattctcctgcctcagcctcccaaatagctaggattacaggtgcccgccaccaacatgcccagctaattttttttttttaaacagagtctcgctgtgtcacccagactggcatgatctccgcttactgcaacctccgcctcccaggtttgagtgattctcctgcctcactgtcccgagtaactgggactacaggcgcctgccaccacgcctggctaatttttgtattttctgtagagacacggttttgccatgttagccaggctggtctcgaacccctggactcaagtgatctgcccgccttggcctcccaaagtgctgggattacaggcgtgagcccccacgcctggccataattttttttgtatttttagtagagagggtgtttcaccatgttggacaggctggtctcgaactcctgacctcaggtgatccacccatctcagcctcccaaagtgctgggattacaggcatgagtcaccgggcccggctgaataatgaattttaaacaactgcagagcagtctgtagagctatgtaggaatgtaggtcgtggagagcagatttattgtcagggactttttatatgtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacccccatggctttccatcatgcctcgaagaaaatccagaatccttccattgcatgtaagagccttcatgatgtggccccttgttccaacttttcagcctctctgtcattcctgtccctagaacatgccaagcactcctgcttcagggcttttgcatttgctgttttctctatctggaatgttctgctgccaaatatctgtgtgtttgtcctttatttcattttgatttttgctcatatggcatctcctcagaaaggcttgtatgatttctgtctcaaatagcgttctccatcattcttgattcttgtcacacttgattttcatcactttttcacatattatgtatctatttgtttatctgtctcctactttttcatgagggcagggactatgtctgattcaccgccttatttccacaccatagaaggatgcctggcatagttggtactcaataaatatttgttgaatgaattgttttgtgcagtatggattagagcctgtctctttcctagattcgaggtgtgatgcctcaatgcagttagaaccaaaatgatttttttttttttgagacggagtctcactcttgttgcccaagttgaagtgcagtggcatgatctcggctcactgcaacctccgcctcatggtttcaagtgattctcctgcctcagcctcccaagtagctgagattacaggcgcctgccactacgcccagctagtttttgtattttagtagagacggggtttcaccgtgttggtcaggctggtctcgaactcctgacctcaagtgatccgcctatctcagcctcctaaagtgctgggattacaggcatgagccaccgtgcctggcaaaccaaaatgatttgtgtattttttgttcttctgtgattctgcaagctcactgttctgtatcatcaggttaacaatgtttgtcttacaggctgcgggcctctcgggtgcttcttgtcggcttgaaaggacttggggctgaaattgccaagaatctcatcttggcaggagtgaaaggactgaccatgctggatcacgaacaggtgcgctgttgtgagctcattcctcccctgctctggctcccctttccagcatgaagatctgcagattttgtgagttcctccttgtgccttaagggctgtgaaaggagggctaacattaataaaccattgcctctggagactgaaggtgctattgttgggtttgaattctagctccaccacatctagctggatgagcagtagagactcacaccccctcattgagcttgcctgcctgtaaaatggggttagtaatatctcccttggtggttgcttgtgaggaggtgtagagaagtgtttttccaatttgtgcctaaaaatgacctgagtgactaactgaaaatgcagagtggcctggaggcttcgtggtgccctagctttcacccctagtgattctcatttaggtctgaggcgagctcaggagtatgtgcatttaaaaggtgttttagggctggacgcagtggctcatgcctgtaatcccaacactttggaaggctgaggcaggcggatcatctgaggtcaggagtttgagactagcctggccaacatggcaaaactctgtctgtactcagtatacaaaaattagccaggcatgttggtgtgcacctgtaatcccagctactcgggaggctgaggcacaagaatcgcttgaatctgggaggtggagtttgcagtgagctgagatggcaccactgcactccagcctgggcaacagagtgagactttgccttaaaaagaaataaattaatgaaaggtgtttcaggagattatgatttagatggtccacagacatcactttaaaaaacactggatcaggccaggcacagtggctcatgcctgtaatcccagcactttgggaggctgaggcgggcagatcatgaggtcaggagatcgagaccatcctggctagcacggtgaaaccccatcactactaaagacacaaaaaattagcagggcttggtggcgggcgcctgtggtcccagctactcgggaggctgaggcaagagaatggcgtgaacctgggaggcggagcttgcaacgagccgagatcatgccactgcactccagccttggcaacagagtgagactccgtttcaacaacaacaacaacaaaaacaaacaaaaacaaacaacactggatcagagagaatgtgggcagactgctttgtatagtgcttgaacctaacaagtatccagtaattaggaataatgatctgacatgctgtttgtttgtttgtgtgtttttgcgagacgagtcttgctgtgatgcccagactggagtgcaatggcgcaatctccgcacactgcaacctccgcttcccgggctcaagtgattctcctgcctcagcctctgaagtagctgggattacaggcacgcaccaccacgcctggctaagttttgttttgttttttttttgagacggagtttagctcttgttgcccaggctggagtgcaatggcgtgatcttggctcactgcaacctctgcctcccaggttcaagcaattctcctgcctcaatctcccgagtagctgggattacaggcatgcaacaccatgcctggctaatttaacgtttttagtagagaccgggtttctccatgttggtcaagctggtcttgaactccgacctcaggtgatcctcccacctcggcctcccaaagtgctgggattgcaggcgtgagccaccgcacccggccatgcctggctaagttttgttatttttagtagagatggggtttcaccatattggccaggttggtctcgaactcctgacctcaggtgatccgctggcctcggcctcccaaagtgcggtgattacaggtgtgagctaccatcccctgctgacataatgctgtttgattaatattataatggtagagcccaactccaatgtagctttctctgaccaggctcatcttcaaggtgaaaataagtgctgctctctctacattcccatgcctcagtgacattttatttattttatttatttattttgagacaaagacttactctgtcgcccaggctggagtacagtgacacaacctcagctcactgcaacctctgcctcccgggttcaagcacttctcctgcctcagcttccctagtagctgggattacataattacttcatctggttgtaagaatccaacattggaggccaatcacagaacagtgcgattctgacaccacaggtgtgaggccactgcacccatcttagagcgtattatgtagtttacattcaacaagcatctgagagcacctactgggtgccctgaagtctgctaggtgctggtgatagaaagatgctcacggtttggttcccattctcaaggtttttttttttttttttttccggaaaccatagcaggctccctgactgaggttgtggtacatgaaagatttcctggagtcctgatctgagctaagtcttaaagaacaaggagggttgtcaagataagagcctgtgttttaggcaggggacatagcagtgtcacaaaggcaccctacagtgtggtagaaatggaagctaaaagtagtttggtgtttttagagtgtgagacccaaagtggtgggtagggacaggttgctggtgaagtccaagtcaggaggggctcctaggaagccccactgtaagcttttacttaatcctctgggtggtgcagactcactgaagagtttcaaatgacaggaagggtgacatggttagctttgggctttatgtgtagatcagtaattactgtataaactatggttggcacaaaatacagggcagaagaccacttagaaggcagtttttagtagtttaggtgagaggtgaaagtggccttgctgatagggatggcaggaagcacacagatgtgagaaatagatttaggtggtagaattgggaggtctgtgtatgggagcttaaggaaagccaggaataaccagagcagctgacactgaaggggctaggcactgttctcagagctgcagttgtattatctcattgagtcctcacaacacatctgagatcaaggacccattaccatccctgttttacagatgggaaaactgagtaaaaggaagaaaagtactggcccatccaaggccccagtagttagtggtacggccgggacccaggcatctgactccagagcccatgttctcagccacctcactatggaccactctcatggaaatagcaaggatatgaagatgaggcttctggcttgagtgactgggtgggtggctggtggactccggagacagcacacagaagcaggcagacatgtagggtttatggatatctgagagaaaacggctggtgggcagtacagtagagaagactcaggtggatcaggaagaaatctgcaccagaaagagtgatttgaaaaataacagcagattttggtagaaactgaaagaggcattgagttggtttatggagctatacagagtggaaagataagtaattctgagatggaagcttggggacagccacacctaagagggcccaaattgagactagaatgtgtagcacgagaggagagcaaagcaaggaaggtgtgatctgtggactgatagtgatgaaatgataattgtatgtgtatgggttttttttttttttttttttttttttttgaggcagtctcactgttacccttgccggaatgcagtgggcatgatcatggctcactgtagccttaacttcctgggctcagggtattctcccacttaagcctcccagtagttgggactacaggtgcacgccaccacacctggctaattttttgtattttttgtagagactgggtttcatgattgttgctcaggctggtcttgaactttctgggctcaattatatgttttttttgtttgtttttttgagatggagtctcacttgtcgcccaggccggagtgcagtggtgagatcttggctcactgcaacctccgcctcctgggttcaagtgattctcctgtctcagcctcccaagtagctaggattacaggcgtgtgccaccacacccggctaatttttgtatttttagtagagatggggtttcaccatgttggctaggctggtctcgaacttctgacctcaagtgatccacccacctcagcctcccaagctgctgggtttacaggtgtgagccaccgtgcccagcctcaactgtatttttttttttttttgagacagagtctcgctctgttgcccaggctggagtgcagtggcgcgatcttggctcactgcaagctctgcctcccgggttcacaccattctcctgcctcagcctccctagtagctgggactacaggcgcccaccaccacgcctggctaatttttttgtattttttagtagagatggggtttcaccgtattagccaggatggtctcgatctcctgacctcgtgatctgcctgccttggcctcccaaagtgctgggattacaggcgtgagccaccacgcgtggccctcaactgtacgtttttatccatgtcctcgttttatatgggattcccacattcttgctgaggttcacacagttgttgagccaggatttgaatcaaagattgaatccagcctgaattatttcagagccttactgttaaccattgtgtggtacagcttctcagcacataatgagatccctgaagaagcaggatggaatgggtcaaggatacagggttagcctagaatgggaagtgggccagctcattttcttggaggagaaggtagtaagatagagagtgtgctgtggatggttggtaggaggtgttgaggggagattacttctgttgtacctagtcttggtgaaggtggcaaggttatttgcagagattaatggttaaattagatgtttgatgtgtgaagaaatactttgagagcagtatggaatctgtaatcttactggtggctattaggggattatattatcctgtctttgaggctctgctctgctgatgttcagccttaggggtgaaataattcctctgttccagtccccactcatctctccacctctctgagttctttttttttttttttgagacagagtctcactctgttgcccaggctggagtgcagtggcacgacctgggctcaatgcagcgtctgcctcccaggttcaagcgattctcctgcctcagcctcccgagtagctggaattacaggcgtgtgccaccacgtccggctaattttgtatttttagtagagatggggtttcaccatgttggtcaggctggttttgaactctggacctcaggtgatctgcctgcctcggcctcccaaagtgctgggattacaagcgtgagccaccgcacctggccatagtctatctatgttttttaaaagttcatttcaagcattcttaattgtgtctgatttttgcacaagtttgattttttttttaagttttctcatgaggttgcaatttttgttgttttttgagagagggcctctctgtgttgtccaggctagtcttgagctcctggcctcaagcagtgatcctcctgctttggcgtcccaaattgctgggattacagatgtgagctactgtgccaggctgcactggtctactttttttttttttttttttttttttgagacggagtcttgctctgttgcccaggctggagtacagtggtgcaatcgcagctcactgcaacctccgcctcccctgttgaagtgattctcctgcctcagcctcctgggtagctgggattacaggcacacaccaccacacctggcttatttttgtatttttagtagagatggcatttcaccatgttggccaggttggtctcaaactcctgacctcaggtgatcctcctgcctcggcctcccaaagtgctgggattacaggtgtgagccaccgtgccctgcccacactggtctagttttaaaccactggaagacagagatttaatcctttaaactacttgtgtatttccccaaatgcttatagttgggcacatgctaagtatttagtcaattcttgccactgttaatcagtcatttgttagcagttacaaatttgcatagaagaagaaagcatggatttttttgttgacagtgaattttctttataaacacaagggggtgctctttaaccatcaatgaccagtttaaaaaaagtttaaagtcattttaaagccttagaaggaagcctgcataaggcaaattgctacaggaacagtaatacattttagggctgtgcacagtgtttcatgcctgtaatctcagcactttgggaggctgaggcaggcggatcacgaggtcaagagattgagaccatcctggcaaacgtggtgaaaccctgtctctactaaaaatacaaaaattagctgttgtggtggtgcgtgcttgtagtcccagctacttgggaggctgaggcaggaggagaatcatttgaacccaggaggcggaggttgcaatgagccgagatcatgccactgcactccagcctggtgacagagcaagactgtctcaaaaaaaaaaaaaaaaaaaaatttaggtggtaggtattttagctatcctttaaaatttaaagattctttttaagatttattttccctaaaaatacaagacttaaaaaaatatgtgtattattcctaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtaagtttcttattataaaatctgctgtgggaattaaacaaattaaggtgctagttgtatatactttcaaatcccaaagcaatctgagagcattcaaatatcaaattctgagctttttcccaagaaaatgtataagctgttctattgtttaggcttagtatattgtgtgaatgtgttgctagagaggtccagtctgttgcatctgctgtagttgttggtgacttgctgtctgctggcttcttctctgggcatatgttccctcagccaggtttcgtctttggtgttttgtcttccttccagaatctttgcacataactttaatccatgttattgcaaatgttttcttccgaaaacttaacaagttggtgattaatttctgtggcagcggcatttttttgttagaaatatcaaactacagcttgtgttttgtcttaagaaaagcacacctgatcttgatctatgtctgtctgtctgtttctcacagtcacattgaccatgttgccatggataactagagaaaaatcactgtagtcgtaagtcaaatgaggcatatccagcctcatttagtttcactgccaaatctatgcggaggtgaaaggataaattctttgtcaatatctgcaacctttcagacatagttccctgcattctggaaaagcttaacaaatcttgataaatgtgaaatagtcatagatgagctactagttttttaaatgaaaggccccagtatgttacatgagaggttagaatttgggttgggtagttttttttttttgcacctttttttatttgagatggagttttgctcttgtcgcccaggctggagtgcaattgtgcgatcttggctcatggcaacctctgcctcctgggttcaagtgattctcctgcctcagcctcccaagtagctaggattacaggcactcaccaccatgctgggctaattttttgtatttttagtagagatggggtttcaccatgttggtcaggctggtcttgaacccctgacctcaggtaatccacctgcctcggcctcccaaagtggtgggattacaggtgtgagccactgcacctggcctgttttttacacttttctttctttctttctttcttttttgagatggagtctcactctgtcgcccaggctggagtgcagtggcatgatcttggctcactgcaacctccgcctccctggtttaagcagttttctgcctcagcctcccgtttttacacttttctatttcatatgtgcatctgttcaaatatgggcttggaaggatggatcatctgtgcatttgtcctgttttctttttcctagtcccttctattttttaacttgaggtattgggacactttccatttggacataagtcttcattttcttatctgtagtaaccacatttattttatgccaggtgtcccttgaacttgtagagttagagggtttgttaaaactgaagtgtgaggccagttgattgtgtaatgcgtgtgcatggggccatgttgaccgccttgcaggccgtgtttggctggtccttgcaggttttatagttactttagactctgcagggttccatttgatcaattggttgcatgttcacctgtggatttcttactttttagatgggatttttccttgggtggctgcattctttgaaacaccaaaggaacacatttctctgtgagtgttatttcggtattcaggctgctagacaacagcaaagagggtctatcaagtgaaaatgtccttttgttcaggagaaagcatgtgcaatttggaagttgtcttttgaccatgatcacaaagcttctcccgaaaagatggtattttgtgcagtagaacttagccatttccaatacctcaacttactggaatacaacctggaggccccagagcaacactgataattccactgagtggatcaccagttcattgtctaagcctgaatggaaggtcacttggtctgtaaccttttcttttgtccttaaattcagataaagtttcacaccgcaatctgtggaaaaatgatctcaacaggacttgtttatcttctttatcttaacatatcaatcaaaaggaggggggtaaaaagcccttgtatttaaacatgacctttgggtcaatttaaaaaactggttttgcttgtccctgtagcttatttggattttaatagatttagcagtatagaaacaacttgctaagttattttttttatgagaactatgaaatgtgtatatgttcgtggattacagaaaacatttgttgaatggcttttactttttagctaaacacattttattttggctgcagaacgtgacggtctcataacttatattttctacacattgaaacctgcaacttttcttttgtcttctagccatagggcccaaagaacctgttgtaccagtttgaaacatgctttgagcatgcccagagagactgttcattaagatttatttagacatcagggcagtgattcacagtttgcaaaactcaaacccagccaatttctttctttctgcaggtgtgtctgacttgctgctccagggatgtcatagttaaagttgaccagatctgtcacaaaaatagcatcaagttctttacaggagatgtttttggctaccatggatacacatttgccaatctaggagagcatgagtttgtagagtaagtgttgggagaggaggggagaacataacattttctcctttttatactttttttttttaaattatgtatttatttatgtgtagagacaggatctatgctatgttgttcaagctggtcttgaactcctgggctcaagtgatcctcccaccttggcctcccaaagtgctgggattataggcatgatccactgcgcctggtctgctgacatgttttcaagttgagagatagtaaaatgattacaaaatagttgggcgattctggaggcatattcaaccaaagtctaccttggaaaaggtgtccaatatccagagagactcctctggtagaacaaacagacctcatcctctcattttgaacactgaggctgcagaacttggtaattcttacatgacaggacttgccgtgttttgactttgtagtctctaggtgaaagatggcagatgatacattattgtaaaactatatgagttaggtattttggctgcagtttctgaccaccccctccaaaaccctccaacttgctaattgagagggaaagacaggctctgtgagataggagcttcctaccaagagactgagaactcttctcttgttcagcctctcaggcaagtcactgaaatttctctggtctccaagtttcttgcctgtaaaatcaagatgggggaaggacagtcatgttccagacatctcctaactctagtgttttatggctttaggataatctagttctttgggcatattattattattattattttattttttgagacggagttttgctgttgttgcccaggctggagtgcaatggcaccatctcagttcagaacaatctctgcctcctgggttcaagccattctcctgcctcagcctccggagtagctgagattacaggcatgcgtcaccatgcctggctaattttgtatttttagtagagacagggtttttccatgttggtcaggctggtcttgaactccggacctcaggtgatccacccacctcggcctcccaaagtgctgggattacacaggcgtgagccaccgcacccggctattattattatttttgagacggagttttgcttttgtcacccaggctggagtgccatggcacgatcttggctcactgcaacctccacctcctggattcaagtggttctcctgcttcagcttcctgagtagctgggactgcaggcacccgccaccatgcccggcaaatttttgtatttttagcagagacggggtttcactatgttggctatgctggtcttgaactcctgacctcaggtggtccacccacctcagcttcacaaagtactaggattacagccaccatgcctggcttctttgggtatattataaagaagttatagtagtgggaagcaatccagattattttaacataagctgcccacagcagaggggcagaattaagtttggcttttttttttttttttttttttttttttttctgagacagactttcactcagttgcccaggctggagtacagtggcgtgatctcagctcattgcaacctcctcctcctggggtcaaccaattctcctgcctcagcctcccaagtagctgggattacaggcgcccaccaccacgcccggctagttttttgtatttttagtagagacggggttttgctatgttggccaggatggtctcaaacccttgacctcaggtgacacgcccgccttggcctcccacagtgctgggattacaggcgtgagccactgcacccagccaagtttggctatttatttcatgattcaagtagagtgtttacaaagtaatcactttgatttattgagagcagctgtgtgcccagcagtgtgctgagcaacttacgctgctctgtttttcccacaataatttcctgagtgcccaacagtgtaccagactcatcatgttatcaatggcagagctcgatttgaaccgagatctgactccaaagcttttgcccttaaccaccatcccgatctgtgacctggagaggctttttttgattccaataacatgattcctagggtaaaattacattctctccccttgtcaccctctagggagaaaactaaagttgccaaagttagccaaggagtagaagatgggcccgacaccaagagagcaaaacttgattcttctgagacaacgatggtcaaaaaggtatgtgtaacgtgggggcagaggtcagaaaccctggggccttggaggggtcaggcaatgacgattgaaaaggataagagcaagcacttcttgaaggggtggggcgggtgcttgtcccatctaaagggaggctgccacagcttagtgtcagccagctgttgctgtgagggaatgtgggcccagtgattccagatgggatttttcaagacaatgagaaatgcaaacttttgtaggctctgtcccaaacttttttttttgtgtgtgtgagatggaattttttcttgtcgctcaggctggagtgcaatggcatgatctcggctcactacagcctccacctcctgggttcaagcaattctcctgcctcatcctcccaagtagcacccctggctaatttttttttgtatttttagtagagacggggtttcaccatgttggccaggctggtctcgaactcctgacctcaggtgatccacccgcctcagcctcccaaagtgctgggattacaggcgtgagccaccatgcccggccccataccctttttttttttttttttgagatggagtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagacggggttccaccatgttggccaggatggtatttatctcttgacctcgtggtccacctgcctcagccccacaaagtgctgggattacaggcatgagccaccatgcccgaccagaaaacttttttttttaaagcagcaaaacaccagccctgggttacagtagcaagaccccgtgtctacaaaaaaaatgtaaaaatttgtctggcgtgatggtgagcacctgtaggcccagctactcataggctgagctgggaggattgtttgagcctgggaggtggaggctgcagtgagccatggtcacaccactgcaccccaacctgggccacctagcaagatcctgtctaaaaaaaaaaaaagcaaaacaaaaaattttttgtattttctctactaacaatacaaaaattagctgggcaaggtggtgcgttgcttgtagtcccagctacttgggaggctgaggcaggagaatagcttgaactggggaggcggatgttgcagtgagccgagacggcaacactgcactccagcctggcgacagaacgagactctgtctccaaaaaaaaaagttttctttgcctgtttttttccttttgccaaataacctttaataagaaaaatccttcaatgttgtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagatggggttccaccatgttggccaggatggtatgaatcctcagattcatatttgttaatgtagtttatattaggggctcagcctctatttggattaggtgcaataattacatttatagaaaggagtggagaagggatcagaagacgatggtttctgtagctagtgctggaatctgagatgggaaccatgcgatggggaaagcaagatgaaggggccagaattggtttcattgaactgagaggaaagacatgaccaagcccatatttactctttgctttgtagatttaaatgttgagaaagaaaaacagctggtcagaatgttgagttaaattacgctaacgaggggattctaaagagtgcagaaaccacaaaagagactgcagaaaaccacaaaagtggaactctcagactctccagcaaggcggcgttggagattttctttctcattttgtgtttgtgttggagtagtttggtgctgtaagtgtgatacagaggaattaagccctaattttagtgtctattcacagaaccataattatccagagtgaaccttggtgttttggccaaaacttgggtgcctttctttctttttgaggcccagtcaagatttatctgaatagctccgtgaatttggtggggggagataaattgttaacaaacggaggagtacaaaagctgctttgtgggtgctgtcagtttataaatcacaccctcttacaagtgtgacacttggccttggtgtgaagggttttatggcttaagggccttctctgattgaggcaggtctttcacattcaaatggagagagtgcctagctttgttagccattcacagctggaagtttccctggagtcagttctgatggtgcccactggggtggatctggaaacctcttttgggaaccactttatctcgctatgaggagaatgtgggcagcccaggcctttgcccaccattccggagggccctacaggcacagaggtttttgtgcagcctcttcctacgtggagctgagctggaaggtatcaaaatattccccagctgacattgttagtcagctgttacacttgaacaatgcaggctcggattccaaccccaagcccttaaggttacgaggcattcagtgcattcctgctgacaatccctgggattccaaaccttgcctttgtgcagcctcaccaagggccctgcggaccgactgggctggactgggttttggccatggctttgtcaccttgcaataacatgcctccttccgttttggcacagatggccctgtgatttcaaggttctcttccaacaccaaagattccttgattcagatgctgcccttttgcctaattgtacagaataactagttgggttgtgctcagagagtgcagggtgggggtggggaagcagctacttcctgtttcctgtgaaaggttttctggttagggttcccttcccctccccgctttccctaggtttaaccaaaggttgtaaagccacttttgcttcaaggtacactttgtgctcctaaattagtaacgttgaaaaacaaaaaggaaaaacagcctgtggttttcacaccctctaggaagctggtgggcctttctagcacctgtgccattctgataaataagggcttaggaaaatgcctagcccagaaataggtgctcagtagtttgtttgcttcctttggtgctcaggagaagatttgagacggatttcgtcacaatcaggtctcgggcacaagcctcacatggacactgacatgcaggagccagaggagacagcaatgaggtggtggtaaggaagtgcccaaaaaggtttcccagaggaagagttgtttgtgttggcatgtgagggacaagctttccaggcaccagagccaagagcagtgctctgtccgaggaagtaggataaaccgaaagacggacgtaggggcagagttgctgtggctgccctcactgccgcagccagctccttccatgagttgcagaatgcctactgtgtgcaaggcactgtgttgagtgcagggaatcacatccagtcttgttgtccccatctatagctgataaagaagctatgagaaattaagtgacctgaccaaggccacacagctgtggaagaaggggcgagagcatagacagtgggtaagggcataggctcaccctatgatttacaaagagggatacccctgaagttgctagggtaacgtgacatattaggaggatggtgggataaaatatgtgaacatcgggatcattctggaaaacctttaggataaaaggccactgtcatgctcccatgttcacgtttctttattgtgagttatctgtgttaggtgctgccagagatgatgagatgcctgacagtggttactctgtaatagctctttaaaaattaaagacaaagtagggtttgttcctgactgtactagaaatacagatttaattttacctctgctcctgaaataggtgactaatttggagtactattaatactcttttcatgaattagttgagaaattccacagttgaggagtgattcattcttttgactccctctttctgagcaatttgttgacagccttctcatcctctcttacacccgtcattaaagaaacagtcgagttctttttctttcatgtggtaccttggtttccactgctggtggcccttaggttgcttgtctctgtctccccgcttccattttaagctccatagggggaaggtagtcttgttcactgctagactcctagtccagtgtgtagcacagtcatatccacggaatatttgttcagtgtactggtggctgttaactgcagcataatccagcaaccctggagattattttcttcctttttttttttttttctttgaagcagggtctgactactctgtcacctaggctgaagtgcagtggttcaaacactgctcactgcagcctcccaagtagctggaattacagacatccactacacctggctaatttttaatttttaaaaattattattatttctgagatggagtcttgctgtgtcacccaggctggagtgcagtggcacaatctcagctcactgcagcctctgcctcctgggttcaagcaattctcctgcctcagcttccggagtagctggaactgccagtgtgtgccaccacactcgactggtttttgtatttttagtagagacggtatttctccatattggccaggctggtctcgaactcctggcctcaagtgatccgcccactttggcctcccaaagtactgggattataggcgtgagccacagcttccagcctgattgtttccattttaaaaaagagtaattgaagtaacctttgttaccaatgaaatgaattaaccttctagtatattaattctcacggtttaggttatttgaactaagctgagagaacagaataccaaagaagacaatagacttgcccagaaatatttagaagtaagtcactcagttgcctggattggaaccctcaggccagagaggttcaaaatcctgcatttttttttttttttttttttttttgagacagagtctcactctatcacccaagctggagtgcaatggtgcgatctcggctcactgcaacctccgcctcccgggtttaagcgattctcctgcgttagccttccgagtagctggaactacaggtgcgcgccaccacgcccagctaattttttttttttttttttttttttgagatggactctcgctctgtcgcccaggctggagtgcagtggtgcgatctcagctcactgcaagctccacctcctgggttcatgccgttctcctgcctcagcctcccgagtagctgggactacagatgcccgccgccatgcccgactaatttttttgtatttctagtagagatggggtttcaccgtgttagccaggatggtctcgatctcctgacctcgtgatccgcccacctcggcctcccaaagtgctgggattacaggcgtgagccaccgtgcccagcctaatttttgtatttttagtagaaacggggtttcaccatgttgaccaggatggtctcaatctcctgaccttgtgatccacccgcctcagcctcccaaagtgctgggattacaggcgtgagccaccactcctggccaatcctgctaattattaatatcagaactacttggttcaaaggagtggaaatagggcaacgaggggtgtaaatttgcagttaggtggaatgctgatagcaagttttccaggtaggagagttagttggggtgggggatgctaatgttagcttatctctgtatatatatttaattttatatgttatttatttttgagatgggatgtaactctgtagcccaggctggagtgcagtggcacaaacacagctcactgcagccttgaactcctgggctaaagggatcctcccacccacctcagtctccaaggtagctgggaccacaggcatgtgccaccatgctctgctaattttttcgggtttttttttttttttgagatctcttgctgtgttgcccaggctgatctcaaactcctggcctcaagtgatcctcttgccttggcctctcaaagtgctgagattataggcatgagccaccgtacccagcctatattttttttattgtgacatttaatgcacaaaagaagatatgcagcatcaatgcagataatggaacaaaacaaacactatccgccttaaaaacacaaatatttttggtacttttgtaccaatctgtatgctgtttctctatcttctacttcttctccctgtaccctcaccaggtaagtaaccccagagctgctggtacatttgtgtggattaaaaaagacacctggaaggggcagatacagccctgcttgacttcctgttttatcacgtgtttataaatctaaacaatgacatggaacttattatacaatattttaggcataaattaagaatgatttcgctcaccatcatagacctaccactcaatttgaagcatcaaacattactggtatggtgaggccctctggctgtccctccaacagaagttaccaccctcctcagttgggtttctcattcctatgcatttcttcttactacttatgtatgtatttccaagcaacacatagaattgctttgcatgctttttatcttcttaaaaattggttttatattgtatgcatggtgccacctgcttttaaggagaagcaacacgtttgtgaggccatctgtttatatgttgttctagggctttgctgtccattttggtagccactagccacagctggctgtttaaattaattaaaatcaaatcaaatcaaatatttagttcctcagtctcactggtcacatttcaagtggccagtaagcacatgtggccattggcatctgtattgcatagcacagattacattctgttccatcatcacagctagttctcttggacagccctgcagggcatttctttttggtttttgttttgtttttatttttgttttttgctagagtctttgttgtgtaaatacattactattttatatccatttttctatttataagcatttgggtatgctcataatttgctgttacaaattgtgctgcataagcattttgtttgtgtgtgtatagatgatctccttgggcaattgtgttaatttctcttgggtatatacctgggagtaaaattaagataagggcattttcagctttaccagaccccgttaagttactctcaagtggttttatcaatttatattctagaaccaacattatgtatcagtaacatttggtaacttcaggcgttttttttccattctgctgagtgtgaaaaatgtgttttgattatggttgtcatttgttagaatactttgttaaagctttttaaagattcttggtccctctaccctccccaccccctaccccaggaattttgattgggtaggacctggggattatattcatctttatatgcagaattatattacttgttactgttaggcctgatttaagaagtaaaataaggctgggtgcagtggctcatgcctgtaatcccagcactttgggaagccaaagtgggcacatcacttgagcccaggagtttgagaccagcctgggcaatgtggctaaaaccccttctctaccaaaaatacaaaaattagctgggcgtggtagcacgtgccagtggtctcagctactggggaagctgaggcgggaggattgcctgagcctggcaagtgtaggcagcagtgagctgagattgtgccactgtagtacatcctgggtgacagagcaacacactgtctcaaaaaaaaatttttttttaagtaaaataagttcataattccaaatgtggaaaatgcagaacaagttaatgaaatgttaatcctactaccaaatgataactataaccttcctttcagtatttttctatgtatatacaacaaaattggggcactgtttaatacagataatatatatagttagctctccttattaatgggcttcacattcatggattcaaccaactgtggatcaaaaatctttagtgtgcttggagtacatccaaaaaaaaaaaaagaaaattgaaattatgttaataataaaatatttgggaaaaaacattgcgtctatctgtaccaaacatgtacagactttttttcttgtcattattccctaagcaatacaatataacaactgtttacatagcaattccattaggtattataagtaatctagagatgatttaaagtatatgggaggccaggcgcagtgcctcacgcctgaaatcccagcactttgggaggccaaggcgggtggatcacttgaggtcaggagttggagaccagcctggccaacatggtgaaaccccatctctaacagaaatacaaaattagctgggcatggtggctcacacctgtaatcccagctactcaggaggctgaggcaggagaatcacttgaacttgggaggcagaggttgcagtgagccaagatcgcaccgttgcactccagcctgggcgacagagcaagactctatctcaaaaataaataaataaataaagtatatgggaggatgcacgtagagtatatgcaagtactgtgccatttatttatttagagacagagtcttgctttattgcccaggctggagcgcagtggcgtgatctccgtctcccaggttcaagtgatcctctggcctcagcctcccgagtagctgggattacaggcttgtgctaccacacccggctaagttttgtattttaagtagagggcgttttcaccttgttcgccaggctggtctcgaactcctgacctcaggtgatccgcccacatcggcctcccaaagttttgggattacaggcgtgagccattgcacctggcttgtatatgtgtatatatatgtacatggttttgtcttttgcttttttcactcaataagcattccccaaatctgctttggagcacatgattttattttatttttatttttttatttttttgagacgaagtctcgatctgtcgcccaggctggagtgcagtggcgcaatctcggctcactgcaagctctgcctcctgggttcacgccattctcctgcctcagcctcccgagtagctgggactacagacacccgccaccacacccggctaattttttgtatttttagtagagacgggtttcaccgtgttagctaggatggtctccatctgctgacctcgtgatccgcccgccttggcctcccaaagtgctgggattacaggcatgagccaccacgtctggcctggagcgcgtgattttaaatgtctgtgtcatttttcctcttcttgcctagccataatctattttaccagtcacctattgtattgaggttattgaggttattgcagtttcctactatgctaaatggctcctgacaacaaatttgatggttgatgggctatgtggagaattcacctttttttttttttttttttttttttttgagacagagtctttctctgtcacccaggcgggagtgcagtggcatgatctcagctcactgcaacctctgcctcccaggttcaagcgattctcctgcctcagcctcctgagtagatggaactacaggcacctgccaccacgcccagctaattttatttttgtatttttagtagagagggggtttcaccgtgttagccaggatggtctcgatctcctgacctcgtgatccgcctgcctcagcctcccaaagtgctgggattacaggcgtgagccacagtgcccggctaatttttgtatttttagtagagacggagtttcaccatattggccaggctggtctcgaactccagaccttgtgatccactcaccttggcctcccaaagtgctgggattacaggcatgagccaagtctttttttttttttttttttttttttgagacggagtcttgctctcttgcccaggctggagtacagtggtttgattgtgatctcggctcactgcaacctcagcctcctgggttcaagcgattctcctgtctcagcctcccaagtagctgggattacaggcacatgccaccatgtccggctaatttttatatttttagtggagacggggtttcaccatgttggccaggctggtctcgaactcctgacctcaggtggtctacccaccttggcctcccaaagtgctgggattataggtgtgagccaccgcacccggccttgttattagtcttaactagattgttgattgaagtccttaagcccagaaatgtatgtgaaggatggtggagaagagtggctcaggcattctaggcagaggtattcttgagctgaggaagtggaggagaggaggtatgtaagttacctgttttcaggggttcattccagtggatagtggatgccactccctggcagacactgtgggtgcctcacctgaaagactcctgattccctgaaggcattgtcgggtgtattttttctttataagcgtaatgccagtggagtgggtaagacaggtaccaccttttgcatctgctgctacagattaggcagcttggttaagttttgttttgtttttaattgttatgagttagtttgaaccaaaaggattgttaagtggagtgtaagaagcactgaataactactgttatctgagaggagtagtaaagaccagggccactgggcaatcccagaggcattaggaatttgtggcctttccctttagagcattgtcattatgtgtatctgcatctctgcattccaactttcacattttcagttcccaggagagagaatctgattggcctggttggggtcctgtgcccacttctggctgtcacctgtggctttcttccctcagttgtagaccacactctggatacctgggacccctgaaatctcctgcccagacaaccccaagcttctcaggactttttgtgggctgcttccctgttctgcctgtgcagtgcaggccttgtcacaatgtctgaatgcttaggccagagacgtgggggtttggtgagaaaggatgagctgggtagctacactcaagtgcagagccaccagtattgtgggacagagccaggcatgggaagagaagtgggcacggatgggggccagctttcccgatgtgccttaatctggcacagaactcctaaggagtgtgaaaatttcaaatttgatccaggccttccaggtggttatgaagaaggcgagtttgtcaagacaggataatacaatatacttcatttaatagcttgttagtgtgatttataactaaatatgtagacatcatatatgggtcttcattcatactcttgccccaggccctgaaagtgttagctaacaggcaagacctgcctgggactgagattctaaaacacaacctccacccccaactccgtttcatcatatagtagcctaacatattagttggttcgttgcttatagtcaggcaaacaacaaagactccgaattgagctcttggtaatttttgaaacctgcctggtaatactgtgtttcctcattctgatggcattcccagaccatattgcaaatgacttgatgtgtattttcagacttgttgagaagggcctggtggtctatatagcaggcataaaatgtcaccaggccgacttcatgacttatcttttgaggtcaaacagacccattgaccaaaagatttgagggcagtgaaaacatcttgtatactatctttaacaatggatttaactcctaaaggaaagccacctaaacatgactgtttaatcttcactagcaatttgaacttttttttttttgagacggcgtctcaccttgttgcccaggctggagtgtagtggtgtgaccttggctcgctgcaacctccacctcctgggtccaagtgattctgctccctcagcttcctgagcagctgggattacaggtgcctgccaccacacccagctaatttttttgtatttttagtagagacagggtttcaccgtgttggccaggctggtctccaattcctgacctctagtgatccacccgccttggcctcccaaaatgctaggattacaggtgtgagccaccacacccggcctgcgcccagataatttttgtattttttttttttttgagagtctcgctctgtcccccaggctggggtgtagtggcacgatgggttcacgccattctcctgcctcagcctcccgagtagctgggactgcaggtgcctgccaccacgcctggctaatttttttgtatttttagtagagacggagtttcgccatgttagccaggatggtctcgatctcctgaccttgtgatctgcccgccttggcctcccaaagtgctgggattacaggtgtgagccactgcgcccagccaacaatttgaacttttatctgtcaaatctatatgcatccttagcaagctttgtaaactgcctggtaactgatagatcttggttcacttagcttcccaaattatgctgttatcatcttgtctctctgttctttaaatatctggttgggagggtatggagagagagggaggaagaaagacacctctgtaagtttgaaattatttgcatcccccccaccgcccaccaccaacctttttaaaatatagagacacagagtctataccacgcctggcctaaaataattttttttagagacgggatctaacagtgttcccccagcttggctatcttaaacttcttaagggtagctagttctaagaactgcttttttctggctaggcacagtggctcacgcctataatcccaacactttgggagaccgaggcaggcagatcacctaaggtcaggagtttgagactagcctgggcaatatagtgaaatcctgtctctactaaaaatacaaaaattagctgggcgtggtggcatgcatctgtaatcccagctactgggggcgctgaggcacgagaattgcttgaacccaggacacggaggttgcagcgagctgagatcatgcactgcactccagcctgggtgacagagggggagactgtctggaaaaaaaaaatgtttaaaacaaaaaactgtttttttgtatgtgtgtttatatgcgaaccatttgtgaaagtggtcccagcatgatgccacatgtgtcatttccaaatatttcagtctgtatttttttctctctctctctgttttttctgtcacccaggctggagtgcagtggtacgatctggctcactgcagcctcgacctcctgtgctaaaacagttctcttgcctcagcctcctgtgaagctggtaccacaggtgcatgccactgcacccagctaacttgtagagattggggtctcactttgttgcccaggctgttatttgactcctggactcaggtgatcatgccactttggcctgccagagtgctgagattacaaaagtgagccaccacactcagccataaatgtgttgttgttgttgtttttgagacagagtttcgctcttgttgctgaggctggagtgcaatggcgcgatctcagctcactgcaacctcccccctcctaggttcaagcgattctcctgcctcagcctcccaggtagttgggattacaggtgcctgccaccacgtccaactaatttttgtatttttaatagagacggggtttcactatgttggtcaggctggtcttgaactcctgacctcaggcgatccacccgcctcggcctcccaaagtgctaggatcacaggcgtgagccactgtgcctggacttgtaaatggtatttcaaagtaaaatatatgtcattgcatttatcaagataatttgattgagctttgtaggtcctagccatccttctgcctattactgggctttttgcaaatgctgttcctgtttccacaacctggagcattgtcccatcccttttattgtttctcttgctgttatttattatgtcatccatcatcattataccattcctctgccaagaaacatttaatttttgtttttgtttactattacaaaaatgttttatagaatattgttagacttacattcttgcccctcattgtggaagtattcctgtagtatgaatacagccagaggttttttagttttgttttggtttttttgaggagtcttactccttcatccagaggctggagtgcagtgacgcgatcttggctcgctgcaaactccacctcctgggttcaagcgattctcctgcctcagcctcccaagtatctgggactacaggcggccgccagcatgcctagctaatttttgtatatttgtagagacgggggtttcaccatgttggccaggctggtctcgaactcctgacctcatgtgatccgcctgcctcggtctccaaagtgttgggattacaggtgtgacccaccgcgcctggcccagtgagagttaaagggccagagtggaagcaggtctttggaagcttggctctgtcttccttcagtgcagggagtttgtgttgtccatccccagcctctacagaagcacacagtgagtgttcaataagcatttcttggatcaaatggcccctgcttcttttaatggtcagtaaactttaaataatgagatttttctgcaatagagaagagcaactgccttgtgattggaagccagcatatgttattcctaagcagttctgccttttttccacagaaggtggtcttctgccctgttaaagaagccctggaggtggactggagcagtgagaaagcaaaggctgctctgaagcgcacgacctccgactactttctccttcaaggtgaggtctcaaagcacaacttaccccgggagagcttttggctctgatttctgcaaatgtggttgcaaggtccagatggttttgtgatgtttgccttgggtggcattcttcattggctagttctcagtgatcacttgagaaaggggtggtcacttgaagggggtgaggtctaccattgagctctgggttctaatgacttctcctttttttacttgttgaaatgacctccctgtcaagttgaccttatggtaatagtgttacaggtcacagattgagaaacctctttttttttcttttttctttttttgagacagagtcttgctctgtcacccagactggagtgcagtggggtgcaatcttggctcactgcaacctccacctcctgggttgaagcgattctggtgtcttagtgtccccagaagctgggatgacaggcatgcaccactgcgcccggctaatttttgtattttgagtagagatggggtttcaccatgatgcccaggccctgaagttctgagattataggcatgagccaccatgtgaagcctgatcaaccaacttctcttcaccgccccccgcctttttttttttttttttttttgagacagagtcttgctctgtcacccaggctggaatgcagtagcgctatcatggttcactgtagcctctacttcctgggcttaagtgctccccatgcctcaggctcctgagtagctggtactacaagcacacgccactgtgcccagctagtttttgtatttttttgtagaagcgaagtttctccatgtagccaggctggacttgaactcctgagctctagtgaaatccccgcgttggccttccaaagtgctggagttaaaggcgtaagccaccagtgcttgttcccctcttcagaattctttctctgcctcaaaaccatcctcacgcttatgaaaggtggggttgtttttcctcttgctattaatgaactacttatcagtccatctttgctggtggtcaagagactgttagtaagtattggttggcttttcagtgttcttcctgtacctggcacttttttgtttgtttttgagatggagtctcgctctgtccccaggctggagtgcagtggtgtgatcttggctcactgtaacctctgcctcctgggttcaagcgattcttctgcctcagcctcccgagtagctgggactgcaggcgcgtgccaccacacccagctaatttttatatttttagtagagacagggtttcaccatgttggccaggttgggctcactctcttgacctcgtgatccgcccacctcagccccccaaagtgctgtgattacaggtgtgagccaccgcgcctggcaaacctggcacttttaatttttattttaattttttttttggagacggagtctagctctgtcgcccaggctggagtgcagtggcacgatcttggcacactgcaacctctgcctcccaggctcaagcaattctcctgcctcagcctcccgagtagctgaaatacaggcgggcaccaccatgcccagctaattttctttttttttgagatggagtctcactctgttgcccaggagagcagtggcgtgatcttggctcactgcaacctccacctcccaggttcaagcgattctcctgcctcagcatcctgagtagctgggatcacaggcacctgccaccacgcttggctaattttttgtatttttagtatttttgtattttttttgtattttcaccatcttggccaggctggtctcgaactcctgacctcaggtgatctgcccacctcagtctcccaaagtgttgggattacagacgtgagccactgcacctggctgcgctaatttttgtattttagtagagacagggtttcaccatgttggccaggctggtcttgaactcctgaccccaggtgatctgcccacctcagcctcccaaagtgctgggattacaggcatggtagttttttaaaaagtattttttttaatgttatttatgcatttatttttttgagacggagtctcactctgtcacccaggctggagtgcagtggtgcaatcttggctcactgcaacctccacctcccggttcaaacagtttccccgcctcagcctcccgagtagctgggattacaggtgcccaccagcacacccagctaatttttgtatttttagtagaaacggggtttcaccatgttggccaggctggcctcaaactcccaacctcagatgatccacctgcctcggcctcccgaagtgctgggattacaggcgtgagccaccacgctcagctggatgaactatttgaaagtcccgaatatccatttgtgtagaaataaatgggttgagcaggaatgagtgttgcatgtgagtgggctgcactcagaaaatgcctcctcttgatagtgggatcaggtgtggaagaggcaccagcagtaagagcagagtcttttccatgtgggaacagtgcctgggccctttgggagaagcttgttgctcactgcctcgcacatagaaagccctcaggaaacaatggcgctaatttgccaaggtttgggtttgacttgagcatctctaactgctgcttatgaaaggagtcaactgggctgggctactaaaaatacaaaaattagccggatgaggtggtgtgcgcctgtaatcccagctactcgggaggctgaggcagaagcacttaaacctaggaggcaaaagttgcagaatccgagatcatgccaaagcactccagcctgggtgacagagctgaactccatctccaaaaaaaagggggagaaacagagtcaatcacagatcatctactccagagttgaaaagtgtacacgccaaaaaaaaaaaagagaaaagaaaaaaagcacatatcttcacggatgacagagttctctaggacttgctctgtgccgggcgttttccatgtatatcaccttcatctcacaaaggccctcaggcaagtgctattaacaccaccagctacagaggggaatctgaggctcagggaatttaaagtcagtggctcaagatcacccatctaaaacaaaatggcagtgcccactggaagccaggtctgttttgattccaaaggtcttgttctttttctttttccccagagacagagtcttgctctatcacccaggtaggagtgcagtggggcgatcttggctcactgcaacttctgcctcctgggttcgagcgattctacaggcacgcaccaccacacccagctaatttttgtattcttagtagaggcagggttccaccgtgttggccaggctggtctcgaactcttgacctcgtgaaccgcctgcctcggcctcccaaagtgctgggattagaggcgtgagccaccgcgcccggcccaaagtcttgttcggaacaaccatgcaccactgcctgccacagaagtcatatagctactgtttcttcctcaaccacctgtccacccctccaaccccgtaacttctgatgctgatgtccagtagcacctgcactgaatattcactttgctcctagatatcagttttgtcccctcagttcaatgacccctgtgatgttgagatggatgagaaaatactctggaaactgcagaggataaaatcaggatttcctcacttcagcacactactgacattctgtgctggataacactgtcacgggggactgtcctgtgcactgtgggatatttagtaacacccctatcctctactcactagatgccagtaatatctccccacccagctctaacatcaaaaaatgtttccagacaccactgccacatgtccccagttgagaaccactggattatgctaaactcaaaggccagttgactcctttcttttctttcttttcttttttttttttttttgagacggagtctctctctgtcacccaggctggagtgcagtggtgcaatctcagctcactgcaagctcagcctcctgggttcacgccattctcctgcctcagcctcccgactagctgggactacaggcgcctgccactatgcctggctaattttttgtatttttagtagagacggggtttcaccgcgttagccaggatggtctcgaactcctgacctcgtgatccacccgcctcggcctcccaaagtgctgggattacagacgtgagccacttcgcccagcctgtttacccttaattccatccctcagtgggtattatggcaacagtctcatgagtgcctatgaccctttgctggataatatatcctatcatgtttaccactctctcccagatggcattaattatctgtctttttcagttttgagttccagggctttggatatggtaatcaaaacattaaaactatgtgcagtaaatttcttttcttttttctttttctttttttttttttttggtgtggtgaaaagcacataacataaaatttaccattataacttaagcgtataggtcagtaataatcatacaatgttttattttattttgtttttttctgagatggagtttcgctcttgttgaccaggctggagtgcaatggtgcgatctcggttcaccacaacctccacctcccaggtttaagcaattctcctgcctcagccttctgagtagctgggattacaggcatatgtcaccacgcctggcaaatttttttttttttttttttttttttgtgagacggagtctcgctctgtctcccagcctggagtgcagtggcatgatctcagctcactgcaagctctgcctcccgggttcacgccattctcctgcctcagcctcccgagtagctgggactacaggtgcccgccaccatgcccggctaatttttttgtatttttagtagagacggggtttcaccatgttagccaggatggtctcgatgttctgacctcgtgatccgcctgcctcagcctcccaaagtgctgggattacaggcgtgagccaccgcgcctggccacatttttgtatttttagtagagacggggtttcaccatgttggccaggctggtctcaaactcctgacctcaggtgatcctcctgcctcggtctcccaaagtgctgagattacaggcgtgaggcaccgtgcccggcagtgagaacatttacaatcacatattgtgtagcatcaggaaggatttttaagatcaaagttagcacattagaagtggaaataatttaaaagtggccttgattttttttttttttttttttttttgcctactgtaaagtcaagcctcagtaacattctgatttcaggatgcagggtggctttgggggatatccaagttgagtggtaaactttgtaggcactactcttgtttccatgttcctggcacctaagttgatatattttctcacagtcttgtgacaatctttgaagtatagttgttatcccattttcctataaggagaccaaggttgagcatggttgtgattgccgaaagtcatatccgtggttttatagacagtcagaatttagaccatgaggtttgttttacctgtggacttagttttcaacatatttaagatatatctgtagtctgggcgcggtggcttatgcctgtaatcccagcacattgtgaggctgaggtgggcagatcatttgaagtcaggagttcgagggcagcctggccaagatggtgaaatcccgtctctactaaaaaacacaaaaattagccaggcatggtggcacatgcctgtagtcccagctacttgggaggctgaggtgagagaatctcttgaacctaggaggcaaggttgcagtgagccgagatcgtgccactgcactccagcctgggcaacagaacgagactctgtctcaaaataaaataaataaaatatctctaaactaatatatctcattaaatttcagatctggagttctgtgagttagggaaacaggatcaccaccatagtagaaaaaactctggtgcagatagttttagacacaaagattatctgaattcaggcccagataattgtcttctttttccccaagaaacatttgaattgtatttctgttagataagcatcatagtaaaaagtcttcaaagtttttgaaggcagaaaaagttttctttgttaaacccttcccatttttttgtcttctaaatttctaggagaactactgttaagttttttagtatcttgttgaacaatggttaacaattataatcatttgtgtttatgtaatcaaactgtgaaacaccggttgggaacttgcttgtgtacacttgatggcgtaaatggtaggggaagagcatacatacaaaagtggcctcttttgctttcttggcagcatgatgttatattcctttggatgtaccgtcatctatgaccagtctcatcttgaaaggcatgcttattttccatttttcccagtgcttggaatttgtttccaaaattgtttctaggaacatgactaatgtgactgacgatgccttaggaattcctagtggggacaaggtgcttggctgggatgcatacctaagaatatctcacaaagaaacctgattttgtttcactattgcctaatggcgcacatagtaggtgctcaataaataaatattttttgcatgagtggtttttgcttgtctggtcatttgccctattgtagagggagagtagtgtgcccactggagtccccacagggtccttttgcctgcatgcctacccctgtggcacccatcaggcttttgattccaatgttgccctgggctctcactcacaggtagatgttttttattgccccattcacaattcagccacctgctgtccgcatgcatgtgcttgccatgtttagatattgggtgtttttccagtttacttaataagttagtggccagactgtacgcttcctgctgcatttttccactgtcttgagagttggcctcgccatctgtgagcaaaaggtctcttctttttattattctcccatggcatgttgcaaaacagtaagcgtgagctggtttcctgtggcaaaaaaatgactttgatttgttctttttgaggttactgtgagtttatcataacaggagtgctaaaaataccgagtctggtatggaaacagcattcacttaccagcatgaacaataacatacaggtttagcctagagcaggaagaaatggacttcatctcaagatgagaatacttatcagagaattcttggcaatcttaacttgctcagtctctgttctgatgagttatggaaaagtacttagaccatctttgagccacagaattgaagctgaaaatattcttagaccaaacattttgtgagcacctgctatgtaccagatctcatagctgggactaatcagaggaagaggaatagaataagtgttcttgccaatgtgaaagacaaacaaataattctactccttgtgaggacagctataacagagggctatagaaactatcatgtgttgttcctggtttttgtttgttttttttcccccccaaaacagggtcttgctctgctttccaggctggagtgtggtggcacaatcataactcactatagccttgaactcctgggctcaagttatcctctcacctcgacctgcaaagtagctgggactacaggcgtgtgccaccatgtccagctattttaaaaaatctgtttgtacagattggggcagggaggtcttgctatgttgcccaggctggccttgaactcctggcctcaagaaatcctctcacctcagtttcccaaagagggactataggaaagcaccaccctgcctggctcgttgttctgtttttaaatacatttgcattattccataataatcaaagtaatttattatgggaacttaggaaactgaaggtctgaccatctttggggagttgtgaagtcttgacagaggaggggagatctgagctgtatttctcggaacaggtatttgccaggtgggaaagagggaagaatattgcagagcaacacatgcacagggccagcaggatagaggctgagcctcggaggggactggagcttggagagagcaggctagtggtttccctattgatagaatatcagaatctggccaggcgcggtggctcacgcctgtaatcccagcactttgagagactgaggtgggcagatcatgaggtcaagagatcgagaccatcctggccaacatagtgaaaccccatctctactaaaaatacaaaaattagctgggcatggtggtgtgcgcctgtagtcccagctactcgggagggggaggcaggagaatcgcttgaaaacctggaaggcagaggttgcagtgagctgaggtcgcgccactgcactccagcctgacgacagggcaagactccatctccaaaaaaaaaaaagaaatctatctatctatcagtcagaatcactgaggaaaccgttgaaaaatgcggagtgcctgcttgtagctcacattactgaatccagatagctaggagtgacttgcatgtctgcatttttctatagcacccaggtttctcaaatcagccaagttaggggaaagtactgtcataggaaagggaagcccatttcccaggtcaaagcctttgcttactcgtttatgtttattttatttttgagacagagtctagctttgttgcccaggctggagttgcaggtgcaatctcagctcattgcaacctccgccttttggattcgtgcaattctcctgcctcagcctccaagtagtggggatcacaggcacacgccaccatgcctggctaatttttgtatttttagtggagacagggtttcgccatgttggccaggctggtctcgaactcttgacctcaagtgatccatgcacctcggccttccaggtgctgagtttataggcatgagccatcgtgcatagcctgcgtttttcttttaaaatgtgttaagcactgtatttcaaattacatttgtgcactgaagcagggaggaaaaaggagctaacccaagtagctgttcaatatagtattttgactgcataccctcaaagtaaagaaaaatctcacctggcgcggtggcttatgcctgtaatcccagcactttgggaggctgaggtgggtggctcacagggtcaggagatcgagaccatcctggctgacacggtgaaacctcgtctctactaaaaatacaaaaattagccgggcgtggtggcgggcgtctgtagtctcagctacttgggaggctgaggcaggagaatggtgtgaacccgggaggcagagcttgcagtgagccgagatctcaccactgcactccagcatgggcgacagaacaaggctctgtctccaaaaaaaaaaaaaaaagaaagaaaaatctctagccggtcgcgatggctcacgcctgtaatcctagcactttgggaggctgaagcaggtggattgcctgagctcagaagtttgagaccagcctgggcaacatggtgaaaccctgtctctactaaagtacaaaaaaattagccagacatggtggcacactcctataatcctagctacttgggaggctgaggcaggagaattgcttgaaccctggaggcagaggttgcagtgagccgaggttgctccattgcactccagcctgggtgacagagcatcttaagaaaaaaaaaaaaagaaaaactctaaataaatattgaactctgcttagtagggattttgttttcagatgaggtcttgctctgtaccccaggctggagtgcagtgtcacgatcataacttactgcagcttctccctcccagctcaagcaatcctcacatcacagcctcccaagtagctgggattataggcaagtagcagggattacaggcatgcaataccacacccagctgattttggtattatttgtagagacggggtttcactgtgttgcccagggtagtctctgtctcctgggctgaagtgagcctcctgcccaaagtgttgggattacaggtgtgagccactttgcctggcctagtaggtttgtttttcacagtgataggggttagcaattctgaaactacttactgttcttctaagattgagcagataggtaagtatagtgttaatagtgagaatcaagttttcttattgtcagaaaagggtgttcctatgaatgtggacagtgggaaaggctagaaggagccatgtggtattggattggaattgaagttatctggatgaactcatggtttcttatacgtagatgtagtaatagatgtatgtgtgtatgcatatccacttttacacgtgtttatttcctagaattgtttcctagaattgttgagagggtttatgcccagagacatcccagaagcactgaacgcactcatgccaagatgttaatacctttcctcactaaagagaaaccagggttccttggagaaatggctgtttccagatctggggtaggaaaattacaggtgagcttggaatatcctgctatgccagaaagtaaggaagtgctctaagaatgataggggcatgtcaaaagaacaagaagaataatcaattaatgtaaacaaggaattatgaagataacaaagtctatctttgactatcaccatagtagtaacaattgtttcaatcaagaatcaaagtgctaaaatcaatggggaacagtttgcggtgaaacagtgtagatgtttccttatcagatgcttttatgctatgcctggtggctcacccctataaatcccaagaggctgaggcaaattgatcacttgcacccaggagttttgagaccagcctgggcaacaaaacgagaccccatctctacaaaaaataaaaaagttagccagatacagtggtgcatgcatgtagtcctagctactcaggaggatgagatgggaggatcggttgagcgcaggaggtcgaagctgcagtgagttgtgattgcaccactgcactccagcctgggagcaagactttgtctcccccgaaaaagaagatgcttttaaatgaattacatagagagacattggagaaccctggcaggttgtacctcagctgagtgatgaaattaacaatctagggatggacagttagacctcatgcctcttggaatatgtaaccctgggttggatctgagaatagaggaaggttttttttcttttgctctaaaggatgttagtggaacaattggtaaaaagaggccccggcgtggtggctcacgcctataatcccagcactttgggaagccgaggcaggtggatcacctgaggtcgggagttcgagaccagcctgcccaacatggagaaaccccatctctactaaaaatacaaaattagccaggcgtggtggtgcatgcctgtaatcccagctacttgggaagctgaggcaggagaatcgcttgaacccaggaggcggaggttgtggtgagccgagatcgcgccattgcactccagcttgggcaacaagagcgaaactctatctcaaaatagtaataataataataaaataaaaaacaaataaaaaggtctgtaggttagatagcagtactgtttccatgttatttatttttacagttatgataattgtctcatggttatttaagagaatggtttttgttttgtttttcttgttttttcttttccttttttttttttttttttttgagatggagtctcactctgtcgcccatgctggagtgcagtggcatcatctcggctcactgcaagctccacctcataggtttacgccattctcctgcctccccctcccaggtagctgggactacaggtgcccgccaccacacctggctaatttttgtatttttggtagagatggggtttcgccatgttagccaggctggtctcgaactcctagcctcaggtgatcctcccacctcagcctcctgaagtgctgggattataagtgtgagccagtgcacctggcctctttttttttttttttttttttaattttacagaattttttttttttttaagacagagtcttgctctaaggctgtagtgcagtggtatgatcacagcttgctgcagcctcagcctcctggactcaagcgatcctcccacatcacccttctgagtaggtgggattattgtaggctaaatttttaattttattgtagagaggcctcactccatggcctaggctggtcttgaactcctgggctcaagtgatcctcccacttctgcctcccaaagcattgggataacagacgtgagccactgcacccagcctgttagataatttagaaaattttctttcctcattcttcaatttcccctcattcacactcccaactttcctgttttgtgatttttaaatgacgttgtctttggatgccggctggatttggtgattagttctcttcagaagaaacttcttattttagaacttgtaacctttgcaaagcaggccataggcagccatcgctatttgggtatgacattccccagtgggtttttggtgtccagtaatgacaaaaactgctgagaaagagacagccacagggaaatgggttccgataatggggcagcagctgagtgcttgttgatttgctgctgtcatgaccacagatgtttaaaaataatttgtaaggaaaaagaaaaaagcgtagtgtgtgtgtgtgtgtgtgtgtgtgtgtgtgtgcgcgcacgcacgcgcgcgcgcacaccactgccttatcagtggtagagaatgcagaccacagtcattcagaaaggaagaaggcaccaccatggaaacaggagaggtgaggagaagggcagaggtgacccacaaatgcggctcagtgccttacagcagagagctcatgagagaacagaactggttagtcaccgactctgctcctcggtctgcaagagaggttcagcaccaagtctatactacacagtactggaaggattagatgaaggcctggcacacattgtgaattaatagttactggttacaggcggggtgtggtggctcaggcttgtaatcccagccctttgggaggccaaagtgggaggattgcttgaggccaatagtccaagaccaacatgggcaacatagcaacaccctgtctctttttttgactgtttttttgaaacagtctcgttctgtcagccaggctggagtgcagtggcacaatcttggctcactgcaacctctgcctcccaggttcaagcaattctcctgcctctgcctcccgagtagctgggattacaggtgcctaccaccacgtccggctaatttttgtatttttagtggagatgggctttcaccatgttggccaggctggtctcaaactcttgacctcaggtgatccacccaccttggcctcccaaagtgctgggattacaggcgtgagccactgtgcctgaccggttcacgtactttacatgcattgtgatcatattaaatcttcatgacagccttactagatcaggtcttgtcctgttttcacatgaggaaattgaatcttggaagggctaagtcatttgtccagggtcatcacacgcagtaagtgttagagtctaaacgagccagagctgtcacactgtcatccccagggccttgtgtttaagcatcgcccaacaaagtgctcagtcagactttaattattagcattactaataataccattatgatgattattttgtctaaacttcacaggcacctcgtgacattttcttattccacttttgcagatgggaaactgaggcccaccaagatcagattacaataatgggcaacattgtcagcaacctgccttgctttttttcttagcaggcccacatctcccccactcccccacccacttggcagtagcctgtgtttgagctgctcacaggccccaaggcccagctgcaattcttgtttaaagcctcacatcttttctctgactgtcagacaacagtcacgggaatgtcctgtgccatcttccctcggcaagaggggttggcagagagcagcagatgcctagagtcaaggtcatgtgctgctcaagtgctgggctggagacaagaccctctctccctgctgcttgtgaccaggcagggtggctctgaatgtagagggctctgtcagaacagttctgtgaccagagggtgtggttggcaaagcaatgcattaggggcccatggaagtttattcttgttgtccacattatttccctgtgacttttagatttttttttcctttttgtaaattagttttttcatactagttagaatgtttcaccttaaaggtgagagtcaagctctggaatcgcctgacatttttaaggaaaggaatagaatattgggctggggctagtctgaaatggtggtttgtattattttaaattgatgggctctgggttaggggagccaaatccattttaaagtgatttttgtaaaaattggcatgtcttctgtttcttctcttttccaaaggtgacactataacgtagaggttaagaatgtggtgacttttaaatccgtcgtgaccataagcctctcctaagccccagttttcctaccactaaaatgggggtggtaacagttgtacctacctcattctgtcttttttgttttttgcttgtttgtttgttttttagatggagtcttgctcttgtcgcccaggctggagtgcaatggtgtgattttggctcattgcaacctccacctcctgggttcaagcgattctcctgcctcaacttcccgagtagctgggatgacaggcacccgccaccatgcccatttagtttttgtatttttagtagagatggggtttcaccacgttggccaggctactcttgaactcctgacctcaggtgatccacccacctcagcctcccaaagtgctgggattacaggcgtgagccaccactgccggcctcgttctgtcgtatttttttacgtaggagagctcagtctgaatgtaggatatgacatggttgtggggttttttttgtttttgttttgtttttgttttgttttgttttgttttgttttgttttgttttgtttttgagacagtctcactctgtcccccaggctggagtgcagtggtgtgatagctcactgaaacctctacctcccaagttcaagcgattctcctgcctcagcccccaagtagctggaattacaggtgcccaccaccatgcccagctaatttttgtagttttagtagagatgaggtttcaccatgttggccaggctgctctcgaactcctgacctcgggtgatccacccgcctcggccttccaagtactgggattataggcgtacttggaaggtaccatgcccggccattatatgctttttaaaaaaacctaaatgttgcaaaaaacatgtgtctaaaatctctgtttcaacatagttttttaatagccatgtaatattccattctgtcaatatgtctttatatgtggtacagactgagtgtctaaatccaagaacccaaaatctgaatttttttttatttttcatttttatttgtttacttatttttgagacagagtcttgctctgtcacccaggttggagtgcggtggtgtgtcggctcactgcgacctccacctcccaggttcaagtgattttcctgcctcagcttcccaagtagctgggattacaggtgcccgccaccatgcctggctaattttttgtatttttagtggacacgaggtttcaccgtgttggccaggctgatcctgaactcctgacctcaagtaatcctcccacctctgtctaccaaagtgctgggattacaggctgagctactgcgcccagcctatttttgtttttttgagacagagtctcactgtgtctcccaggctagagtacagtagccccatctctgctcactgcaacctccgcctcctgggttcaagtgattctcctgccttagtctcctgagtacctgggattacagacgtgtgccaccacacccggctaatttttgtatttttagtagagacagggtttcactatgttggccagcctgatcttgaactactgacctcaagtgatccacccatctcagcctcccaaagtgctgggattacaggcatgagccaccgcaccaagcccccaaaatctgaaatgttttgagtgccgacataacactcaaaaaaatgcttattggccccgggcgtggtggctcatgcctgtaatcccagcactttgggaggcctaggtgggtggatcacctgaggtcaggagttcaagaccagcctggctaacatggtgaaaccccgtctctactaaaaatacaaaaattgaccaggtgtagtggtgggtgcctgtagtcccagctactagggaggctgaagcaggagaatcacttgaacccaggaggcacagcttgcggtgagccgagatcccgccactgcattccagcctgggcaacagagagagactctgtctcaaaaataaaaataaaaaaaaaataataaaagctcattggagcattttggatttgggattcttagatttggggtgctctattggtaagtacaatgcaaatatttcaaaatctgaaaatacccaaaattcaaacacttctgctccctgacatcctgtgtaaacaacactgcagtgaacatttataggtaattcattcagcgggtaagggtcaggaccttttatagggatccttaataccacatttttacatggttcattgagcattcgtgctcccctctgctgtgggtgagggtgcaggtccctcagccttcttgcttgggttgagtcatcctggtctttaatttggtaagcaaaaaatggcatcttgtttttgagctcgtttctgagaaagtgcatgctccttttccccatcaacaactttcatccggcgcctcggaacctcttcagtagagagtgagatgcaaatagcgaggcacagcttctttccctcttctgagctgatgcctggtgaggtcatagactgggtttcattgcaaagacgaaagcgtgggcaggacttttggagcacaaaaaggggcatttcagagtagtcttcatgggcggccactccagaggtgaagttttctagagaaagacatgaaagtactgtgtggctgtggcgacagacagaggcttacgagcctgccctctagagactgtgagctccgcgtgtgagggcaaggcctggggctgtctgggtcgcttctgggtccccaccacagctagcatagggtaggggtggagggggggtgctcaggaagtgatttttgaagagtggatgactgaatacatgcacacacatacttttaagtttctgggttaaagaggaaaacagaatgaggtaaacaaaggaaagtaatgtggaggtgaactgagcagatggcaagatgccgtgaatggttagaggccaggagagccagaatcagagtggcttccgtgaagtgtccctacctcctcccccagcccagctatgtcactcctctgagcttcacacctatggactgttctgcaccctagccctcagatgcaacggtgaaagtgggactcctattgggtttccctgttgaggacagacatggtgccctgtgtatctgctgctgcttttttctttttttcttgctgagtattccatgtgtagcatgtttgtaacacttgataagaaacagaaccatcccagatagcttgaacacttttcaattcagtcagtaacagaccaggtctgctttggatttccaggagcttgtgtcactttattttttttctgagccagggtctcgctttgtcacccagctggagtgcagtggtgcaatgtcagctcaccacagcctctgcctcctgggttcaagcaattctcgtacctcagcctcccaagtagctgggactacaggtgcctgccacaacacccggctcatttttgtgtttttagcagagacggggtttcaccatgttggccaggctggtctcaaactcctgacctcagttgatctgcttgccttggcctctcaaagtgctgggattacaggcgtgagccactgcacccggcctctggattgcccggcctgtgtcactttgtcatgagcccttctcccctagttatcctttattcttcaaacaggcttcctgtgtgacatattttttgagtgcctgctatggggcaagccctgtgccaggtgttcagtatagagtagtgacatcgcctttgccccacagagcataaaaatctaatggaggagacaagccagtccttgtgctagttcatttccacaggtgaatataaaaccacaaactgggcagggcatggtggctcacgcctgtaatcccagcactttcagaggacaaggcaggtggacaacttgagctcaggagtttgagaccagcctgggcaacatggtgagacctcgtctctacaaaaaataaaaaatgaaccaccaggcatggtggtgcatgcctgtagtcccagctatttgggaggctgaggcaggaggatcacttgagttcaggaggtccaggcagcaatgagctgagattgtgctgctcattccagcctgggtgacagactgaggccatgtctcaaaaaaaaaaaagaaaaaaataatcacaaactgtgagtaaggtatctaagggaaaaaactgtgctgggagtgaatgtcaggagacagggagatctgaggcagtatcgtgtccagagcccacagctgaattaatggtaatgcaggtaaatgagctactgtgtgacacaggttaccacagcaagtgtatcggcttttctagggcgagtgtgagctgggtttctggactttgcttaagagcagtgacagacctggaagatactgccccaggcactcttgggtgctttacatgtattggttcatttaatctttaaaccccacaagtgcccttgggattcccattttgcagaggaggctcagggtccttgtcacttgcccaaggtcacagtaagtggaagaatagggagtctagagctgtgctcttcgctgctgccctccagttggaaagctgtccaggccagggacaggctttgcagagagaaggtacagaggacgggacaggcaaatattcagagactatgaggactgaggtggttctgccaactgtggagggcctggtcacttgacaaggcacctcattgcacccccctgaggctctctcaaagccccttttcgagttaggacattgttatctcctgtgtagtttttgttgattgccctctgaaatgctgtgagagggtagaccatccattctgccctcgcctgcccagcccagcacctggcacagtcattgctcagtgtatatttattgaatgaacaattgactgaatgtcaggcccagggctttgccttaggaaacaggctgttggataagaggtagtactaccatactttgcaatttttctggaaatttatgtcacctgggagtggagcagattaccaggctgtttccagagatagcgactctccataaagtgagccaacctgggggctgggcgcagtggctcacgcctgtaaccccagcgctttgggaggctgaggcaggcggatcacgaggtcaggaatttgagaccagcctgaccaacatggtgaaaccccatctctactaaaaaatatgtatataaatgagccgggcgtagtggtgcgtgcctgtaatcccagctactcaggaggctgaggcagtagaatcgcttgcacctgggaggcggaggttgcagtgagcaaagatcgcgccactgcactccagcctgggtgacagagcgagactctgtcttaaaacgaacaaacaaaaaaaacaaaagtgagccaaccctggggaggagtctacgttcagctgcagggagccagggaattggggccgaggtgtctggcacagaaaagctttgggcctgtctcaggtaaatgaagttttgatatagattcaactcccctgccccccacaattgaactgtttttgggggccagcaattaggggctaatttgtgacagtgactttattttcttcctactaaagtactggtttattcggtggccttggtgattagatttaggcataatagttaaatgtaatagaagtttatgtaacaaacagtgattaataatgttgctgtccagattcccgttatagcgctaacctgatgttatgaactgagattaaatttgaatttgagtgcttacattattttgtaaaggtggttgtatattcacatatccacagttttttctataaataacgtgaaaccgtgcttggtttctcttttccaaagtttgccttttccattacatgggcaagtcctgaacctaagccgagacactagtccatcatctccagcaatgaatgtcatccccccagacttcagcatcctgagttaattaaaaggtgcagatgaagttaatcaagtttggaactctaattttgtgcagtgttttgatacgatttgatgagtcatcttttggtagagcacctctctatccctgacagtgtttgatcttaacggaacagttttataatgtgtaaactggtgggaggtgctcttcagaaatgcagtcaacagtggtatgtgtgcgtgtttggctcttggggcggggcggaaagcagaacaaaggagaatttaataagcgagaacttgtcaggggctagggtcagttctgaggctgctgcctgtcaagaacatggctttcttcctgcccccctccactgctgctaactggagtctgaccttcgagaaagagtgaaaaaagacagcttctgtttgttttgctgcaagtaagtggctggactgattggcccccttcccagaggccctgcaaggacttcagatgtggtcagcgaggtatgtggatggtgccagcctgccggccctcgtccagccaaactgcaccaggaacaggcaagggtcccagagaaacagcggggtcagctgctgccgcctttgctcctgctcttaatgctgtcctatttcttcctaagaggaagctggtttactctctcaagattgatgggcaaagttttatatgaccacggtctccacttctcacccactgaacttacagcttgaaattaacagaggcgaggcccatctggaaaaatgcatttgacaaaaacttgatcaaatgggggatcccctgaggtgggtggcaaagaaccagaccacttggaatcctaggtgctgtgtccctgtatggacctgctgtttcttttggattccattagggttaagaagcacaaattctgaagctagatttgagtttacatttctgctccagtacttgggagttacagtgaccaagtcatttaatgtttctgaacttcagtttcctgatctgtaaagtaggatgggtaggttgggcgtagtgggtcatgcctataatcccagcactttgggaggctgaggcaggaggatcacttaaggtcagaagttcgagaccagcctggccaacatagtgaagccccgtcactagtaaaaatacaaaagttatttgggcgtggttgtgggcgtctccagcctgggtgacagagtgagactccatctcaaaaaaaaagaagaaaaacaaaaacaagtaaataaatgaataaaaataaaggaatccagccatctgttagtatagccaaagcagaggatattgcatcaaatgttaaacgctagtcctgtcagtcactcctgagagaacagggcaacaagacccagaaagggtatcaacactgcctgagcagatggaggcaaagctgtgcatgggctgcttatagggcacagtctgaggccttgcagcagtcacgtggaaactgaggctgcctgctttccaggtgcaaggtgatggacagtggcaggaaccctgtgctagatgactcttgtgcgatcttatttctttgttactgggacacaagcaccaactgtcacaagggaccaacaagaggaggtgattttttttttcagctgttaccacaaagcttttcatcttttggtttgaaaacatagctgtgggaataggccgggcgcggtggctcacacctgtaatcccagcactttgggaggccaaggcgggccgatcacaaggtcaggagatcgagaccatcctggctaacacggtgaaaccccgtctatactaaaaatacaaaaattagccgggcgtggtgatggccgcctgtagtcccagctactcgggaggctgaggcaggagaatggcgtgaacccgggaggcggagcttgcagtgagccgagatcgcgccaccgcactccagcctgggcaacagagcgagactctgtctcaaaaaaaaaaaaagaaaaaagagagagaaagaaaatatagctttgggagcaccaaagcccaaagcgttatagtgcctactatgtgtcaggcactatactaaacatttcacatggcttagcactcatgtgatcttcacgataacctggtgagcgggtaattattatcacccttcctactggtttgttgttgttgttgttgtcgtcgttgttgttttgagacagagtctcgctctgtcacccaggctagattgcagtggcacgataccggctcactgcaacctctgcctcctgggtttgagcgactcctgcctcaggctcccgagtagctgggattaaaagcgtccgccaccatgcccagctaatttttgtatttttaatagagatggggttttatcatcttggccaggctggtcttgaacccctgacctcgtgatccacccgccttggcctcccaaagtgctgggattacaggcatcagccaccatgcccggctacttaatttattttttgagacagcctctctctgtagcccagactggagtgcagcggtgtgatttcggctcaccgcaacctctgaatcctgggttcaagcaattctactgcctcagcctcccaagtacttgattataggcacccaccacactttcggctaattttcctatttttagtagagatggggtttcaccatgttggccaggctggtctcaaactcctgacctcaagtgatctgcccaccttagcctcccaaagtgctggggttacaggtgtgagccactgcacctggcctcctttattttatgggacattttttgaaaagaggcttggtccaaacaggcagtacttgccacttctgcagtcatttctctaccctgccccaaaatggttactcagttgcatttatttactacaatcggaataccagcaggacatctacaaaagtagaagtattgggtggtagcagatcagtgctctctggcatccagatcgtctagatggtcacagcctttttttttttttttttggagacagagtcttgctctgtcgcccaggctggagtgcagtggcacaatctcggctcactgcaacctccacctcccgggttcaagagattctcctgcctcagcctcccgagtagctgagattacaggcacccaccaccatgcacggctaatttttttggtatttttagtagagatggggtttcgctgtgttggccaggctggtcttgaactcctgacctcaggtgatccacctgcctcagcctctgaaagtgctgggattacaggcatgagccaccacacctggccaattgttacagctttgagttgactgccaagtgttgaggtagcattgagggttgcagaagctgtgttcttgaaaaagagaagagagtaacattctcagaaagcaaacagtattcagaagagtcaatgggtgttctggagcttttttcttttctttcctttttttttttaaagaaattaccagctgggtgctgtggctcacgcctgtaattccagcactttggggggccaaggtgggaggatcacctgaggtcaggaacttgagaccaggaatttttctatttttagtgaaaccccatctctactaaaaatacaaaaaattagctgggtgtggctgcaggcacctgtaatccccagttacttggcaggttgaggcaggagaatggcttgaacccgggaggtggaggttgcattgagccgagatcacgccattgcactccagcctgggcaacagagcaagattgtctcaaaaaaaaaaaaaaagaaagaaaagaaaaagaaaaagaaattacctcttctctgatatgcagagccccgtctatactggacaggtggaagttaccagagaaatacaggccaggggcctttgtctgacattggcactgagaaaagcatagcccagaagcagggtgtgtcttttttttttacctgggcatctgtggtttgagatcttcttggaacactttataacccatttctgaacgtctcccaggcttcagtggagccacctgttgtagcttctaaaactgtgtcctcctcagttgttctcccacccattgccttcacagatgcagagaccaagattcactcactcgccattggacctttagcacccaggtctgtctggcacaaagtaagtgccaggctggtggagtgaatgaattctacttagagaatggccctcaacacaggctgctcattaccaaaactatttggtctttaaaaagtgtgactctgatgcttcagtctggggtgggtaccaaatacttgtattttttaaagagcctcacagcaacttgaatttaccttaatttttatgtaggaacccttgtcctggtagagagtataatttgctgaataagtctactttttcaatcaacatatacggaagagatatcaatgaaagaactgacaaactgtaaagccccctctccaggtgtaaagcactcagggcttgggcctagaagctgatccatgtctctgtgtctgttctgaaatagcctgtgtgatgtgggagaaagagtattgtccttagagacaaggctcgagactggctgtgccctttccttgggcagtatgtagggaacaagaatgcctgcccgcccgcaggcaggttacctgtggacaaggtgtagtgggcagttagaaggtgttggtatgttaatcagtcttttttttttttttttttttgagatggagttacgctctatcgcacaggcaaagtgcagtggcgcgatctcagctcactgcaacctcccaggttcaagtgattcttctgcttcagcctcccaagtacctgggactacaggcgtgcgccaccacgcctggctaatttatgtatttttttagtagagacggggtttcaccatgttggccaggctggtctctaacttctgacctcgtgatctgcctgcctcggcctcccaaagtgctgggattacagacgttacagacgtgagccaccacacctggccagtctttttttttttttttctgagatgaagtctcactctgttgcccaggctggagttcagtggcacgatctcggctcactgcaacctctgcctcccgggttcaagcgattctcctgcctcagcctcctgactaagtgggactacaggtgcctgccaccacgcctggctaatttttgtatttttagtagagaccgggtttcaccatgttggccaggttggtctcgaactcctgacctcagatgatccacccgccttggcctcccaaaatgcttggattacaggcgtgagccactgcacccagcctaattagtcttttgctcctatttgtctttatttgggataaaagttatagccttgttggggtcttcttacacagtagttctgactcacagccatcatctgaacctttcctctggttcacaaccaaaattaaacatccatttatggggattgagatagttttcatagtaaaggaagttttgtttgtaatgaccttcctgtttgatgggtctaagtatatggctggcccttctggctaaagcaggctttaaactggtcctgcctagaatgtgtacctcccactccttatcatctctcttctaggtcccttcccctttccctttcccttccccttccccttcgcttcttccttccctttgttccttttcctttcctttttttcttctttttttttttttttttttgacagggtctcactctgtcacccaggctggagtgcagtgatgagatctctgctcatgtagccttgaccttctgggctcaagtgatcttctgccttggcctccttagtagctgggactacaggcaccaccatacttggctaaattttttttttttttttggtagcagtgaggtctcactatgttgcccaggattatctcaaactcctgggctcaagcgatcctcacgccttggccccccaaagtgttgggattgcagatgtgtgccatcacactctgcctcttccgggtctttttttttttttttttcccagacggagtctcgctctgttgcccaggctggagtgcagtggcacgatcttggctcactgcaacctctgcctcctgggttcaagcgattctcctgcctcagccttccgagtagctgggattataggtgcctggctaattttttttatatttttagtagagacggggtttcaccatgttggtcaggctggtctcaaactcctgacctcgtgatcctcccacctcggcctcccaaagtgctgggattacaggcgtgagccaccgcgcctggcttttttttttttttttttttttttttttttttttaattttacttttttgagacggagtctcactctgtcacccaggctagattgcagtggcacaatcttggttcactgcaacttccgcctgctggattcaagtgattctcctgcttcagtctcccaagtagctgggactacaggcacgtgtcaccacacctggctaatttttgtatttttagtagagacagggtttcactatgttggccaggctggtctcgaactcctgaccttgtgatccacctgcctcggcctcccaaagtgctggggttacagctgtgagccaccgcacccggctcttccaggtcttaatagagcctttttcctctactgaaagcttccactgctttctgcccccttcaaactcatatatacttcattgaattgtttcctcggggaagccttcctgataccaccctacagagggtgtcagacgccctattatgctgtcacagcacttttcacagtaaggtaaattgcttttataattattggattgcctctctgactatgtttgttgaataaataaaaaaaggtggccaggtgccgtggctcacacctgtaatcccagcactttgggaggccgaggcgggcggatcacgaggtcaggagtttgagacaagcctgaccaacatggtgaaaacccgtctctactaaatatacaaaaattagccaggcatggtggttcgtgcctgtagtcctagctactcaggaggctgaggcagaagaatcacttgaacccgggaggcagaggttgcagtgagccaagattgtgccattgcactccagcctgggcgacagtgtgagcctccatctccaaaaaaaaaaaaaagtggctttataacctgccttctttttcttattcccagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggttggtgtcagtatttatcactgtttagtctggacagataaagtttgttttcaggatttgccttaatttgacaagctcttttattagaaacccttcagagagcaccctgccacattctgctcgctcctgtagacttctgcctctccactagaatagcaatatataaaaaataaagaggggacagattctgatttttacaataagtatcttatattcacgtggttcaaaattcaaggcaatgtaagatctgtaaacattattctctaccttttttcactttatgtgatcttgttatctcttggggacatctccagatcagtacatagtttgctccctcttttccacagctccttagtattctagagtgtgaagcgatggagtttattgaaccagttgcctgctcactcaagttgtgttcaggcttttctaactgcgtaacactgcagtgtgtgaccttgtgtcgtacgtgtgcaggtacaactgcaggataattaggaggaagggagttgctgggtcagaaggttgtaatttatcatttggtcagcattgccaccttgcctccattggtatcctatcaattcatacccccagcagcaaaaccacccatgttcccagcatcctctcacttggacactccatgctttcaccttacgtgactacctttttgctctcataaacaggcttaggatttgattggagaagaccacatagtgactaggtcacaatctctctctctcttttttttttttgagacagagttttgctcttgttgcccaggctggagtgcaatggcacaatctcaactcaccgcaacttctgccgcctgggtccaagcgattctcctaactcagccttttgagtagctgggattacaggtgcctgccaccacgcccagctaattttttttgtatttttagtagagatggggttttccatgttggccaggcaggtcttgaactcttgacctcaggtgatccgcctaccttggcctcccaaagtgctgagattacaggcatgagccaccacgcgctccatccacatctccttccaagcagctctgggatcatgtacacaccctaattccctttccatgtcttgagaggcttcctaaactcggctttgcagtgcctccagcttgtagcagtgataatgatggctgcagtttactgagcagctgttatgtactaggcatcaggtagtaagtagccaacccagatcccaccccaggtatcattacagtgcttgctctagtagcagcatgctaccttggtttcttatcaacagtaaggtctgccagagtccctagtcctttctttgttgacttcctgctgggaacttcaggtgagcaacagcaaaccccactccatttagggccagcagtggtctttgaagcacctgtggtgccctgacccaaaaagccatgattgtcctggtacagtggctcacacctataatcccagcactttgggaggttgaggcaggcagattgctttgagcttaggagtttgaggccaaccttgacaacatggtgaaaccctgtctctacaaaaaatagaaaaattaactgggcatcgatgactggtgcttgtagtctcagctactctggaggctgaggctagagcatcgcttgagcccaggaaagcagaggttgcagtgaaccaagattgcaccactgcattccagcctgggtgacagagagagaccgtgtctcaatacatatagcgtaaggctgggcgcggtggctcacgcctgtaatcccagcactttgggaggccgagacaggcagatcatgaggtcaggagattgagaccatcgtggctaacatggtgaaaccccatctctactaaaaatacaaaaaattagccaggtgtggtggtgggtgcctaagtcccagctactcgggaggctgaggcaggagaatggcgtgaacccgggaggcagaggttgcagtgagctgagatcacgccactgcactccagcctgggcgacagagcgagagggagactccttctcaaaaaaaaaaaaaaaaaaaaaaaggcagcaatagagtggcagtgcctgagcacacgagactgagacatggaaaagcggtttccccaaagagggtgggcagggaaggaaccactttggagagaaaaccagccagcagctcgttaggctgtggctttcctcttctaggaagcagggccttcaactctgctggccggtgatgcagagccagaccgttcatcactttgaatgcccaagtagtcacttggctgcacactcacggcccagcacacagccccaggtatgctcagtggctgccgcttgccactggctgactggctgggattattggaactgaagccctgcatgacccagtccttcttcctgctgcgaagcacagcagaggaaacacttgcttctcacaaactggtcattcctccaccaagagatgagtgccccagtgagttaccatgagatccaagcctgtacagtgtcatcagccgctgacctcacggtgctgatgttacaaaggcaccttgtaaactgctgcctatgtttagatgatggctttttttttttttggagacagagtctcgctctgtcccccaggctggagtgcgatggcatgatcttggctcactgcaagttccgcctcccgggttcacgccattctcctgcctcagcctccccagtagctgggataacaggcgcccgccaccacgcccagctaattttttttgtattttttagtagagatgtggtttcgctgtgttagccaggatggtcttgatctcctgacctcatgatccacctgcctcggcctcccaaagtgttgggattacaagtgtgagccaccacgcccagcctctttttttttttttttttaagatagggtctctctctgttgcctaggctagagtgcagtggcacatcatagctcactgcagcatcaacctcctgggctcaggcaacactctcatctcggcctcttgcgtagctgggactataggcgtgtactaccaagcctgcctaattttttttttttttttttttttttgtattgacagggtctcactatgttcaccaggctgtttcctattttttaaagttatgaaccgcataacaagagagtatacaaagcacatctgcctgagttaaatgataattaatacttatttatttttgttgtagagacgggggtctcactctgctgcccaggctgttctcagactcctggattcaagccatccttctgccttggctttccaaaacttctgggatagacaggcgtcagccacttgtatctcttttaatttggaatagcccttggcaaactggcttgccacctctttttgtaaataaagttttattggcacacttactcatttatatattatctgtggcagcttttgtgccacagcagggttaaatagttataacaaagaccatatggcccataaagctgaaaatattttattatctggttcttttgtttgtttgtttgtttttgagacaaagtttcactttgtcacctaggctagagtgcagtggcatgatctcggctcactgcaacctccacctcccgggttcaagtgaatctcctgcctcagcctcctgagtagctgggattacgggcatacgccaccatgcccagctatttttttttatttttttattttttttatttttttttgagatggagtcttactctgtcacccaagctagagtgcaatggcccgatcttggctcactgcaacctccgcctctgtgctctgtggttcaagtgattcttctgtctcaacctcctgagtagctgggactacaggcgcgtgccaccacgcccggctaatttttgtatttttagtagagatggggtttcaccatattggccagactgatctcaaactcctgacctcatgatccacccagcttggcctccgaaagtgctgggattacaggcatgagccactgcacctggcctgttatctggttcctttttttttttttttttttttttttttttgaatcagagtcttgctgtgtcacccaggctggagtgcagtggcgtgatctcggcttattgcaacctctgcctcccagctttaagtgattcttttgcctcagcctctggagtagctgggactataggcacgtgccaccacgcccagctaatttctgtatttttagtagagacggggtttcaccatattggccagactgaactattcctccaatacggccaaaatgagattctaccagcaatgggaggagtttttttaattattattattgggagtctctctctcacccaggctggagtgcagtggcaccatctcggctcactgcaacctccacctcctgggttcatgcaattcttccacctcagcctcccgagtatctggcattacagctgcccgccaccacacccggctaacttttgtattttagtagagacggggtttcactatgtaggtcaagctggtcttgaactcctgacctcaaatgatccacccgccttggcctcccaaagtgctgggattacagatgtgagccaccgcacccagccctagttctccatgtattttagagctctgtagtggaccttgataagcaggaagatgttacccctggatgaacaaaatgggaatgtgctggtcctggccagggcgtaaggagccggaggtgcctttggacacagctcttgggattggaatggatacagccttttgggagggcattttggcaatacatatgaaaaactagcattgctatatttagaaatttgtcttaaggaattatttcgacgcctgtgtctttgtcaagatgtatgattacagtgttgaacagcttaaatgtccctcaataggttatagaacagaagagtaatagttgataatatttgggtttaaaattatacctatttatttatttatttattttttgagacagtcttgccctgtcaccaggctggagtgtagttgtgcgatctcagctcactgcaacctatgcctcccaggttcaagcgattctcctgcctcaacctcctgagtagctgggactacaggctcaccccaccacaccaagctaatttttgtatttttagtagaaacggggtttcaccatgtgggccaggatgatctcgatctcttgactttgtgatccgcccacctcgacctcccaaagtgctgggattacaggcatcagccactgagcccgccctaattatacccgtttagattgtgcacttttaaaaatgtctagaaggggctgggcgcagtggctcacacctgtaatcccagcgctttgggaggccgaggcgggcggatcacgaggtcaagagattgagaccatcctggccaacatggtgaaaccccgtctctactaaaaattcagagtagccgggcgtggtggcgggtgcctgtagtctcagctactcaggaggctgaggcaggaaaatgacatgaatccgggaggcggagcttgcagtaagccaagatcgcgccactgcactccagcctgggtgacagagcgagactccgtctcaaaaaaagtctagaaggatgtgcaccacactggggagattggaggtagttctgtagggaggctttccctttcacttgtctgtgttccagtttgcttggtgagcacacagcattgtgttcaggagtaggagctggcagagcacacttcctttggggaagtggtggaattaagtgatttgcttactaggatgggtaacttggaggggcaggtgactgtgtcatctaaaatttgtcctctagatgccccatcctggcccagaagggctggtttctatgtgggttgtgaagactttttctgccctcatactttaatttcacgcctcaaatttcccttgcttcctacatgttaacacaggcctgctccctgacatttgtctgggaatagcatatagaacccactggccattatgggtaagaagagaattgcgagaatgtgaccagggcactgaaacatctgatatctctaggacagatataggaagcacagatatagtctttcctttaacttataaaggtaaaaataaaagtattgtgaaagaatttctgcttgccaaagttcaaaggtcttttccaaccacttatgaatcccttgctcagatttcattttcacgcctagatgccagcattaacactgctatctgaatcgggccctcctgctagaagttgtttttattcaggagagcctactactgaatttctccagatgtcatggtcacagttctgttcccagtgctccattttccttgtcttcctctcttttaggtactgcttctccgagatggccccagtgtgtgcggtggttggagggattttggcacaggaaattgtgaaggtaaaacatcactgtggagcagaaaattgttaaccatgactttgtatatgtgctgacagagagaatggaaactgtcttagacagctgcctgctttctctcaccccattcatctttgtttcatgccctccccatttccacctcatcccattttctctggcccatccaggtgccattcagcaaatgaccttggagtgcctgctctgtgcttagctcacagttggccatagtgcctcgaaggtgtgatctgctctcccctaactgtattagttatccagtgcctgttgtattggtcagggattctgcttctcatagctctataagtgagtactatcatgatccccacttaagaggaagacacttgggcccatgaaagggactccagaacctgtgctcttaacctctgtacagtttatctctattcatcaccatgacatcaaagccctcccttttttttttttttttttttttttttttgagatggagtctcgctctgtcccccaggctggagtgcagtagcacgatctcagatcactgcaagctccacctcccgggttcacgccattctcctaccttagccttccaagtagctgggactacaggcgcctgccaccacgcccagctaatttttttgtatttttagtagagacagggtttcactgtgttagccaggatggtctggatctcctgacatcgtgatctgcccacctcagcctctcaaagtgctgggattacaggcatgagccactgtacccagccgcaccccccccctttttttttttttttgagacagaatctcactttgtctctcagactggagtgcagtggcatgatcttgactcactgcaacctccgcctcctgggttcaagcgattctcctgcctcagcctcccgagcagctgagagtacaggttcccaccaccacaccaggctaatttttgtatttttagtagttcaccatattggccaggctggtctcgaactcctgaccttgtgatcctcccacctcagcctcccaaagtgctgggattataggtgtgagccaccgcacccggccaagcccccgtctttttaaccacacactgtaggtatttgtagagaaatcagtttctgtgtccccatgaacacaccaggagcccctcaaggctctgtacaggatgacccgtgaccctgttaggtaggtgttagtgtgtctctcagaagggaagcatcttatacagggtcacataaccagtaactagcacagccttttgagggtcttctggaacatttgggttgctaaaactataccatacccccaaatatattgtacattctttgcagactttgctatttgcccgaagatgttaaatttgccttttgcaggttcttggctgccttcgtggactccggtgaggctttttccttctttcttatggagcagagtcgtgcctggttaaatgattggccatgtccatgtacatgtcaagtttgagcttgggaggacagtttggaggccagcccttaacactttgtcttggggtctgtacattctggaggcgtttggctcaatttgttagtcacaccgttttcctaaggctactttttttttttttttttgtctattttttctgatccttctctctggtctaaattcttcctttgatcaaatctaactttcttctatgtaatgggcaccgaggagatatttggagggggaagaaaagtgtgcaatggccatacctctttccttgctcacattttatacatagcccagagtgatgtgaaaattacagtttatatgcccaatctgagaagagggtaatggccacccagaggactgttcgagcaggattctgaggctccctgtagacaaactgcaggaaagagtgcagcaatgggaatgttctaagtggggaatgggaatgtacatatttttgtagcctaaaatgacgacaccaccaataatagacaagacttactgaaagcccactgtctgccacacaaagacagtgttttttacgtggatactcatttcatctcccaccggccctatgaggtaggaactcctgtgatccctggtttataaaagagagactaaggtgcaggaaagaagatgcttgcccaggctagtgagtgtggtgccaggatgtgggcccaggcagtctggtttctgagcctgtcctcttcaccacggggcagtcatgcatcaggtgttgccttcaatggcaccatcatgtagagactgcatggaccccagggccgctgcccttgcattgtcagccttacttctgcacatcccattgaggggctccccctaaatttttcatgtgggatggagactggaggttggggcaggtagccttgaccccattgttggtggtagtttctcacatccccatcctcacacagccccctccttcctgcctgctggagacagctggtgcccagcatcttgtttctgtttatcccagatagccagagtactctgcattcttcgttgctgggtgtgtttggaatctcctcctaccccatcttgcttgggaagcactttaccttttgccccatgtcaccccatgccctgctctcatccccagtactccttcatacttattactggtcagccttcagccagctggcaggcggggcctgcagtccaagggcctcagactcacctttctctcctgaggcactgtctgagcgcctatggaaagcttacactaggagatgggtcaagcgcaagtctgctcctttggaatcatcttttgcgtctttcctttcttacgtccttctagataccctattttatatccatgtctacttccttgggtttaaagcagttttcctttctctccatccccaccgtccacggcaggtctccctgtctatggtaagagaggtgatagtgaaagcagcagccatcccaggttcatggtaaaacacataccatctcctgtatcttgggtttgagggtctaagagttccacctgtgtactgttggacccttccacctggctaggttggtggcatccccagtattggtaaaggactcctggccctattattattaatagcagctcctacttactaagaatttactacgtgctcggcactttacaagcctagtcacatttcattctcaccaaaactctagcaggcaggtgctttttatttgcctatttgcccagagaagcaaacttctttctgatccaagctccatgtggacagagacctcagaatccttaatgtctagctgaatacctggcatagagtagatgcttaataaatgttcccttgactgggtgcagtagctcatgcctgtaattccagcactttgggaggattgcttgaacctagaagttcaagactagcttgggcaacatgaggagacctcatctctacaaaagtcccagctactcaagagggtatgggaggatatctggagctggggagacggaggttgcagtaagccgagaatgtgcctcccacctgggtagcagaacaagatcctatctcaaaaaattaaaaacatttacaaataaataaaatttccctggaaaaatggctgactaacactatttgtatatggtagatgtgattgtccctgttttatggatgaggaaaagggtttggtgctgagtttgaagaggagcagttcaggatgtgtagccccaccttcctcatgaatgatgggacggtgctcctgggaaccgttaaaccctgccctggcagcttgcctaggtgatgtcttcctctttaaatggtagcttgtggtgaaatttcaatcctttctgggttaaggacctgtttgaaaatttgtgacaattgtgaaccctttctcagaaagatgtatgtgcatacaagactcagtatgttgtttcgggggctgaccctgcctcaaaagacagggccacgtgctcactctccttcccacccctctctctcgctctctgttgcccaggctggagtacagtggtgccatcacagctcactgcagacttgatttccctggacttaagtgatcctcccacctcagcttcctgaggcactgagactataagcacacgccaccacatccaactaattttttttattttttgtagatatggggttttgccatgttgcccaggctggtctcgaactcctgggctcaagtgattctcccgcctcggcctccctaagtgctgggattacagatgtgagacattaagcccagccctgttcttgtattttaaagtgctctgtctggtaaccccacaagataatcaccattgccattgctaaatagcattgtccaggccctctggatcccagccctgaccccctgtggaagcctagcgactctatgtcctcatggaatagcccccgcttctgcatcagtgtgttccttgattaaatgtgtccccttaggtgataaaggccacagcctaagaactgccacctttctcagttgaatagtcatgaataattatttctgctgtttgcccaatggtggtgcaacacagtgttagtcattgttttagttttaaggtgtttttttgtttgtttgttttttgttttgagacagggtctcactctgttccccaggctggagtatagtggcactattacagctcactgcagcctcaatgtcccaggctcaagcgatcctcccacctcagcctcccgagtagctggcaccttgggcatgcatcaccatacctggctaatttatgtcatttttctttttctctttttttttgagacagagtctcactgtgtcgcccaggctggagtgcggtggcgcaatctcagtttactgcaacctctgcctcctgggttcaagcaattctcctgcctcagcctcccgagtagcatgccaccatactcggctaatttctgtatttttagtagagacaggtttcaccgtgttggccaggctggtctccaactcccaacctcaggtgatccgcccacttcagcctcccagagtgctgggattacaggcgtgagccactgcgccccacctattttagttttcatatagacgggatctcaccatgttgcacagactggtcttgaattcctgggctcaagtgattctcccacctcagcctcccaaagtgctgggattacaggtgtgaatgtgcctggccctggcctgttttacatttttgagatacatagtttaacccaggcaaatacatttcttaatctcatgttaggaaaataaggtaatgtttggagaggttaaataatctccccatggacacacagcttgtaagggacagagcaaggagataggacaatcaaaattgtctccagacattgccaaatagccctttgggagcaaaatcgaccccagttaagaaccactgccctagactgcttttagaatttttttttccctctattcctcttaaagcacttgagctaaaccctcttttcatttttctccccaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctattctga

SEQ ID NO: 1495 - DNA, 79814 bp, Homo sapiens; identical to SEQ ID NO: 1494

SEQ ID NO: 1496 - DNA, 79814 bp, Homo sapiens; identical to SEQ ID NO: 1494

SEQ ID NO: 1497 - DNA, 79779 bp, Homo sapiens
ggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacggccgtaggctcccgaaaaggttgcttgtgtttggtatggggctgtgtcttgataggacaggagacgtagtttgggcattgtggagtagcttagggaattctttttttttttttttttttttttgagatagtctctctctgtcgcccaggctggagggcagtggcgcgatctcggctcactgcaacctctgcctcccggattcaagcgattctcctaactcagcctcccgagtagctgggattataggggcccgccagcacgcccggctaatttttgtatttttagtagacacggggtttcgccatattgacgagactggtctcgatctccttacctcaagtgatccacccgcctcggcctcctgaagtgctgggattacaggagtgagccaccgcgccaggacgtcttttgttttgtgcagttgggtgacctcggttcactgcagcctctggcctcccgggttcaagacttcctctcacctcagtcttctgagtagctgggattacaggctcgcgccaccatgcctggctaatttttgtatttttagtagacatgggttttcaccatgttggccaggctggtctcaaactccggacctcaagtgatctgcccgccacagcctcccaaagtggttggattacagacgtgagccactgtgcccagcttgttttttttttttttctttctctgtggcccagtggagtgcagtggtgggatcacagctcactgtagcctcaacctccaaggctcaagggatattccctcttcagcctcccaagtagctgggactacaggcgtgccccaccacatcatccgactaatttttgtttttttttttttttgtaggatggggttttgccatgttgcccagactggtcttgaactcccaagctcaagcgatcctcggcctcaagagatctccccccatctcagactcctaaaatgctgggattacaggcatgagctaccatgcctggcctcattgatcaatatttttacttagcctggacgcagtgactcacacctgtaatcccagcactttgggaagctgagttggggggaggggacctcttgagcccaggagtttgagactagcctgggtaatgttgccaaacccagtctctacaaaaaaatacaaaaattagccaggcatggtgacataagtttatagtcccagcttgtcaggagactgaggtgggagcatcacctgagcccctgggaggtggaggttgcagtgagccatgatcacaccactacaccccagcctgggtgacagagtgaggccccgtctcaaaaaaaaaaaaaaaatccacaagcgtgtgtatatgtgtcagttattaaaggatggtgaagtgagagggttgttttgataggttggccagggaagggctctgaagaggtaacattgagcctcagacttatatgggaaagagccctgtggtcatctgggagaactttcctagctaagagaacagcaagtgcaaattcccagaggcccaggcatgattgtcaaattagagaaataaggtggcaggaaccaaatgatttgaggagtagcttttattctaagtgtgtgggaaaacctgttggagtgttttgagtgtgggagtaacatgatctgttttttgtttgttttttgagacggagtcttgctctgtggcccaggctggagtgcaatggcacgatctcggctcactgccattgcagtgaatccgcctcccaggttcaagcgattctcctgcctcaccttcctgagtagctgggactatcggcatgtgccacaacacccggctaatcttgagtatttttagtagagacggggtttcaccatgttagacaggatagtctcgatctcctgacctcgtgatccgcctgccttgggctcccaaagtgctgtgattacaggcgtgagccactgcggcctggcctggtttgtgttttaaaatgatcgctccagaataggttaaagtggtcagaaatggaagtaaagattctggctggactgttgcagtaatccagttgagataaaaatattggtggcttgaaactcaagagaaggggtcaaataaatatattctggatatattttgaaggtagaagagggaacagaatttggggcagaagtccaggatgacaccactgtttttggcttgagcacctacctggaacgatggaattgccattttgaaagatatggagagctgtaggtttggtggggtcggggaagagtcagttctcttttaggtttcagatttgttttttttgtttgttttttttttttttgagacggagtctcactctgtcgcccaggctggagtgcagtggcatggtctcggctcactgcaacctctgcctcccaggttcaagcaattctcctgcctcagcctcccgagtagctgggattacaggcgcccgccaccatgcccagctaatttttgtatttttagtagagacggagtttcaccgtgttggtcaggctggtgttgaacccctgacctcgtgatccacctgcctcggcctcccaaagtgctgggattacaggtgtgagccaccatgcccggcctcagatttgtttttttatacaactaagtagaaatatgtgaggggttgagttcagaggtaaaatttgggtgatggtgggtattgtgtgagtacagagtatagaattaatggaggggttggggaggcagacacgtcaggagaatttagtttgagggggtgggagctttcagaaggttttagagggtgcagtggtgggatgggaattacctcaggctcatttcagatctgtggggtcttctttgatggggtggggggatgtcatcatgaggcattaacattggtgggagggttgaaggcacctggaatagattgggaattaagtgatgagaatgtgcctctggacataggtggactgcattgattttagggactgctattttctggatggagtggaaagaggatttatgtgagttggaggaaactttgaggaagcttggtgtgttctgagatcctaaagggttggggaggggattctaaggtactggaagggttaatcgaaggggtttgcggcagcagatagctttgtttgaagtggggcaaagttggtgaggtttaaactggaatgtagttagggaactttcagagggatggggatgatttttctgagaagcagtgaagaatggatgggggcctctgagtgggagatgacctaagggacaagtcagggtcagggcatggaatttgtgggaggtaggaattattctgagggagtggagctgtaccaaatttggtggagaacatgaaaaggattggctgggggttgcaggagggagggaagaggttgtttgtaatttgtactctatttttagacagtcttagagagtttattaaagtgttttttgtccattttcagccgaggtttttagaaattaaaaatttttttgtgtgagtacatagtaggtgtatacattttgggggtatgtgagatactttgatacaggcatacaatgggtaataatcacatcagggtaaatggggtatccaccaccttaagcacttatcctttgtgttacaaacaatccaattatattcttttagttgctttgaaatgtacaacaaattattgttgactgtagtcaccctgttatgctatcaaatactgtatcttattcattgtatttaattatatttttgtatccattagtcatccctccttcccctccaccccccactacccttcctagcctctggtaaccctcagtctactatctgcatgagttcaattgttttaatttttttagttcccacaaataagtgacagcgtgcaaagttttctttctgtgcctgatttatttcacttaacataataacatccagtgccctccctgttgttgtaaatgacaggatctcattcccttttttttgtagacagggtctctctgtcgcgcagactagagtgcagtggtgtgatcacaactcacttcagccttgacttcttgggctcaggtgatcctcccacctcagcctcccggtagttgtgactatagcacgtgtcacaagcccagctaatattttagtacaggtggggtttcaccaggctagtctccaactcctgggctcaaataatcctcctgcctccctgcaaagtgctgggattagaggcgtgaacagcaatgcccagcctttgtaccacaatttctatttttttttttgaaacggagtctcgccgtgtcgcctaggctggagtaggctggagtgcagtggcgcagtcttggttcactgcaagctccgcctcccaggttcacgccattctcctgcctcagcctccctagtagctgggactacaggtgcccgccaccacgcccggctaatttctgtatttttagtagagacggggtttcaccttgttggccaggatggtctcaatctcctgacctcgtgtaccacaatttctttatccatttgtctgttgatagacatatgggttgctttcaaatcttggctattgtgaagagtgctgcaataaacatgggatttattgcagttttttttcttttgagaccgagcctcgctctgttgcccaggctagaggacagtggcacgatctcagcccagtacaatctccacctcccaggttcaagcgattctcctgcctaagcctcccaagtagctgagattacaggcacctgccaccacgcccggctaatctttgtattttttagtagagatggggttgctgtgttggccaggctggtctcaaactcctggcttcaggtgattggccctccttggccccccaaagtgttgcaattacaggcgtgagccaccacacccagcctgatttattttcatttgggtatatacctagcagtgggattgcatttttacccgagtcttttttttttttttttttgagacggagtttcgctcttgttacccagactggagtatggtggcgtgatctcagctcaccgcaacccttgcctcccaggttcaagcaattcttctggttcagcctcccaagtagctgggattacaggcgtgtgccaccatgcccggctaattttgtattttagtagagacgggattcctccatgttggtcaggctgtgaactcctgacctcaggtgatccgcccgccttggcctcccaaagtgctgggattacaggcatgagccacagcccccggccttcacctgagtcttatagcagctctctggagtcggaagggcagtgatttccttctctgttcagatgaggaaggaggctccacagagcaaattgacttgcctctaagagggctctaggtgggataggagggttctaggtgggataggagaactctggagactggagttcctttatgaaacagaagccctggaaatgggcaggctgataaaatgtacaaattgtggggcattttataagacagttatcctacttctcttccaaaagtcagtttcatgggaaaaataagtgaagggactgttgtggattaaaagagagtaaaggccgtcacagtgactcagcctgtaatcccaggactttgagaggccgaggtgggtggatcacctgaggtcaggagttcgagactagcctggccaacatggtgaccgtctctactaaaaatacaaaaaaaattagccaggtgtggtggtgggtgcttgtaatcccaactacttgggaggctgaggcaggagaattgtttgaatccaggaggcagaggttttagtgagccaaggtcacactatcgcactccagcctgggtgacaagagcgaaactctgtctcaaaaataaataaataaaataaaataaagtaaagaagcagcttcctagagcagatttggttgcttaaattgaggccaagtttctggagtttttattgatagttgacaattacaactaaaatttttttttctcgctctgttacccaggctggagtgcagtgacgcagtgacgtgatcttcagctcactgcaacctccacctcccgggttcaagggattctcccgcctcagcccccaagtagctgggaccacaggcgtatgccatatcactcagctaattttgtgtgtgcatggcgtatgccgtaacactcagctgattgtgtgtgtgtgtgtgtgtgtgtgttgttttttttttttttttgtgatggactctcactctgtcgcccaggctggagtgcagtggcacaatcttggctcactgcaacctccgcctcctgagttcaagcgattctcctgccttagcctctggagtagctcggattacaggcgcgtgccaccacacctggctgatttttatatttttagtagagacggggttttaccatgttggccaggctggtctcaaactcctcacttcaagtgatctgcccacctcggcctcccaaagtgctgggattacaggcgtgagccactacacccggcctatgtgtgtgtattttatttttttatttttttgagacggaatttctctcttgttgcccaggctggagtgcaatggcgtgatctagactcactgcaacctctgcctcccgggttcaggcaattctcctgcctcagcctcctaagtagctgggattacaggcgcctgctaccgcgcccagctaatgtttgtatttttagtagagaccaggtttcgccatgttggccagggtggtcttgaactcctgacctcaggtgatctacccgcctcagcctccttaagtgctgggattacaggcatgagccactgcgcctggccagaagttaccttctttgtgcctgttttctcagctgcaaaagaggggtaacaaagtgccagcccattagattgtcatgggaattaaatgacataatacatacaaagagcttagtagaacagtgcttggcacatagtaagtgttagataaatgttggccattattattttattatgtaccagatttctataattctgctgatggacacaggtttgttttggtgtgtctattaattcacagccatttgagtaacagtatgtcctaaatgccaaggaagttactggttctagtgatacagtggtttctggagtttacattctaatggaggagggggcagtaaacatataaacaagtagtgtagcttagcacagtggtgtgtggctgtgatcccagctactggggaggctgaggttggaggatcacttgagccaggcaattgagactagcttgggcaacttagtgaggccccatttcaatcaaaacagtgggcaacacagaccccatcttaatcaaaacaaaaacaagtagcataattcgagatagaagaggatgtggacctattttaaattaggtggccagtatggacttctctaaggaggtgacaattgagctgagacctaaagaatgtgtcccttaagaagttgagggaagaagcaatgggaagcactaatgccaaggtcctaaggtgggagcaaggatgggagcaaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagctgagattacaggcgcctgccaccactcccggctaattttttttttttttctttttgaaacagacccttgttctgttgcccaggatggaatgcagtggcgccatctcggctcactgcaaactccacctcccgggttcacgccattctcttgccttagcctcccgagtagctgggactacaggcgcccgccaccatgcccagctaattttttatatttttagtagagatagggtttcaccttgttagccaggatggtctcggtcttctgacctcgtgatctgcctgtctcggcctcccaaagtgctgggattacaggtgtgagccaccgtgcccagcccacgcccggctaatttttgtaattttagtagagatggggtttcaccatgttggccaggctggtctcgaactcctgacttcaggtgatctacccaccttggcctcccaaagtgatgggatttgtaaacccagcactttgagggaggcagaggcaggaagattgcttgagcccaggagctggagatgagcctgggcaacatagtgagaccctgtgtctacaaaaaaaaaaaaaaacccataaatcagccaggtgcagtggtgtgcacctatagtcccaggactcaataggccgaggtggcgggatcacttgaacctgggaggttgaggctgcagcgagccctgatcttgccactgcccttcaatctgggttcacagaatgagaccctgtttcaataaaacaaaacgtaaacatggtatttggtgttgatggcagttgagtatttaatttaatttaatttaattttttttgagacggagtctgtcacctgggatggagtgcagcggcacagtcttggctcattgaaacctctgcctctcaggttcaagcgattctcctgcctcagcctcccaaatagctaggattacaggtgcccgccaccaacatgcccagctaattttttttttttaaacagagtctcgctgtgtcacccagactggcatgatctccgcttactgcaacctccgcctcccaggtttgagtgattctcctgcctcactgtcccgagtaactgggactacaggcgcctgccaccacgcctggctaatttttgtattttctgtagagacacggttttgccatgttagccaggctggtctcgaacccctggactcaagtgatctgcccgccttggcctcccaaagtgctgggattacaggcgtgagcccccacgcctggccataattttttttgtatttttagtagagagggtgtttcaccatgttggacaggctggtctcgaactcctgacctcaggtgatccacccatctcagcctcccaaagtgctgggattacaggcatgagtcaccgggcccggctgaataatgaattttaaacaactgcagagcagtctgtagagctatgtaggaatgtaggtcgtggagagcagatttattgtcagggactttttatatgtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacccccatggctttccatcatgcctcgaagaaaatccagaatccttccattgcatgtaagagccttcatgatgtggccccttgttccaacttttcagcctctctgtcattcctgtccctagaacatgccaagcactcctgcttcagggcttttgcatttgctgttttctctatctggaatgttctgctgccaaatatctgtgtgtttgtcctttatttcattttgatttttgctcatatggcatctcctcagaaaggcttgtatgatttctgtctcaaatagcgttctccatcattcttgattcttgtcacacttgattttcatcactttttcacatattatgtatctatttgtttatctgtctcctactttttcatgagggcagggactatgtctgattcaccgccttatttccacaccatagaaggatgcctggcatagttggtactcaataaatatttgttgaatgaattgttttgtgcagtatggattagagcctgtctctttcctagattcgaggtgtgatgcctcaatgcagttagaaccaaaatgatttttttttttttgagacggagtctcactcttgttgcccaagttgaagtgcagtggcatgatctcggctcactgcaacctccgcctcatggtttcaagtgattctcctgcctcagcctcccaagtagctgagattacaggcgcctgccactacgcccagctagtttttgtattttagtagagacggggtttcaccgtgttggtcaggctggtctcgaactcctgacctcaagtgatccgcctatctcagcctcctaaagtgctgggattacaggcatgagccaccgtgcctggcaaaccaaaatgatttgtgtattttttgttcttctgtgattctgcaagctcactgttctgtatcatcaggttaacaatgtttgtcttacaggctgcgggcctctcgggtgcttcttgtcggcttgaaaggacttggggctgaaattgccaagaatctcatcttggcaggagtgaaaggactgaccatgctggatcacgaacaggtgcgctgttgtgagctcattcctcccctgctctggctcccctttccagcatgaagatctgcagattttgtgagttcctccttgtgccttaagggctgtgaaaggagggctaacattaataaaccattgcctctggagactgaaggtgctattgttgggtttgaattctagctccaccacatctagctggatgagcagtagagactcacaccccctcattgagcttgcctgcctgtaaaatggggttagtaatatctcccttggtggttgcttgtgaggaggtgtagagaagtgtttttccaatttgtgcctaaaaatgacctgagtgactaactgaaaatgcagagtggcctggaggcttcgtggtgccctagctttcacccctagtgattctcatttaggtctgaggcgagctcaggagtatgtgcatttaaaaggtgttttagggctggacgcagtggctcatgcctgtaatcccaacactttggaaggctgaggcaggcggatcatctgaggtcaggagtttgagactagcctggccaacatggcaaaactctgtctgtactcagtatacaaaaattagccaggcatgttggtgtgcacctgtaatcccagctactcgggaggctgaggcacaagaatcgcttgaatctgggaggtggagtttgcagtgagctgagatggcaccactgcactccagcctgggcaacagagtgagactttgccttaaaaagaaataaattaatgaaaggtgtttcaggagattatgatttagatggtccacagacatcactttaaaaaacactggatcaggccaggcacagtggctcatgcctgtaatcccagcactttgggaggctgaggcgggcagatcatgaggtcaggagatcgagaccatcctggctagcacggtgaaaccccatcactactaaagacacaaaaaattagcagggcttggtggcgggcgcctgtggtcccagctactcgggaggctgaggcaagagaatggcgtgaacctgggaggcggagcttgcaacgagccgagatcatgccactgcactccagccttggcaacagagtgagactccgtttcaacaacaacaacaacaaaaacaaacaaaaacaaacaacactggatcagagagaatgtgggcagactgctttgtatagtgcttgaacctaacaagtatccagtaattaggaataatgatctgacatgctgtttgtttgtttgtgtgtttttgcgagacgagtcttgctgtgatgcccagactggagtgcaatggcgcaatctccgcacactgcaacctccgcttcccgggctcaagtgattctcctgcctcagcctctgaagtagctgggattacaggcacgcaccaccacgcctggctaagttttgttttgttttttttttgagacggagtttagctcttgttgcccaggctggagtgcaatggcgtgatcttggctcactgcaacctctgcctcccaggttcaagcaattctcctgcctcaatctcccgagtagctgggattacaggcatgcaacaccatgcctggctaatttaacgtttttagtagagaccgggtttctccatgttggtcaagctggtcttgaactccgacctcaggtgatcctcccacctcggcctcccaaagtgctgggattgcaggcgtgagccaccgcacccggccatgcctggctaagttttgttatttttagtagagatggggtttcaccatattggccaggttggtctcgaactcctgacctcaggtgatccgctggcctcggcctcccaaagtgcggtgattacaggtgtgagctaccatcccctgctgacataatgctgtttgattaatattataatggtagagcccaactccaatgtagctttctctgaccaggctcatcttcaaggtgaaaataagtgctgctctctctacattcccatgcctcagtgacattttatttattttatttatttattttgagacaaagacttactctgtcgcccaggctggagtacagtgacacaacctcagctcactgcaacctctgcctcccgggttcaagcacttctcctgcctcagcttccctagtagctgggattacataattacttcatctggttgtaagaatccaacattggaggccaatcacagaacagtgcgattctgacaccacaggtgtgaggccactgcacccatcttagagcgtattatgtagtttacattcaacaagcatctgagagcacctactgggtgccctgaagtctgctaggtgctggtgatagaaagatgctcacggtttggttcccattctcaaggtttttttttttttttttttccggaaaccatagcaggctccctgactgaggttgtggtacatgaaagatttcctggagtcctgatctgagctaagtcttaaagaacaaggagggttgtcaagataagagcctgtgttttaggcaggggacatagcagtgtcacaaaggcaccctacagtgtggtagaaatggaagctaaaagtagtttggtgtttttagagtgtgagacccaaagtggtgggtagggacaggttgctggtgaagtccaagtcaggaggggctcctaggaagccccactgtaagcttttacttaatcctctgggtggtgcagactcactgaagagtttcaaatgacaggaagggtgacatggttagctttgggctttatgtgtagatcagtaattactgtataaactatggttggcacaaaatacagggcagaagaccacttagaaggcagtttttagtagtttaggtgagaggtgaaagtggccttgctgatagggatggcaggaagcacacagatgtgagaaatagatttaggtggtagaattgggaggtctgtgtatgggagcttaaggaaagccaggaataaccagagcagctgacactgaaggggctaggcactgttctcagagctgcagttgtattatctcattgagtcctcacaacacatctgagatcaaggacccattaccatccctgttttacagatgggaaaactgagtaaaaggaagaaaagtactggcccatccaaggccccagtagttagtggtacggccgggacccaggcatctgactccagagcccatgttctcagccacctcactatggaccactctcatggaaatagcaaggatatgaagatgaggcttctggcttgagtgactgggtgggtggctggtggactccggagacagcacacagaagcaggcagacatgtagggtttatggatatctgagagaaaacggctggtgggcagtacagtagagaagactcaggtggatcaggaagaaatctgcaccagaaagagtgatttgaaaaataacagcagattttggtagaaactgaaagaggcattgagttggtttatggagctatacagagtggaaagataagtaattctgagatggaagcttggggacagccacacctaagagggcccaaattgagactagaatgtgtagcacgagaggagagcaaagcaaggaaggtgtgatctgtggactgatagtgatgaaatgataattgtatgtgtatgggttttttttttttttttttttttttttttgaggcagtctcactgttacccttgccggaatgcagtgggcatgatcatggctcactgtagccttaacttcctgggctcagggtattctcccacttaagcctcccagtagttgggactacaggtgcacgccaccacacctggctaattttttgtattttttgtagagactgggtttcatgattgttgctcaggctggtcttgaactttctgggctcaattatatgttttttttgtttgtttttttgagatggagtctcacttgtcgcccaggccggagtgcagtggtgagatcttggctcactgcaacctccgcctcctgggttcaagtgattctcctgtctcagcctcccaagtagctaggattacaggcgtgtgccaccacacccggctaatttttgtatttttagtagagatggggtttcaccatgttggctaggctggtctcgaacttctgacctcaagtgatccacccacctcagcctcccaagctgctgggtttacaggtgtgagccaccgtgcccagcctcaactgtatttttttttttttttgagacagagtctcgctctgttgcccaggctggagtgcagtggcgcgatcttggctcactgcaagctctgcctcccgggttcacaccattctcctgcctcagcctccctagtagctgggactacaggcgcccaccaccacgcctggctaatttttttgtattttttagtagagatggggtttcaccgtattagccaggatggtctcgatctcctgacctcgtgatctgcctgccttggcctcccaaagtgctgggattacaggcgtgagccaccacgcgtggccctcaactgtacgtttttatccatgtcctcgttttatatgggattcccacattcttgctgaggttcacacagttgttgagccaggatttgaatcaaagattgaatccagcctgaattatttcagagccttactgttaaccattgtgtggtacagcttctcagcacataatgagatccctgaagaagcaggatggaatgggtcaaggatacagggttagcctagaatgggaagtgggccagctcattttcttggaggagaaggtagtaagatagagagtgtgctgtggatggttggtaggaggtgttgaggggagattacttctgttgtacctagtcttggtgaaggtggcaaggttatttgcagagattaatggttaaattagatgtttgatgtgtgaagaaatactttgagagcagtatggaatctgtaatcttactggtggctattaggggattatattatcctgtctttgaggctctgctctgctgatgttcagccttaggggtgaaataattcctctgttccagtccccactcatctctccacctctctgagttctttttttttttttttgagacagagtctcactctgttgcccaggctggagtgcagtggcacgacctgggctcaatgcagcgtctgcctcccaggttcaagcgattctcctgcctcagcctcccgagtagctggaattacaggcgtgtgccaccacgtccggctaattttgtatttttagtagagatggggtttcaccatgttggtcaggctggttttgaactctggacctcaggtgatctgcctgcctcggcctcccaaagtgctgggattacaagcgtgagccaccgcacctggccatagtctatctatgttttttaaaagttcatttcaagcattcttaattgtgtctgatttttgcacaagtttgattttttttttaagttttctcatgaggttgcaatttttgttgttttttgagagagggcctctctgtgttgtccaggctagtcttgagctcctggcctcaagcagtgatcctcctgctttggcgtcccaaattgctgggattacagatgtgagctactgtgccaggctgcactggtctactttttttttttttttttttttttttgagacggagtcttgctctgttgcccaggctggagtacagtggtgcaatcgcagctcactgcaacctccgcctcccctgttgaagtgattctcctgcctcagcctcctgggtagctgggattacaggcacacaccaccacacctggcttatttttgtatttttagtagagatggcatttcaccatgttggccaggttggtctcaaactcctgacctcaggtgatcctcctgcctcggcctcccaaagtgctgggattacaggtgtgagccaccgtgccctgcccacactggtctagttttaaaccactggaagacagagatttaatcctttaaactacttgtgtatttccccaaatgcttatagttgggcacatgctaagtatttagtcaattcttgccactgttaatcagtcatttgttagcagttacaaatttgcatagaagaagaaagcatggatttttttgttgacagtgaattttctttataaacacaagggggtgctctttaaccatcaatgaccagtttaaaaaaagtttaaagtcattttaaagccttagaaggaagcctgcataaggcaaattgctacaggaacagtaatacattttagggctgtgcacagtgtttcatgcctgtaatctcagcactttgggaggctgaggcaggcggatcacgaggtcaagagattgagaccatcctggcaaacgtggtgaaaccctgtctctactaaaaatacaaaaattagctgttgtggtggtgcgtgcttgtagtcccagctacttgggaggctgaggcaggaggagaatcatttgaacccaggaggcggaggttgcaatgagccgagatcatgccactgcactccagcctggtgacagagcaagactgtctcaaaaaaaaaaaaaaaaaaaaatttaggtggtaggtattttagctatcctttaaaatttaaagattctttttaagatttattttccctaaaaatacaagacttaaaaaaatatgtgtattattcctaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtaagtttcttattataaaatctgctgtgggaattaaacaaattaaggtgctagttgtatatactttcaaatcccaaagcaatctgagagcattcaaatatcaaattctgagctttttcccaagaaaatgtataagctgttctattgtttaggcttagtatattgtgtgaatgtgttgctagagaggtccagtctgttgcatctgctgtagttgttggtgacttgctgtctgctggcttcttctctgggcatatgttccctcagccaggtttcgtctttggtgttttgtcttccttccagaatctttgcacataactttaatccatgttattgcaaatgttttcttccgaaaacttaacaagttggtgattaatttctgtggcagcggcatttttttgttagaaatatcaaactacagcttgtgttttgtcttaagaaaagcacacctgatcttgatctatgtctgtctgtctgtttctcacagtcacattgaccatgttgccatggataactagagaaaaatcactgtagtcgtaagtcaaatgaggcatatccagcctcatttagtttcactgccaaatctatgcggaggtgaaaggataaattctttgtcaatatctgcaacctttcagacatagttccctgcattctggaaaagcttaacaaatcttgataaatgtgaaatagtcatagatgagctactagttttttaaatgaaaggccccagtatgttacatgagaggttagaatttgggttgggtagttttttttttttgcacctttttttatttgagatggagttttgctcttgtcgcccaggctggagtgcaattgtgcgatcttggctcatggcaacctctgcctcctgggttcaagtgattctcctgcctcagcctcccaagtagctaggattacaggcactcaccaccatgctgggctaattttttgtatttttagtagagatggggtttcaccatgttggtcaggctggtcttgaacccctgacctcaggtaatccacctgcctcggcctcccaaagtggtgggattacaggtgtgagccactgcacctggcctgttttttacacttttctttctttctttctttcttttttgagatggagtctcactctgtcgcccaggctggagtgcagtggcatgatcttggctcactgcaacctccgcctccctggtttaagcagttttctgcctcagcctcccgtttttacacttttctatttcatatgtgcatctgttcaaatatgggcttggaaggatggatcatctgtgcatttgtcctgttttctttttcctagtcccttctattttttaacttgaggtattgggacactttccatttggacataagtcttcattttcttatctgtagtaaccacatttattttatgccaggtgtcccttgaacttgtagagttagagggtttgttaaaactgaagtgtgaggccagttgattgtgtaatgcgtgtgcatggggccatgttgaccgccttgcaggccgtgtttggctggtccttgcaggttttatagttactttagactctgcagggttccatttgatcaattggttgcatgttcacctgtggatttcttactttttagatgggatttttccttgggtggctgcattctttgaaacaccaaaggaacacatttctctgtgagtgttatttcggtattcaggctgctagacaacagcaaagagggtctatcaagtgaaaatgtccttttgttcaggagaaagcatgtgcaatttggaagttgtcttttgaccatgatcacaaagcttctcccgaaaagatggtattttgtgcagtagaacttagccatttccaatacctcaacttactggaatacaacctggaggccccagagcaacactgataattccactgagtggatcaccagttcattgtctaagcctgaatggaaggtcacttggtctgtaaccttttcttttgtccttaaattcagataaagtttcacaccgcaatctgtggaaaaatgatctcaacaggacttgtttatcttctttatcttaacatatcaatcaaaaggaggggggtaaaaagcccttgtatttaaacatgacctttgggtcaatttaaaaaactggttttgcttgtccctgtagcttatttggattttaatagatttagcagtatagaaacaacttgctaagttattttttttatgagaactatgaaatgtgtatatgttcgtggattacagaaaacatttgttgaatggcttttactttttagctaaacacattttattttggctgcagaacgtgacggtctcataacttatattttctacacattgaaacctgcaacttttcttttgtcttctagccatagggcccaaagaacctgttgtaccagtttgaaacatgctttgagcatgcccagagagactgttcattaagatttatttagacatcagggcagtgattcacagtttgcaaaactcaaacccagccaatttctttctttctgcaggtgtgtctgacttgctgctccagggatgtcatagttaaagttgaccagatctgtcacaaaaatagcatcaagttctttacaggagatgtttttggctaccatggatacacatttgccaatctaggagagcatgagtttgtagagtaagtgttgggagaggaggggagaacataacattttctcctttttatactttttttttttaaattatgtatttatttatgtgtagagacaggatctatgctatgttgttcaagctggtcttgaactcctgggctcaagtgatcctcccaccttggcctcccaaagtgctgggattataggcatgatccactgcgcctggtctgctgacatgttttcaagttgagagatagtaaaatgattacaaaatagttgggcgattctggaggcatattcaaccaaagtctaccttggaaaaggtgtccaatatccagagagactcctctggtagaacaaacagacctcatcctctcattttgaacactgaggctgcagaacttggtaattcttacatgacaggacttgccgtgttttgactttgtagtctctaggtgaaagatggcagatgatacattattgtaaaactatatgagttaggtattttggctgcagtttctgaccaccccctccaaaaccctccaacttgctaattgagagggaaagacaggctctgtgagataggagcttcctaccaagagactgagaactcttctcttgttcagcctctcaggcaagtcactgaaatttctctggtctccaagtttcttgcctgtaaaatcaagatgggggaaggacagtcatgttccagacatctcctaactctagtgttttatggctttaggataatctagttctttgggcatattattattattattattttattttttgagacggagttttgctgttgttgcccaggctggagtgcaatggcaccatctcagttcagaacaatctctgcctcctgggttcaagccattctcctgcctcagcctccggagtagctgagattacaggcatgcgtcaccatgcctggctaattttgtatttttagtagagacagggtttttccatgttggtcaggctggtcttgaactccggacctcaggtgatccacccacctcggcctcccaaagtgctgggattacacaggcgtgagccaccgcacccggctattattattatttttgagacggagttttgcttttgtcacccaggctggagtgccatggcacgatcttggctcactgcaacctccacctcctggattcaagtggttctcctgcttcagcttcctgagtagctgggactgcaggcacccgccaccatgcccggcaaatttttgtatttttagcagagacggggtttcactatgttggctatgctggtcttgaactcctgacctcaggtggtccacccacctcagcttcacaaagtactaggattacagccaccatgcctggcttctttgggtatattataaagaagttatagtagtgggaagcaatccagattattttaacataagctgcccacagcagaggggcagaattaagtttggcttttttttttttttttttttttttttttttctgagacagactttcactcagttgcccaggctggagtacagtggcgtgatctcagctcattgcaacctcctcctcctggggtcaaccaattctcctgcctcagcctcccaagtagctgggattacaggcgcccaccaccacgcccggctagttttttgtatttttagtagagacggggttttgctatgttggccaggatggtctcaaacccttgacctcaggtgacacgcccgccttggcctcccacagtgctgggattacaggcgtgagccactgcacccagccaagtttggctatttatttcatgattcaagtagagtgtttacaaagtaatcactttgatttattgagagcagctgtgtgcccagcagtgtgctgagcaacttacgctgctctgtttttcccacaataatttcctgagtgcccaacagtgtaccagactcatcatgttatcaatggcagagctcgatttgaaccgagatctgactccaaagcttttgcccttaaccaccatcccgatctgtgacctggagaggctttttttgattccaataacatgattcctagggtaaaattacattctctccccttgtcaccctctagggagaaaactaaagttgccaaagttagccaaggagtagaagatgggcccgacaccaagagagcaaaacttgattcttctgagacaacgatggtcaaaaaggtatgtgtaacgtgggggcagaggtcagaaaccctggggccttggaggggtcaggcaatgacgattgaaaaggataagagcaagcacttcttgaaggggtggggcgggtgcttgtcccatctaaagggaggctgccacagcttagtgtcagccagctgttgctgtgagggaatgtgggcccagtgattccagatgggatttttcaagacaatgagaaatgcaaacttttgtaggctctgtcccaaacttttttttttgtgtgtgtgagatggaattttttcttgtcgctcaggctggagtgcaatggcatgatctcggctcactacagcctccacctcctgggttcaagcaattctcctgcctcatcctcccaagtagcacccctggctaatttttttttgtatttttagtagagacggggtttcaccatgttggccaggctggtctcgaactcctgacctcaggtgatccacccgcctcagcctcccaaagtgctgggattacaggcgtgagccaccatgcccggccccataccctttttttttttttttttgagatggagtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagacggggttccaccatgttggccaggatggtatttatctcttgacctcgtggtccacctgcctcagccccacaaagtgctgggattacaggcatgagccaccatgcccgaccagaaaacttttttttttaaagcagcaaaacaccagccctgggttacagtagcaagaccccgtgtctacaaaaaaaatgtaaaaatttgtctggcgtgatggtgagcacctgtaggcccagctactcataggctgagctgggaggattgtttgagcctgggaggtggaggctgcagtgagccatggtcacaccactgcaccccaacctgggccacctagcaagatcctgtctaaaaaaaaaaaaagcaaaacaaaaaattttttgtattttctctactaacaatacaaaaattagctgggcaaggtggtgcgttgcttgtagtcccagctacttgggaggctgaggcaggagaatagcttgaactggggaggcggatgttgcagtgagccgagacggcaacactgcactccagcctggcgacagaacgagactctgtctccaaaaaaaaaagttttctttgcctgtttttttccttttgccaaataacctttaataagaaaaatccttcaatgttgtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagatggggttccaccatgttggccaggatggtatgaatcctcagattcatatttgttaatgtagtttatattaggggctcagcctctatttggattaggtgcaataattacatttatagaaaggagtggagaagggatcagaagacgatggtttctgtagctagtgctggaatctgagatgggaaccatgcgatggggaaagcaagatgaaggggccagaattggtttcattgaactgagaggaaagacatgaccaagcccatatttactctttgctttgtagatttaaatgttgagaaagaaaaacagctggtcagaatgttgagttaaattacgctaacgaggggattctaaagagtgcagaaaccacaaaagagactgcagaaaaccacaaaagtggaactctcagactctccagcaaggcggcgttggagattttctttctcattttgtgtttgtgttggagtagtttggtgctgtaagtgtgatacagaggaattaagccctaattttagtgtctattcacagaaccataattatccagagtgaaccttggtgttttggccaaaacttgggtgcctttctttctttttgaggcccagtcaagatttatctgaatagctccgtgaatttggtggggggagataaattgttaacaaacggaggagtacaaaagctgctttgtgggtgctgtcagtttataaatcacaccctcttacaagtgtgacacttggccttggtgtgaagggttttatggcttaagggccttctctgattgaggcaggtctttcacattcaaatggagagagtgcctagctttgttagccattcacagctggaagtttccctggagtcagttctgatggtgcccactggggtggatctggaaacctcttttgggaaccactttatctcgctatgaggagaatgtgggcagcccaggcctttgcccaccattccggagggccctacaggcacagaggtttttgtgcagcctcttcctacgtggagctgagctggaaggtatcaaaatattccccagctgacattgttagtcagctgttacacttgaacaatgcaggctcggattccaaccccaagcccttaaggttacgaggcattcagtgcattcctgctgacaatccctgggattccaaaccttgcctttgtgcagcctcaccaagggccctgcggaccgactgggctggactgggttttggccatggctttgtcaccttgcaataacatgcctccttccgttttggcacagatggccctgtgatttcaaggttctcttccaacaccaaagattccttgattcagatgctgcccttttgcctaattgtacagaataactagttgggttgtgctcagagagtgcagggtgggggtggggaagcagctacttcctgtttcctgtgaaaggttttctggttagggttcccttcccctccccgctttccctaggtttaaccaaaggttgtaaagccacttttgcttcaaggtacactttgtgctcctaaattagtaacgttgaaaaacaaaaaggaaaaacagcctgtggttttcacaccctctaggaagctggtgggcctttctagcacctgtgccattctgataaataagggcttaggaaaatgcctagcccagaaataggtgctcagtagtttgtttgcttcctttggtgctcaggagaagatttgagacggatttcgtcacaatcaggtctcgggcacaagcctcacatggacactgacatgcaggagccagaggagacagcaatgaggtggtggtaaggaagtgcccaaaaaggtttcccagaggaagagttgtttgtgttggcatgtgagggacaagctttccaggcaccagagccaagagcagtgctctgtccgaggaagtaggataaaccgaaagacggacgtaggggcagagttgctgtggctgccctcactgccgcagccagctccttccatgagttgcagaatgcctactgtgtgcaaggcactgtgttgagtgcagggaatcacatccagtcttgttgtccccatctatagctgataaagaagctatgagaaattaagtgacctgaccaaggccacacagctgtggaagaaggggcgagagcatagacagtgggtaagggcataggctcaccctatgatttacaaagagggatacccctgaagttgctagggtaacgtgacatattaggaggatggtgggataaaatatgtgaacatcgggatcattctggaaaacctttaggataaaaggccactgtcatgctcccatgttcacgtttctttattgtgagttatctgtgttaggtgctgccagagatgatgagatgcctgacagtggttactctgtaatagctctttaaaaattaaagacaaagtagggtttgttcctgactgtactagaaatacagatttaattttacctctgctcctgaaataggtgactaatttggagtactattaatactcttttcatgaattagttgagaaattccacagttgaggagtgattcattcttttgactccctctttctgagcaatttgttgacagccttctcatcctctcttacacccgtcattaaagaaacagtcgagttctttttctttcatgtggtaccttggtttccactgctggtggcccttaggttgcttgtctctgtctccccgcttccattttaagctccatagggggaaggtagtcttgttcactgctagactcctagtccagtgtgtagcacagtcatatccacggaatatttgttcagtgtactggtggctgttaactgcagcataatccagcaaccctggagattattttcttcctttttttttttttttctttgaagcagggtctgactactctgtcacctaggctgaagtgcagtggttcaaacactgctcactgcagcctcccaagtagctggaattacagacatccactacacctggctaatttttaatttttaaaaattattattatttctgagatggagtcttgctgtgtcacccaggctggagtgcagtggcacaatctcagctcactgcagcctctgcctcctgggttcaagcaattctcctgcctcagcttccggagtagctggaactgccagtgtgtgccaccacactcgactggtttttgtatttttagtagagacggtatttctccatattggccaggctggtctcgaactcctggcctcaagtgatccgcccactttggcctcccaaagtactgggattataggcgtgagccacagcttccagcctgattgtttccattttaaaaaagagtaattgaagtaacctttgttaccaatgaaatgaattaaccttctagtatattaattctcacggtttaggttatttgaactaagctgagagaacagaataccaaagaagacaatagacttgcccagaaatatttagaagtaagtcactcagttgcctggattggaaccctcaggccagagaggttcaaaatcctgcatttttttttttttttttttttttttgagacagagtctcactctatcacccaagctggagtgcaatggtgcgatctcggctcactgcaacctccgcctcccgggtttaagcgattctcctgcgttagccttccgagtagctggaactacaggtgcgcgccaccacgcccagctaattttttttttttttttttttttttgagatggactctcgctctgtcgcccaggctggagtgcagtggtgcgatctcagctcactgcaagctccacctcctgggttcatgccgttctcctgcctcagcctcccgagtagctgggactacagatgcccgccgccatgcccgactaatttttttgtatttctagtagagatggggtttcaccgtgttagccaggatggtctcgatctcctgacctcgtgatccgcccacctcggcctcccaaagtgctgggattacaggcgtgagccaccgtgcccagcctaatttttgtatttttagtagaaacggggtttcaccatgttgaccaggatggtctcaatctcctgaccttgtgatccacccgcctcagcctcccaaagtgctgggattacaggcgtgagccaccactcctggccaatcctgctaattattaatatcagaactacttggttcaaaggagtggaaatagggcaacgaggggtgtaaatttgcagttaggtggaatgctgatagcaagttttccaggtaggagagttagttggggtgggggatgctaatgttagcttatctctgtatatatatttaattttatatgttatttatttttgagatgggatgtaactctgtagcccaggctggagtgcagtggcacaaacacagctcactgcagccttgaactcctgggctaaagggatcctcccacccacctcagtctccaaggtagctgggaccacaggcatgtgccaccatgctctgctaattttttcgggtttttttttttttttgagatctcttgctgtgttgcccaggctgatctcaaactcctggcctcaagtgatcctcttgccttggcctctcaaagtgctgagattataggcatgagccaccgtacccagcctatattttttttattgtgacatttaatgcacaaaagaagatatgcagcatcaatgcagataatggaacaaaacaaacactatccgccttaaaaacacaaatatttttggtacttttgtaccaatctgtatgctgtttctctatcttctacttcttctccctgtaccctcaccaggtaagtaaccccagagctgctggtacatttgtgtggattaaaaaagacacctggaaggggcagatacagccctgcttgacttcctgttttatcacgtgtttataaatctaaacaatgacatggaacttattatacaatattttaggcataaattaagaatgatttcgctcaccatcatagacctaccactcaatttgaagcatcaaacattactggtatggtgaggccctctggctgtccctccaacagaagttaccaccctcctcagttgggtttctcattcctatgcatttcttcttactacttatgtatgtatttccaagcaacacatagaattgctttgcatgctttttatcttcttaaaaattggttttatattgtatgcatggtgccacctgcttttaaggagaagcaacacgtttgtgaggccatctgtttatatgttgttctagggctttgctgtccattttggtagccactagccacagctggctgtttaaattaattaaaatcaaatcaaatcaaatatttagttcctcagtctcactggtcacatttcaagtggccagtaagcacatgtggccattggcatctgtattgcatagcacagattacattctgttccatcatcacagctagttctcttggacagccctgcagggcatttctttttggtttttgttttgtttttatttttgttttttgctagagtctttgttgtgtaaatacattactattttatatccatttttctatttataagcatttgggtatgctcataatttgctgttacaaattgtgctgcataagcattttgtttgtgtgtgtatagatgatctccttgggcaattgtgttaatttctcttgggtatatacctgggagtaaaattaagataagggcattttcagctttaccagaccccgttaagttactctcaagtggttttatcaatttatattctagaaccaacattatgtatcagtaacatttggtaacttcaggcgttttttttccattctgctgagtgtgaaaaatgtgttttgattatggttgtcatttgttagaatactttgttaaagctttttaaagattcttggtccctctaccctccccaccccctaccccaggaattttgattgggtaggacctggggattatattcatctttatatgcagaattatattacttgttactgttaggcctgatttaagaagtaaaataaggctgggtgcagtggctcatgcctgtaatcccagcactttgggaagccaaagtgggcacatcacttgagcccaggagtttgagaccagcctgggcaatgtggctaaaaccccttctctaccaaaaatacaaaaattagctgggcgtggtagcacgtgccagtggtctcagctactggggaagctgaggcgggaggattgcctgagcctggcaagtgtaggcagcagtgagctgagattgtgccactgtagtacatcctgggtgacagagcaacacactgtctcaaaaaaaaatttttttttaagtaaaataagttcataattccaaatgtggaaaatgcagaacaagttaatgaaatgttaatcctactaccaaatgataactataaccttcctttcagtatttttctatgtatatacaacaaaattggggcactgtttaatacagataatatatatagttagctctccttattaatgggcttcacattcatggattcaaccaactgtggatcaaaaatctttagtgtgcttggagtacatccaaaaaaaaaaaaagaaaattgaaattatgttaataataaaatatttgggaaaaaacattgcgtctatctgtaccaaacatgtacagactttttttcttgtcattattccctaagcaatacaatataacaactgtttacatagcaattccattaggtattataagtaatctagagatgatttaaagtatatgggaggccaggcgcagtgcctcacgcctgaaatcccagcactttgggaggccaaggcgggtggatcacttgaggtcaggagttggagaccagcctggccaacatggtgaaaccccatctctaacagaaatacaaaattagctgggcatggtggctcacacctgtaatcccagctactcaggaggctgaggcaggagaatcacttgaacttgggaggcagaggttgcagtgagccaagatcgcaccgttgcactccagcctgggcgacagagcaagactctatctcaaaaataaataaataaataaagtatatgggaggatgcacgtagagtatatgcaagtactgtgccatttatttatttagagacagagtcttgctttattgcccaggctggagcgcagtggcgtgatctccgtctcccaggttcaagtgatcctctggcctcagcctcccgagtagctgggattacaggcttgtgctaccacacccggctaagttttgtattttaagtagagggcgttttcaccttgttcgccaggctggtctcgaactcctgacctcaggtgatccgcccacatcggcctcccaaagttttgggattacaggcgtgagccattgcacctggcttgtatatgtgtatatatatgtacatggttttgtcttttgcttttttcactcaataagcattccccaaatctgctttggagcacatgattttattttatttttatttttttatttttttgagacgaagtctcgatctgtcgcccaggctggagtgcagtggcgcaatctcggctcactgcaagctctgcctcctgggttcacgccattctcctgcctcagcctcccgagtagctgggactacagacacccgccaccacacccggctaattttttgtatttttagtagagacgggtttcaccgtgttagctaggatggtctccatctgctgacctcgtgatccgcccgccttggcctcccaaagtgctgggattacaggcatgagccaccacgtctggcctggagcgcgtgattttaaatgtctgtgtcatttttcctcttcttgcctagccataatctattttaccagtcacctattgtattgaggttattgaggttattgcagtttcctactatgctaaatggctcctgacaacaaatttgatggttgatgggctatgtggagaattcacctttttttttttttttttttttttttttgagacagagtctttctctgtcacccaggcgggagtgcagtggcatgatctcagctcactgcaacctctgcctcccaggttcaagcgattctcctgcctcagcctcctgagtagatggaactacaggcacctgccaccacgcccagctaattttatttttgtatttttagtagagagggggtttcaccgtgttagccaggatggtctcgatctcctgacctcgtgatccgcctgcctcagcctcccaaagtgctgggattacaggcgtgagccacagtgcccggctaatttttgtatttttagtagagacggagtttcaccatattggccaggctggtctcgaactccagaccttgtgatccactcaccttggcctcccaaagtgctgggattacaggcatgagccaagtctttttttttttttttttttttttttgagacggagtcttgctctcttgcccaggctggagtacagtggtttgattgtgatctcggctcactgcaacctcagcctcctgggttcaagcgattctcctgtctcagcctcccaagtagctgggattacaggcacatgccaccatgtccggctaatttttatatttttagtggagacggggtttcaccatgttggccaggctggtctcgaactcctgacctcaggtggtctacccaccttggcctcccaaagtgctgggattataggtgtgagccaccgcacccggccttgttattagtcttaactagattgttgattgaagtccttaagcccagaaatgtatgtgaaggatggtggagaagagtggctcaggcattctaggcagaggtattcttgagctgaggaagtggaggagaggaggtatgtaagttacctgttttcaggggttcattccagtggatagtggatgccactccctggcagacactgtgggtgcctcacctgaaagactcctgattccctgaaggcattgtcgggtgtattttttctttataagcgtaatgccagtggagtgggtaagacaggtaccaccttttgcatctgctgctacagattaggcagcttggttaagttttgttttgtttttaattgttatgagttagtttgaaccaaaaggattgttaagtggagtgtaagaagcactgaataactactgttatctgagaggagtagtaaagaccagggccactgggcaatcccagaggcattaggaatttgtggcctttccctttagagcattgtcattatgtgtatctgcatctctgcattccaactttcacattttcagttcccaggagagagaatctgattggcctggttggggtcctgtgcccacttctggctgtcacctgtggctttcttccctcagttgtagaccacactctggatacctgggacccctgaaatctcctgcccagacaaccccaagcttctcaggactttttgtgggctgcttccctgttctgcctgtgcagtgcaggccttgtcacaatgtctgaatgcttaggccagagacgtgggggtttggtgagaaaggatgagctgggtagctacactcaagtgcagagccaccagtattgtgggacagagccaggcatgggaagagaagtgggcacggatgggggccagctttcccgatgtgccttaatctggcacagaactcctaaggagtgtgaaaatttcaaatttgatccaggccttccaggtggttatgaagaaggcgagtttgtcaagacaggataatacaatatacttcatttaatagcttgttagtgtgatttataactaaatatgtagacatcatatatgggtcttcattcatactcttgccccaggccctgaaagtgttagctaacaggcaagacctgcctgggactgagattctaaaacacaacctccacccccaactccgtttcatcatatagtagcctaacatattagttggttcgttgcttatagtcaggcaaacaacaaagactccgaattgagctcttggtaatttttgaaacctgcctggtaatactgtgtttcctcattctgatggcattcccagaccatattgcaaatgacttgatgtgtattttcagacttgttgagaagggcctggtggtctatatagcaggcataaaatgtcaccaggccgacttcatgacttatcttttgaggtcaaacagacccattgaccaaaagatttgagggcagtgaaaacatcttgtatactatctttaacaatggatttaactcctaaaggaaagccacctaaacatgactgtttaatcttcactagcaatttgaacttttttttttttgagacggcgtctcaccttgttgcccaggctggagtgtagtggtgtgaccttggctcgctgcaacctccacctcctgggtccaagtgattctgctccctcagcttcctgagcagctgggattacaggtgcctgccaccacacccagctaatttttttgtatttttagtagagacagggtttcaccgtgttggccaggctggtctccaattcctgacctctagtgatccacccgccttggcctcccaaaatgctaggattacaggtgtgagccaccacacccggcctgcgcccagataatttttgtattttttttttttttgagagtctcgctctgtcccccaggctggggtgtagtggcacgatgggttcacgccattctcctgcctcagcctcccgagtagctgggactgcaggtgcctgccaccacgcctggctaatttttttgtatttttagtagagacggagtttcgccatgttagccaggatggtctcgatctcctgaccttgtgatctgcccgccttggcctcccaaagtgctgggattacaggtgtgagccactgcgcccagccaacaatttgaacttttatctgtcaaatctatatgcatccttagcaagctttgtaaactgcctggtaactgatagatcttggttcacttagcttcccaaattatgctgttatcatcttgtctctctgttctttaaatatctggttgggagggtatggagagagagggaggaagaaagacacctctgtaagtttgaaattatttgcatcccccccaccgcccaccaccaacctttttaaaatatagagacacagagtctataccacgcctggcctaaaataattttttttagagacgggatctaacagtgttcccccagcttggctatcttaaacttcttaagggtagctagttctaagaactgcttttttctggctaggcacagtggctcacgcctataatcccaacactttgggagaccgaggcaggcagatcacctaaggtcaggagtttgagactagcctgggcaatatagtgaaatcctgtctctactaaaaatacaaaaattagctgggcgtggtggcatgcatctgtaatcccagctactgggggcgctgaggcacgagaattgcttgaacccaggacacggaggttgcagcgagctgagatcatgcactgcactccagcctgggtgacagagggggagactgtctggaaaaaaaaaatgtttaaaacaaaaaactgtttttttgtatgtgtgtttatatgcgaaccatttgtgaaagtggtcccagcatgatgccacatgtgtcatttccaaatatttcagtctgtatttttttctctctctctctgttttttctgtcacccaggctggagtgcagtggtacgatctggctcactgcagcctcgacctcctgtgctaaaacagttctcttgcctcagcctcctgtgaagctggtaccacaggtgcatgccactgcacccagctaacttgtagagattggggtctcactttgttgcccaggctgttatttgactcctggactcaggtgatcatgccactttggcctgccagagtgctgagattacaaaagtgagccaccacactcagccataaatgtgttgttgttgttgtttttgagacagagtttcgctcttgttgctgaggctggagtgcaatggcgcgatctcagctcactgcaacctcccccctcctaggttcaagcgattctcctgcctcagcctcccaggtagttgggattacaggtgcctgccaccacgtccaactaatttttgtatttttaatagagacggggtttcactatgttggtcaggctggtcttgaactcctgacctcaggcgatccacccgcctcggcctcccaaagtgctaggatcacaggcgtgagccactgtgcctggacttgtaaatggtatttcaaagtaaaatatatgtcattgcatttatcaagataatttgattgagctttgtaggtcctagccatccttctgcctattactgggctttttgcaaatgctgttcctgtttccacaacctggagcattgtcccatcccttttattgtttctcttgctgttatttattatgtcatccatcatcattataccattcctctgccaagaaacatttaatttttgtttttgtttactattacaaaaatgttttatagaatattgttagacttacattcttgcccctcattgtggaagtattcctgtagtatgaatacagccagaggttttttagttttgttttggtttttttgaggagtcttactccttcatccagaggctggagtgcagtgacgcgatcttggctcgctgcaaactccacctcctgggttcaagcgattctcctgcctcagcctcccaagtatctgggactacaggcggccgccagcatgcctagctaatttttgtatatttgtagagacgggggtttcaccatgttggccaggctggtctcgaactcctgacctcatgtgatccgcctgcctcggtctccaaagtgttgggattacaggtgtgacccaccgcgcctggcccagtgagagttaaagggccagagtggaagcaggtctttggaagcttggctctgtcttccttcagtgcagggagtttgtgttgtccatccccagcctctacagaagcacacagtgagtgttcaataagcatttcttggatcaaatggcccctgcttcttttaatggtcagtaaactttaaataatgagatttttctgcaatagagaagagcaactgccttgtgattggaagccagcatatgttattcctaagcagttctgccttttttccacagaaggtggtcttctgccctgttaaagaagccctggaggtggactggagcagtgagaaagcaaaggctgctctgaagcgcacgacctccgactactttctccttcaaggtgaggtctcaaagcacaacttaccccgggagagcttttggctctgatttctgcaaatgtggttgcaaggtccagatggttttgtgatgtttgccttgggtggcattcttcattggctagttctcagtgatcacttgagaaaggggtggtcacttgaagggggtgaggtctaccattgagctctgggttctaatgacttctcctttttttacttgttgaaatgacctccctgtcaagttgaccttatggtaatagtgttacaggtcacagattgagaaacctctttttttttcttttttctttttttgagacagagtcttgctctgtcacccagactggagtgcagtggggtgcaatcttggctcactgcaacctccacctcctgggttgaagcgattctggtgtcttagtgtccccagaagctgggatgacaggcatgcaccactgcgcccggctaatttttgtattttgagtagagatggggtttcaccatgatgcccaggccctgaagttctgagattataggcatgagccaccatgtgaagcctgatcaaccaacttctcttcaccgccccccgcctttttttttttttttttttttgagacagagtcttgctctgtcacccaggctggaatgcagtagcgctatcatggttcactgtagcctctacttcctgggcttaagtgctccccatgcctcaggctcctgagtagctggtactacaagcacacgccactgtgcccagctagtttttgtatttttttgtagaagcgaagtttctccatgtagccaggctggacttgaactcctgagctctagtgaaatccccgcgttggccttccaaagtgctggagttaaaggcgtaagccaccagtgcttgttcccctcttcagaattctttctctgcctcaaaaccatcctcacgcttatgaaaggtggggttgtttttcctcttgctattaatgaactacttatcagtccatctttgctggtggtcaagagactgttagtaagtattggttggcttttcagtgttcttcctgtacctggcacttttttgtttgtttttgagatggagtctcgctctgtccccaggctggagtgcagtggtgtgatcttggctcactgtaacctctgcctcctgggttcaagcgattcttctgcctcagcctcccgagtagctgggactgcaggcgcgtgccaccacacccagctaatttttatatttttagtagagacagggtttcaccatgttggccaggttgggctcactctcttgacctcgtgatccgcccacctcagccccccaaagtgctgtgattacaggtgtgagccaccgcgcctggcaaacctggcacttttaatttttattttaattttttttttggagacggagtctagctctgtcgcccaggctggagtgcagtggcacgatcttggcacactgcaacctctgcctcccaggctcaagcaattctcctgcctcagcctcccgagtagctgaaatacaggcgggcaccaccatgcccagctaattttctttttttttgagatggagtctcactctgttgcccaggagagcagtggcgtgatcttggctcactgcaacctccacctcccaggttcaagcgattctcctgcctcagcatcctgagtagctgggatcacaggcacctgccaccacgcttggctaattttttgtatttttagtatttttgtattttttttgtattttcaccatcttggccaggctggtctcgaactcctgacctcaggtgatctgcccacctcagtctcccaaagtgttgggattacagacgtgagccactgcacctggctgcgctaatttttgtattttagtagagacagggtttcaccatgttggccaggctggtcttgaactcctgaccccaggtgatctgcccacctcagcctcccaaagtgctgggattacaggcatggtagttttttaaaaagtattttttttaatgttatttatgcatttatttttttgagacggagtctcactctgtcacccaggctggagtgcagtggtgcaatcttggctcactgcaacctccacctcccggttcaaacagtttccccgcctcagcctcccgagtagctgggattacaggtgcccaccagcacacccagctaatttttgtatttttagtagaaacggggtttcaccatgttggccaggctggcctcaaactcccaacctcagatgatccacctgcctcggcctcccgaagtgctgggattacaggcgtgagccaccacgctcagctggatgaactatttgaaagtcccgaatatccatttgtgtagaaataaatgggttgagcaggaatgagtgttgcatgtgagtgggctgcactcagaaaatgcctcctcttgatagtgggatcaggtgtggaagaggcaccagcagtaagagcagagtcttttccatgtgggaacagtgcctgggccctttgggagaagcttgttgctcactgcctcgcacatagaaagccctcaggaaacaatggcgctaatttgccaaggtttgggtttgacttgagcatctctaactgctgcttatgaaaggagtcaactgggctgggctactaaaaatacaaaaattagccggatgaggtggtgtgcgcctgtaatcccagctactcgggaggctgaggcagaagcacttaaacctaggaggcaaaagttgcagaatccgagatcatgccaaagcactccagcctgggtgacagagctgaactccatctccaaaaaaaagggggagaaacagagtcaatcacagatcatctactccagagttgaaaagtgtacacgccaaaaaaaaaaaagagaaaagaaaaaaagcacatatcttcacggatgacagagttctctaggacttgctctgtgccgggcgttttccatgtatatcaccttcatctcacaaaggccctcaggcaagtgctattaacaccaccagctacagaggggaatctgaggctcagggaatttaaagtcagtggctcaagatcacccatctaaaacaaaatggcagtgcccactggaagccaggtctgttttgattccaaaggtcttgttctttttctttttccccagagacagagtcttgctctatcacccaggtaggagtgcagtggggcgatcttggctcactgcaacttctgcctcctgggttcgagcgattctacaggcacgcaccaccacacccagctaatttttgtattcttagtagaggcagggttccaccgtgttggccaggctggtctcgaactcttgacctcgtgaaccgcctgcctcggcctcccaaagtgctgggattagaggcgtgagccaccgcgcccggcccaaagtcttgttcggaacaaccatgcaccactgcctgccacagaagtcatatagctactgtttcttcctcaaccacctgtccacccctccaaccccgtaacttctgatgctgatgtccagtagcacctgcactgaatattcactttgctcctagatatcagttttgtcccctcagttcaatgacccctgtgatgttgagatggatgagaaaatactctggaaactgcagaggataaaatcaggatttcctcacttcagcacactactgacattctgtgctggataacactgtcacgggggactgtcctgtgcactgtgggatatttagtaacacccctatcctctactcactagatgccagtaatatctccccacccagctctaacatcaaaaaatgtttccagacaccactgccacatgtccccagttgagaaccactggattatgctaaactcaaaggccagttgactcctttcttttctttcttttcttttttttttttttttgagacggagtctctctctgtcacccaggctggagtgcagtggtgcaatctcagctcactgcaagctcagcctcctgggttcacgccattctcctgcctcagcctcccgactagctgggactacaggcgcctgccactatgcctggctaattttttgtatttttagtagagacggggtttcaccgcgttagccaggatggtctcgaactcctgacctcgtgatccacccgcctcggcctcccaaagtgctgggattacagacgtgagccacttcgcccagcctgtttacccttaattccatccctcagtgggtattatggcaacagtctcatgagtgcctatgaccctttgctggataatatatcctatcatgtttaccactctctcccagatggcattaattatctgtctttttcagttttgagttccagggctttggatatggtaatcaaaacattaaaactatgtgcagtaaatttcttttcttttttctttttctttttttttttttttggtgtggtgaaaagcacataacataaaatttaccattataacttaagcgtataggtcagtaataatcatacaatgttttattttattttgtttttttctgagatggagtttcgctcttgttgaccaggctggagtgcaatggtgcgatctcggttcaccacaacctccacctcccaggtttaagcaattctcctgcctcagccttctgagtagctgggattacaggcatatgtcaccacgcctggcaaatttttttttttttttttttttttttgtgagacggagtctcgctctgtctcccagcctggagtgcagtggcatgatctcagctcactgcaagctctgcctcccgggttcacgccattctcctgcctcagcctcccgagtagctgggactacaggtgcccgccaccatgcccggctaatttttttgtatttttagtagagacggggtttcaccatgttagccaggatggtctcgatgttctgacctcgtgatccgcctgcctcagcctcccaaagtgctgggattacaggcgtgagccaccgcgcctggccacatttttgtatttttagtagagacggggtttcaccatgttggccaggctggtctcaaactcctgacctcaggtgatcctcctgcctcggtctcccaaagtgctgagattacaggcgtgaggcaccgtgcccggcagtgagaacatttacaatcacatattgtgtagcatcaggaaggatttttaagatcaaagttagcacattagaagtggaaataatttaaaagtggccttgattttttttttttttttttttttttgcctactgtaaagtcaagcctcagtaacattctgatttcaggatgcagggtggctttgggggatatccaagttgagtggtaaactttgtaggcactactcttgtttccatgttcctggcacctaagttgatatattttctcacagtcttgtgacaatctttgaagtatagttgttatcccattttcctataaggagaccaaggttgagcatggttgtgattgccgaaagtcatatccgtggttttatagacagtcagaatttagaccatgaggtttgttttacctgtggacttagttttcaacatatttaagatatatctgtagtctgggcgcggtggcttatgcctgtaatcccagcacattgtgaggctgaggtgggcagatcatttgaagtcaggagttcgagggcagcctggccaagatggtgaaatcccgtctctactaaaaaacacaaaaattagccaggcatggtggcacatgcctgtagtcccagctacttgggaggctgaggtgagagaatctcttgaacctaggaggcaaggttgcagtgagccgagatcgtgccactgcactccagcctgggcaacagaacgagactctgtctcaaaataaaataaataaaatatctctaaactaatatatctcattaaatttcagatctggagttctgtgagttagggaaacaggatcaccaccatagtagaaaaaactctggtgcagatagttttagacacaaagattatctgaattcaggcccagataattgtcttctttttccccaagaaacatttgaattgtatttctgttagataagcatcatagtaaaaagtcttcaaagtttttgaaggcagaaaaagttttctttgttaaacccttcccatttttttgtcttctaaatttctaggagaactactgttaagttttttagtatcttgttgaacaatggttaacaattataatcatttgtgtttatgtaatcaaactgtgaaacaccggttgggaacttgcttgtgtacacttgatggcgtaaatggtaggggaagagcatacatacaaaagtggcctcttttgctttcttggcagcatgatgttatattcctttggatgtaccgtcatctatgaccagtctcatcttgaaaggcatgcttattttccatttttcccagtgcttggaatttgtttccaaaattgtttctaggaacatgactaatgtgactgacgatgccttaggaattcctagtggggacaaggtgcttggctgggatgcatacctaagaatatctcacaaagaaacctgattttgtttcactattgcctaatggcgcacatagtaggtgctcaataaataaatattttttgcatgagtggtttttgcttgtctggtcatttgccctattgtagagggagagtagtgtgcccactggagtccccacagggtccttttgcctgcatgcctacccctgtggcacccatcaggcttttgattccaatgttgccctgggctctcactcacaggtagatgttttttattgccccattcacaattcagccacctgctgtccgcatgcatgtgcttgccatgtttagatattgggtgtttttccagtttacttaataagttagtggccagactgtacgcttcctgctgcatttttccactgtcttgagagttggcctcgccatctgtgagcaaaaggtctcttctttttattattctcccatggcatgttgcaaaacagtaagcgtgagctggtttcctgtggcaaaaaaatgactttgatttgttctttttgaggttactgtgagtttatcataacaggagtgctaaaaataccgagtctggtatggaaacagcattcacttaccagcatgaacaataacatacaggtttagcctagagcaggaagaaatggacttcatctcaagatgagaatacttatcagagaattcttggcaatcttaacttgctcagtctctgttctgatgagttatggaaaagtacttagaccatctttgagccacagaattgaagctgaaaatattcttagaccaaacattttgtgagcacctgctatgtaccagatctcatagctgggactaatcagaggaagaggaatagaataagtgttcttgccaatgtgaaagacaaacaaataattctactccttgtgaggacagctataacagagggctatagaaactatcatgtgttgttcctggtttttgtttgttttttttcccccccaaaacagggtcttgctctgctttccaggctggagtgtggtggcacaatcataactcactatagccttgaactcctgggctcaagttatcctctcacctcgacctgcaaagtagctgggactacaggcgtgtgccaccatgtccagctattttaaaaaatctgtttgtacagattggggcagggaggtcttgctatgttgcccaggctggccttgaactcctggcctcaagaaatcctctcacctcagtttcccaaagagggactataggaaagcaccaccctgcctggctcgttgttctgtttttaaatacatttgcattattccataataatcaaagtaatttattatgggaacttaggaaactgaaggtctgaccatctttggggagttgtgaagtcttgacagaggaggggagatctgagctgtatttctcggaacaggtatttgccaggtgggaaagagggaagaatattgcagagcaacacatgcacagggccagcaggatagaggctgagcctcggaggggactggagcttggagagagcaggctagtggtttccctattgatagaatatcagaatctggccaggcgcggtggctcacgcctgtaatcccagcactttgagagactgaggtgggcagatcatgaggtcaagagatcgagaccatcctggccaacatagtgaaaccccatctctactaaaaatacaaaaattagctgggcatggtggtgtgcgcctgtagtcccagctactcgggagggggaggcaggagaatcgcttgaaaacctggaaggcagaggttgcagtgagctgaggtcgcgccactgcactccagcctgacgacagggcaagactccatctccaaaaaaaaaaaagaaatctatctatctatcagtcagaatcactgaggaaaccgttgaaaaatgcggagtgcctgcttgtagctcacattactgaatccagatagctaggagtgacttgcatgtctgcatttttctatagcacccaggtttctcaaatcagccaagttaggggaaagtactgtcataggaaagggaagcccatttcccaggtcaaagcctttgcttactcgtttatgtttattttatttttgagacagagtctagctttgttgcccaggctggagttgcaggtgcaatctcagctcattgcaacctccgccttttggattcgtgcaattctcctgcctcagcctccaagtagtggggatcacaggcacacgccaccatgcctggctaatttttgtatttttagtggagacagggtttcgccatgttggccaggctggtctcgaactcttgacctcaagtgatccatgcacctcggccttccaggtgctgagtttataggcatgagccatcgtgcatagcctgcgtttttcttttaaaatgtgttaagcactgtatttcaaattacatttgtgcactgaagcagggaggaaaaaggagctaacccaagtagctgttcaatatagtattttgactgcataccctcaaagtaaagaaaaatctcacctggcgcggtggcttatgcctgtaatcccagcactttgggaggctgaggtgggtggctcacagggtcaggagatcgagaccatcctggctgacacggtgaaacctcgtctctactaaaaatacaaaaattagccgggcgtggtggcgggcgtctgtagtctcagctacttgggaggctgaggcaggagaatggtgtgaacccgggaggcagagcttgcagtgagccgagatctcaccactgcactccagcatgggcgacagaacaaggctctgtctccaaaaaaaaaaaaaaaagaaagaaaaatctctagccggtcgcgatggctcacgcctgtaatcctagcactttgggaggctgaagcaggtggattgcctgagctcagaagtttgagaccagcctgggcaacatggtgaaaccctgtctctactaaagtacaaaaaaattagccagacatggtggcacactcctataatcctagctacttgggaggctgaggcaggagaattgcttgaaccctggaggcagaggttgcagtgagccgaggttgctccattgcactccagcctgggtgacagagcatcttaagaaaaaaaaaaaaagaaaaactctaaataaatattgaactctgcttagtagggattttgttttcagatgaggtcttgctctgtaccccaggctggagtgcagtgtcacgatcataacttactgcagcttctccctcccagctcaagcaatcctcacatcacagcctcccaagtagctgggattataggcaagtagcagggattacaggcatgcaataccacacccagctgattttggtattatttgtagagacggggtttcactgtgttgcccagggtagtctctgtctcctgggctgaagtgagcctcctgcccaaagtgttgggattacaggtgtgagccactttgcctggcctagtaggtttgtttttcacagtgataggggttagcaattctgaaactacttactgttcttctaagattgagcagataggtaagtatagtgttaatagtgagaatcaagttttcttattgtcagaaaagggtgttcctatgaatgtggacagtgggaaaggctagaaggagccatgtggtattggattggaattgaagttatctggatgaactcatggtttcttatacgtagatgtagtaatagatgtatgtgtgtatgcatatccacttttacacgtgtttatttcctagaattgtttcctagaattgttgagagggtttatgcccagagacatcccagaagcactgaacgcactcatgccaagatgttaatacctttcctcactaaagagaaaccagggttccttggagaaatggctgtttccagatctggggtaggaaaattacaggtgagcttggaatatcctgctatgccagaaagtaaggaagtgctctaagaatgataggggcatgtcaaaagaacaagaagaataatcaattaatgtaaacaaggaattatgaagataacaaagtctatctttgactatcaccatagtagtaacaattgtttcaatcaagaatcaaagtgctaaaatcaatggggaacagtttgcggtgaaacagtgtagatgtttccttatcagatgcttttatgctatgcctggtggctcacccctataaatcccaagaggctgaggcaaattgatcacttgcacccaggagttttgagaccagcctgggcaacaaaacgagaccccatctctacaaaaaataaaaaagttagccagatacagtggtgcatgcatgtagtcctagctactcaggaggatgagatgggaggatcggttgagcgcaggaggtcgaagctgcagtgagttgtgattgcaccactgcactccagcctgggagcaagactttgtctcccccgaaaaagaagatgcttttaaatgaattacatagagagacattggagaaccctggcaggttgtacctcagctgagtgatgaaattaacaatctagggatggacagttagacctcatgcctcttggaatatgtaaccctgggttggatctgagaatagaggaaggttttttttcttttgctctaaaggatgttagtggaacaattggtaaaaagaggccccggcgtggtggctcacgcctataatcccagcactttgggaagccgaggcaggtggatcacctgaggtcgggagttcgagaccagcctgcccaacatggagaaaccccatctctactaaaaatacaaaattagccaggcgtggtggtgcatgcctgtaatcccagctacttgggaagctgaggcaggagaatcgcttgaacccaggaggcggaggttgtggtgagccgagatcgcgccattgcactccagcttgggcaacaagagcgaaactctatctcaaaatagtaataataataataaaataaaaaacaaataaaaaggtctgtaggttagatagcagtactgtttccatgttatttatttttacagttatgataattgtctcatggttatttaagagaatggtttttgttttgtttttcttgttttttcttttccttttttttttttttttttttgagatggagtctcactctgtcgcccatgctggagtgcagtggcatcatctcggctcactgcaagctccacctcataggtttacgccattctcctgcctccccctcccaggtagctgggactacaggtgcccgccaccacacctggctaatttttgtatttttggtagagatggggtttcgccatgttagccaggctggtctcgaactcctagcctcaggtgatcctcccacctcagcctcctgaagtgctgggattataagtgtgagccagtgcacctggcctctttttttttttttttttttttaattttacagaattttttttttttttaagacagagtcttgctctaaggctgtagtgcagtggtatgatcacagcttgctgcagcctcagcctcctggactcaagcgatcctcccacatcacccttctgagtaggtgggattattgtaggctaaatttttaattttattgtagagaggcctcactccatggcctaggctggtcttgaactcctgggctcaagtgatcctcccacttctgcctcccaaagcattgggataacagacgtgagccactgcacccagcctgttagataatttagaaaattttctttcctcattcttcaatttcccctcattcacactcccaactttcctgttttgtgatttttaaatgacgttgtctttggatgccggctggatttggtgattagttctcttcagaagaaacttcttattttagaacttgtaacctttgcaaagcaggccataggcagccatcgctatttgggtatgacattccccagtgggtttttggtgtccagtaatgacaaaaactgctgagaaagagacagccacagggaaatgggttccgataatggggcagcagctgagtgcttgttgatttgctgctgtcatgaccacagatgtttaaaaataatttgtaaggaaaaagaaaaaagcgtagtgtgtgtgtgtgtgtgtgtgtgtgtgtgtgtgcgcgcacgcacgcgcgcgcgcacaccactgccttatcagtggtagagaatgcagaccacagtcattcagaaaggaagaaggcaccaccatggaaacaggagaggtgaggagaagggcagaggtgacccacaaatgcggctcagtgccttacagcagagagctcatgagagaacagaactggttagtcaccgactctgctcctcggtctgcaagagaggttcagcaccaagtctatactacacagtactggaaggattagatgaaggcctggcacacattgtgaattaatagttactggttacaggcggggtgtggtggctcaggcttgtaatcccagccctttgggaggccaaagtgggaggattgcttgaggccaatagtccaagaccaacatgggcaacatagcaacaccctgtctctttttttgactgtttttttgaaacagtctcgttctgtcagccaggctggagtgcagtggcacaatcttggctcactgcaacctctgcctcccaggttcaagcaattctcctgcctctgcctcccgagtagctgggattacaggtgcctaccaccacgtccggctaatttttgtatttttagtggagatgggctttcaccatgttggccaggctggtctcaaactcttgacctcaggtgatccacccaccttggcctcccaaagtgctgggattacaggcgtgagccactgtgcctgaccggttcacgtactttacatgcattgtgatcatattaaatcttcatgacagccttactagatcaggtcttgtcctgttttcacatgaggaaattgaatcttggaagggctaagtcatttgtccagggtcatcacacgcagtaagtgttagagtctaaacgagccagagctgtcacactgtcatccccagggccttgtgtttaagcatcgcccaacaaagtgctcagtcagactttaattattagcattactaataataccattatgatgattattttgtctaaacttcacaggcacctcgtgacattttcttattccacttttgcagatgggaaactgaggcccaccaagatcagattacaataatgggcaacattgtcagcaacctgccttgctttttttcttagcaggcccacatctcccccactcccccacccacttggcagtagcctgtgtttgagctgctcacaggccccaaggcccagctgcaattcttgtttaaagcctcacatcttttctctgactgtcagacaacagtcacgggaatgtcctgtgccatcttccctcggcaagaggggttggcagagagcagcagatgcctagagtcaaggtcatgtgctgctcaagtgctgggctggagacaagaccctctctccctgctgcttgtgaccaggcagggtggctctgaatgtagagggctctgtcagaacagttctgtgaccagagggtgtggttggcaaagcaatgcattaggggcccatggaagtttattcttgttgtccacattatttccctgtgacttttagatttttttttcctttttgtaaattagttttttcatactagttagaatgtttcaccttaaaggtgagagtcaagctctggaatcgcctgacatttttaaggaaaggaatagaatattgggctggggctagtctgaaatggtggtttgtattattttaaattgatgggctctgggttaggggagccaaatccattttaaagtgatttttgtaaaaattggcatgtcttctgtttcttctcttttccaaaggtgacactataacgtagaggttaagaatgtggtgacttttaaatccgtcgtgaccataagcctctcctaagccccagttttcctaccactaaaatgggggtggtaacagttgtacctacctcattctgtcttttttgttttttgcttgtttgtttgttttttagatggagtcttgctcttgtcgcccaggctggagtgcaatggtgtgattttggctcattgcaacctccacctcctgggttcaagcgattctcctgcctcaacttcccgagtagctgggatgacaggcacccgccaccatgcccatttagtttttgtatttttagtagagatggggtttcaccacgttggccaggctactcttgaactcctgacctcaggtgatccacccacctcagcctcccaaagtgctgggattacaggcgtgagccaccactgccggcctcgttctgtcgtatttttttacgtaggagagctcagtctgaatgtaggatatgacatggttgtggggttttttttgtttttgttttgtttttgttttgttttgttttgttttgttttgttttgttttgtttttgagacagtctcactctgtcccccaggctggagtgcagtggtgtgatagctcactgaaacctctacctcccaagttcaagcgattctcctgcctcagcccccaagtagctggaattacaggtgcccaccaccatgcccagctaatttttgtagttttagtagagatgaggtttcaccatgttggccaggctgctctcgaactcctgacctcgggtgatccacccgcctcggccttccaagtactgggattataggcgtacttggaaggtaccatgcccggccattatatgctttttaaaaaaacctaaatgttgcaaaaaacatgtgtctaaaatctctgtttcaacatagttttttaatagccatgtaatattccattctgtcaatatgtctttatatgtggtacagactgagtgtctaaatccaagaacccaaaatctgaatttttttttatttttcatttttatttgtttacttatttttgagacagagtcttgctctgtcacccaggttggagtgcggtggtgtgtcggctcactgcgacctccacctcccaggttcaagtgattttcctgcctcagcttcccaagtagctgggattacaggtgcccgccaccatgcctggctaattttttgtatttttagtggacacgaggtttcaccgtgttggccaggctgatcctgaactcctgacctcaagtaatcctcccacctctgtctaccaaagtgctgggattacaggctgagctactgcgcccagcctatttttgtttttttgagacagagtctcactgtgtctcccaggctagagtacagtagccccatctctgctcactgcaacctccgcctcctgggttcaagtgattctcctgccttagtctcctgagtacctgggattacagacgtgtgccaccacacccggctaatttttgtatttttagtagagacagggtttcactatgttggccagcctgatcttgaactactgacctcaagtgatccacccatctcagcctcccaaagtgctgggattacaggcatgagccaccgcaccaagcccccaaaatctgaaatgttttgagtgccgacataacactcaaaaaaatgcttattggccccgggcgtggtggctcatgcctgtaatcccagcactttgggaggcctaggtgggtggatcacctgaggtcaggagttcaagaccagcctggctaacatggtgaaaccccgtctctactaaaaatacaaaaattgaccaggtgtagtggtgggtgcctgtagtcccagctactagggaggctgaagcaggagaatcacttgaacccaggaggcacagcttgcggtgagccgagatcccgccactgcattccagcctgggcaacagagagagactctgtctcaaaaataaaaataaaaaaaaaataataaaagctcattggagcattttggatttgggattcttagatttggggtgctctattggtaagtacaatgcaaatatttcaaaatctgaaaatacccaaaattcaaacacttctgctccctgacatcctgtgtaaacaacactgcagtgaacatttataggtaattcattcagcgggtaagggtcaggaccttttatagggatccttaataccacatttttacatggttcattgagcattcgtgctcccctctgctgtgggtgagggtgcaggtccctcagccttcttgcttgggttgagtcatcctggtctttaatttggtaagcaaaaaatggcatcttgtttttgagctcgtttctgagaaagtgcatgctccttttccccatcaacaactttcatccggcgcctcggaacctcttcagtagagagtgagatgcaaatagcgaggcacagcttctttccctcttctgagctgatgcctggtgaggtcatagactgggtttcattgcaaagacgaaagcgtgggcaggacttttggagcacaaaaaggggcatttcagagtagtcttcatgggcggccactccagaggtgaagttttctagagaaagacatgaaagtactgtgtggctgtggcgacagacagaggcttacgagcctgccctctagagactgtgagctccgcgtgtgagggcaaggcctggggctgtctgggtcgcttctgggtccccaccacagctagcatagggtaggggtggagggggggtgctcaggaagtgatttttgaagagtggatgactgaatacatgcacacacatacttttaagtttctgggttaaagaggaaaacagaatgaggtaaacaaaggaaagtaatgtggaggtgaactgagcagatggcaagatgccgtgaatggttagaggccaggagagccagaatcagagtggcttccgtgaagtgtccctacctcctcccccagcccagctatgtcactcctctgagcttcacacctatggactgttctgcaccctagccctcagatgcaacggtgaaagtgggactcctattgggtttccctgttgaggacagacatggtgccctgtgtatctgctgctgcttttttctttttttcttgctgagtattccatgtgtagcatgtttgtaacacttgataagaaacagaaccatcccagatagcttgaacacttttcaattcagtcagtaacagaccaggtctgctttggatttccaggagcttgtgtcactttattttttttctgagccagggtctcgctttgtcacccagctggagtgcagtggtgcaatgtcagctcaccacagcctctgcctcctgggttcaagcaattctcgtacctcagcctcccaagtagctgggactacaggtgcctgccacaacacccggctcatttttgtgtttttagcagagacggggtttcaccatgttggccaggctggtctcaaactcctgacctcagttgatctgcttgccttggcctctcaaagtgctgggattacaggcgtgagccactgcacccggcctctggattgcccggcctgtgtcactttgtcatgagcccttctcccctagttatcctttattcttcaaacaggcttcctgtgtgacatattttttgagtgcctgctatggggcaagccctgtgccaggtgttcagtatagagtagtgacatcgcctttgccccacagagcataaaaatctaatggaggagacaagccagtccttgtgctagttcatttccacaggtgaatataaaaccacaaactgggcagggcatggtggctcacgcctgtaatcccagcactttcagaggacaaggcaggtggacaacttgagctcaggagtttgagaccagcctgggcaacatggtgagacctcgtctctacaaaaaataaaaaatgaaccaccaggcatggtggtgcatgcctgtagtcccagctatttgggaggctgaggcaggaggatcacttgagttcaggaggtccaggcagcaatgagctgagattgtgctgctcattccagcctgggtgacagactgaggccatgtctcaaaaaaaaaaaagaaaaaaataatcacaaactgtgagtaaggtatctaagggaaaaaactgtgctgggagtgaatgtcaggagacagggagatctgaggcagtatcgtgtccagagcccacagctgaattaatggtaatgcaggtaaatgagctactgtgtgacacaggttaccacagcaagtgtatcggcttttctagggcgagtgtgagctgggtttctggactttgcttaagagcagtgacagacctggaagatactgccccaggcactcttgggtgctttacatgtattggttcatttaatctttaaaccccacaagtgcccttgggattcccattttgcagaggaggctcagggtccttgtcacttgcccaaggtcacagtaagtggaagaatagggagtctagagctgtgctcttcgctgctgccctccagttggaaagctgtccaggccagggacaggctttgcagagagaaggtacagaggacgggacaggcaaatattcagagactatgaggactgaggtggttctgccaactgtggagggcctggtcacttgacaaggcacctcattgcacccccctgaggctctctcaaagccccttttcgagttaggacattgttatctcctgtgtagtttttgttgattgccctctgaaatgctgtgagagggtagaccatccattctgccctcgcctgcccagcccagcacctggcacagtcattgctcagtgtatatttattgaatgaacaattgactgaatgtcaggcccagggctttgccttaggaaacaggctgttggataagaggtagtactaccatactttgcaatttttctggaaatttatgtcacctgggagtggagcagattaccaggctgtttccagagatagcgactctccataaagtgagccaacctgggggctgggcgcagtggctcacgcctgtaaccccagcgctttgggaggctgaggcaggcggatcacgaggtcaggaatttgagaccagcctgaccaacatggtgaaaccccatctctactaaaaaatatgtatataaatgagccgggcgtagtggtgcgtgcctgtaatcccagctactcaggaggctgaggcagtagaatcgcttgcacctgggaggcggaggttgcagtgagcaaagatcgcgccactgcactccagcctgggtgacagagcgagactctgtcttaaaacgaacaaacaaaaaaaacaaaagtgagccaaccctggggaggagtctacgttcagctgcagggagccagggaattggggccgaggtgtctggcacagaaaagctttgggcctgtctcaggtaaatgaagttttgatatagattcaactcccctgccccccacaattgaactgtttttgggggccagcaattaggggctaatttgtgacagtgactttattttcttcctactaaagtactggtttattcggtggccttggtgattagatttaggcataatagttaaatgtaatagaagtttatgtaacaaacagtgattaataatgttgctgtccagattcccgttatagcgctaacctgatgttatgaactgagattaaatttgaatttgagtgcttacattattttgtaaaggtggttgtatattcacatatccacagttttttctataaataacgtgaaaccgtgcttggtttctcttttccaaagtttgccttttccattacatgggcaagtcctgaacctaagccgagacactagtccatcatctccagcaatgaatgtcatccccccagacttcagcatcctgagttaattaaaaggtgcagatgaagttaatcaagtttggaactctaattttgtgcagtgttttgatacgatttgatgagtcatcttttggtagagcacctctctatccctgacagtgtttgatcttaacggaacagttttataatgtgtaaactggtgggaggtgctcttcagaaatgcagtcaacagtggtatgtgtgcgtgtttggctcttggggcggggcggaaagcagaacaaaggagaatttaataagcgagaacttgtcaggggctagggtcagttctgaggctgctgcctgtcaagaacatggctttcttcctgcccccctccactgctgctaactggagtctgaccttcgagaaagagtgaaaaaagacagcttctgtttgttttgctgcaagtaagtggctggactgattggcccccttcccagaggccctgcaaggacttcagatgtggtcagcgaggtatgtggatggtgccagcctgccggccctcgtccagccaaactgcaccaggaacaggcaagggtcccagagaaacagcggggtcagctgctgccgcctttgctcctgctcttaatgctgtcctatttcttcctaagaggaagctggtttactctctcaagattgatgggcaaagttttatatgaccacggtctccacttctcacccactgaacttacagcttgaaattaacagaggcgaggcccatctggaaaaatgcatttgacaaaaacttgatcaaatgggggatcccctgaggtgggtggcaaagaaccagaccacttggaatcctaggtgctgtgtccctgtatggacctgctgtttcttttggattccattagggttaagaagcacaaattctgaagctagatttgagtttacatttctgctccagtacttgggagttacagtgaccaagtcatttaatgtttctgaacttcagtttcctgatctgtaaagtaggatgggtaggttgggcgtagtgggtcatgcctataatcccagcactttgggaggctgaggcaggaggatcacttaaggtcagaagttcgagaccagcctggccaacatagtgaagccccgtcactagtaaaaatacaaaagttatttgggcgtggttgtgggcgtctccagcctgggtgacagagtgagactccatctcaaaaaaaaagaagaaaaacaaaaacaagtaaataaatgaataaaaataaaggaatccagccatctgttagtatagccaaagcagaggatattgcatcaaatgttaaacgctagtcctgtcagtcactcctgagagaacagggcaacaagacccagaaagggtatcaacactgcctgagcagatggaggcaaagctgtgcatgggctgcttatagggcacagtctgaggccttgcagcagtcacgtggaaactgaggctgcctgctttccaggtgcaaggtgatggacagtggcaggaaccctgtgctagatgactcttgtgcgatcttatttctttgttactgggacacaagcaccaactgtcacaagggaccaacaagaggaggtgattttttttttcagctgttaccacaaagcttttcatcttttggtttgaaaacatagctgtgggaataggccgggcgcggtggctcacacctgtaatcccagcactttgggaggccaaggcgggccgatcacaaggtcaggagatcgagaccatcctggctaacacggtgaaaccccgtctatactaaaaatacaaaaattagccgggcgtggtgatggccgcctgtagtcccagctactcgggaggctgaggcaggagaatggcgtgaacccgggaggcggagcttgcagtgagccgagatcgcgccaccgcactccagcctgggcaacagagcgagactctgtctcaaaaaaaaaaaaagaaaaaagagagagaaagaaaatatagctttgggagcaccaaagcccaaagcgttatagtgcctactatgtgtcaggcactatactaaacatttcacatggcttagcactcatgtgatcttcacgataacctggtgagcgggtaattattatcacccttcctactggtttgttgttgttgttgttgtcgtcgttgttgttttgagacagagtctcgctctgtcacccaggctagattgcagtggcacgataccggctcactgcaacctctgcctcctgggtttgagcgactcctgcctcaggctcccgagtagctgggattaaaagcgtccgccaccatgcccagctaatttttgtatttttaatagagatggggttttatcatcttggccaggctggtcttgaacccctgacctcgtgatccacccgccttggcctcccaaagtgctgggattacaggcatcagccaccatgcccggctacttaatttattttttgagacagcctctctctgtagcccagactggagtgcagcggtgtgatttcggctcaccgcaacctctgaatcctgggttcaagcaattctactgcctcagcctcccaagtacttgattataggcacccaccacactttcggctaattttcctatttttagtagagatggggtttcaccatgttggccaggctggtctcaaactcctgacctcaagtgatctgcccaccttagcctcccaaagtgctggggttacaggtgtgagccactgcacctggcctcctttattttatgggacattttttgaaaagaggcttggtccaaacaggcagtacttgccacttctgcagtcatttctctaccctgccccaaaatggttactcagttgcatttatttactacaatcggaataccagcaggacatctacaaaagtagaagtattgggtggtagcagatcagtgctctctggcatccagatcgtctagatggtcacagcctttttttttttttttttggagacagagtcttgctctgtcgcccaggctggagtgcagtggcacaatctcggctcactgcaacctccacctcccgggttcaagagattctcctgcctcagcctcccgagtagctgagattacaggcacccaccaccatgcacggctaatttttttggtatttttagtagagatggggtttcgctgtgttggccaggctggtcttgaactcctgacctcaggtgatccacctgcctcagcctctgaaagtgctgggattacaggcatgagccaccacacctggccaattgttacagctttgagttgactgccaagtgttgaggtagcattgagggttgcagaagctgtgttcttgaaaaagagaagagagtaacattctcagaaagcaaacagtattcagaagagtcaatgggtgttctggagcttttttcttttctttcctttttttttttaaagaaattaccagctgggtgctgtggctcacgcctgtaattccagcactttggggggccaaggtgggaggatcacctgaggtcaggaacttgagaccaggaatttttctatttttagtgaaaccccatctctactaaaaatacaaaaaattagctgggtgtggctgcaggcacctgtaatccccagttacttggcaggttgaggcaggagaatggcttgaacccgggaggtggaggttgcattgagccgagatcacgccattgcactccagcctgggcaacagagcaagattgtctcaaaaaaaaaaaaaaagaaagaaaagaaaaagaaaaagaaattacctcttctctgatatgcagagccccgtctatactggacaggtggaagttaccagagaaatacaggccaggggcctttgtctgacattggcactgagaaaagcatagcccagaagcagggtgtgtcttttttttttacctgggcatctgtggtttgagatcttcttggaacactttataacccatttctgaacgtctcccaggcttcagtggagccacctgttgtagcttctaaaactgtgtcctcctcagttgttctcccacccattgccttcacagatgcagagaccaagattcactcactcgccattggacctttagcacccaggtctgtctggcacaaagtaagtgccaggctggtggagtgaatgaattctacttagagaatggccctcaacacaggctgctcattaccaaaactatttggtctttaaaaagtgtgactctgatgcttcagtctggggtgggtaccaaatacttgtattttttaaagagcctcacagcaacttgaatttaccttaatttttatgtaggaacccttgtcctggtagagagtataatttgctgaataagtctactttttcaatcaacatatacggaagagatatcaatgaaagaactgacaaactgtaaagccccctctccaggtgtaaagcactcagggcttgggcctagaagctgatccatgtctctgtgtctgttctgaaatagcctgtgtgatgtgggagaaagagtattgtccttagagacaaggctcgagactggctgtgccctttccttgggcagtatgtagggaacaagaatgcctgcccgcccgcaggcaggttacctgtggacaaggtgtagtgggcagttagaaggtgttggtatgttaatcagtcttttttttttttttttttttgagatggagttacgctctatcgcacaggcaaagtgcagtggcgcgatctcagctcactgcaacctcccaggttcaagtgattcttctgcttcagcctcccaagtacctgggactacaggcgtgcgccaccacgcctggctaatttatgtatttttttagtagagacggggtttcaccatgttggccaggctggtctctaacttctgacctcgtgatctgcctgcctcggcctcccaaagtgctgggattacagacgttacagacgtgagccaccacacctggccagtctttttttttttttttctgagatgaagtctcactctgttgcccaggctggagttcagtggcacgatctcggctcactgcaacctctgcctcccgggttcaagcgattctcctgcctcagcctcctgactaagtgggactacaggtgcctgccaccacgcctggctaatttttgtatttttagtagagaccgggtttcaccatgttggccaggttggtctcgaactcctgacctcagatgatccacccgccttggcctcccaaaatgcttggattacaggcgtgagccactgcacccagcctaattagtcttttgctcctatttgtctttatttgggataaaagttatagccttgttggggtcttcttacacagtagttctgactcacagccatcatctgaacctttcctctggttcacaaccaaaattaaacatccatttatggggattgagatagttttcatagtaaaggaagttttgtttgtaatgaccttcctgtttgatgggtctaagtatatggctggcccttctggctaaagcaggctttaaactggtcctgcctagaatgtgtacctcccactccttatcatctctcttctaggtcccttcccctttccctttcccttccccttccccttcgcttcttccttccctttgttccttttcctttcctttttttcttctttttttttttttttttttgacagggtctcactctgtcacccaggctggagtgcagtgatgagatctctgctcatgtagccttgaccttctgggctcaagtgatcttctgccttggcctccttagtagctgggactacaggcaccaccatacttggctaaattttttttttttttttggtagcagtgaggtctcactatgttgcccaggattatctcaaactcctgggctcaagcgatcctcacgccttggccccccaaagtgttgggattgcagatgtgtgccatcacactctgcctcttccgggtctttttttttttttttttcccagacggagtctcgctctgttgcccaggctggagtgcagtggcacgatcttggctcactgcaacctctgcctcctgggttcaagcgattctcctgcctcagccttccgagtagctgggattataggtgcctggctaattttttttatatttttagtagagacggggtttcaccatgttggtcaggctggtctcaaactcctgacctcgtgatcctcccacctcggcctcccaaagtgctgggattacaggcgtgagccaccgcgcctggcttttttttttttttttttttttttttttttttttaattttacttttttgagacggagtctcactctgtcacccaggctagattgcagtggcacaatcttggttcactgcaacttccgcctgctggattcaagtgattctcctgcttcagtctcccaagtagctgggactacaggcacgtgtcaccacacctggctaatttttgtatttttagtagagacagggtttcactatgttggccaggctggtctcgaactcctgaccttgtgatccacctgcctcggcctcccaaagtgctggggttacagctgtgagccaccgcacccggctcttccaggtcttaatagagcctttttcctctactgaaagcttccactgctttctgcccccttcaaactcatatatacttcattgaattgtttcctcggggaagccttcctgataccaccctacagagggtgtcagacgccctattatgctgtcacagcacttttcacagtaaggtaaattgcttttataattattggattgcctctctgactatgtttgttgaataaataaaaaaaggtggccaggtgccgtggctcacacctgtaatcccagcactttgggaggccgaggcgggcggatcacgaggtcaggagtttgagacaagcctgaccaacatggtgaaaacccgtctctactaaatatacaaaaattagccaggcatggtggttcgtgcctgtagtcctagctactcaggaggctgaggcagaagaatcacttgaacccgggaggcagaggttgcagtgagccaagattgtgccattgcactccagcctgggcgacagtgtgagcctccatctccaaaaaaaaaaaaaagtggctttataacctgccttctttttcttattcccagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggttggtgtcagtatttatcactgtttagtctggacagataaagtttgttttcaggatttgccttaatttgacaagctcttttattagaaacccttcagagagcaccctgccacattctgctcgctcctgtagacttctgcctctccactagaatagcaatatataaaaaataaagaggggacagattctgatttttacaataagtatcttatattcacgtggttcaaaattcaaggcaatgtaagatctgtaaacattattctctaccttttttcactttatgtgatcttgttatctcttggggacatctccagatcagtacatagtttgctccctcttttccacagctccttagtattctagagtgtgaagcgatggagtttattgaaccagttgcctgctcactcaagttgtgttcaggcttttctaactgcgtaacactgcagtgtgtgaccttgtgtcgtacgtgtgcaggtacaactgcaggataattaggaggaagggagttgctgggtcagaaggttgtaatttatcatttggtcagcattgccaccttgcctccattggtatcctatcaattcatacccccagcagcaaaaccacccatgttcccagcatcctctcacttggacactccatgctttcaccttacgtgactacctttttgctctcataaacaggcttaggatttgattggagaagaccacatagtgactaggtcacaatctctctctctcttttttttttttgagacagagttttgctcttgttgcccaggctggagtgcaatggcacaatctcaactcaccgcaacttctgccgcctgggtccaagcgattctcctaactcagccttttgagtagctgggattacaggtgcctgccaccacgcccagctaattttttttgtatttttagtagagatggggttttccatgttggccaggcaggtcttgaactcttgacctcaggtgatccgcctaccttggcctcccaaagtgctgagattacaggcatgagccaccacgcgctccatccacatctccttccaagcagctctgggatcatgtacacaccctaattccctttccatgtcttgagaggcttcctaaactcggctttgcagtgcctccagcttgtagcagtgataatgatggctgcagtttactgagcagctgttatgtactaggcatcaggtagtaagtagccaacccagatcccaccccaggtatcattacagtgcttgctctagtagcagcatgctaccttggtttcttatcaacagtaaggtctgccagagtccctagtcctttctttgttgacttcctgctgggaacttcaggtgagcaacagcaaaccccactccatttagggccagcagtggtctttgaagcacctgtggtgccctgacccaaaaagccatgattgtcctggtacagtggctcacacctataatcccagcactttgggaggttgaggcaggcagattgctttgagcttaggagtttgaggccaaccttgacaacatggtgaaaccctgtctctacaaaaaatagaaaaattaactgggcatcgatgactggtgcttgtagtctcagctactctggaggctgaggctagagcatcgcttgagcccaggaaagcagaggttgcagtgaaccaagattgcaccactgcattccagcctgggtgacagagagagaccgtgtctcaatacatatagcgtaaggctgggcgcggtggctcacgcctgtaatcccagcactttgggaggccgagacaggcagatcatgaggtcaggagattgagaccatcgtggctaacatggtgaaaccccatctctactaaaaatacaaaaaattagccaggtgtggtggtgggtgcctaagtcccagctactcgggaggctgaggcaggagaatggcgtgaacccgggaggcagaggttgcagtgagctgagatcacgccactgcactccagcctgggcgacagagcgagagggagactccttctcaaaaaaaaaaaaaaaaaaaaaaaggcagcaatagagtggcagtgcctgagcacacgagactgagacatggaaaagcggtttccccaaagagggtgggcagggaaggaaccactttggagagaaaaccagccagcagctcgttaggctgtggctttcctcttctaggaagcagggccttcaactctgctggccggtgatgcagagccagaccgttcatcactttgaatgcccaagtagtcacttggctgcacactcacggcccagcacacagccccaggtatgctcagtggctgccgcttgccactggctgactggctgggattattggaactgaagccctgcatgacccagtccttcttcctgctgcgaagcacagcagaggaaacacttgcttctcacaaactggtcattcctccaccaagagatgagtgccccagtgagttaccatgagatccaagcctgtacagtgtcatcagccgctgacctcacggtgctgatgttacaaaggcaccttgtaaactgctgcctatgtttagatgatggctttttttttttttggagacagagtctcgctctgtcccccaggctggagtgcgatggcatgatcttggctcactgcaagttccgcctcccgggttcacgccattctcctgcctcagcctccccagtagctgggataacaggcgcccgccaccacgcccagctaattttttttgtattttttagtagagatgtggtttcgctgtgttagccaggatggtcttgatctcctgacctcatgatccacctgcctcggcctcccaaagtgttgggattacaagtgtgagccaccacgcccagcctctttttttttttttttttaagatagggtctctctctgttgcctaggctagagtgcagtggcacatcatagctcactgcagcatcaacctcctgggctcaggcaacactctcatctcggcctcttgcgtagctgggactataggcgtgtactaccaagcctgcctaattttttttttttttttttttttttgtattgacagggtctcactatgttcaccaggctgtttcctattttttaaagttatgaaccgcataacaagagagtatacaaagcacatctgcctgagttaaatgataattaatacttatttatttttgttgtagagacgggggtctcactctgctgcccaggctgttctcagactcctggattcaagccatccttctgccttggctttccaaaacttctgggatagacaggcgtcagccacttgtatctcttttaatttggaatagcccttggcaaactggcttgccacctctttttgtaaataaagttttattggcacacttactcatttatatattatctgtggcagcttttgtgccacagcagggttaaatagttataacaaagaccatatggcccataaagctgaaaatattttattatctggttcttttgtttgtttgtttgtttttgagacaaagtttcactttgtcacctaggctagagtgcagtggcatgatctcggctcactgcaacctccacctcccgggttcaagtgaatctcctgcctcagcctcctgagtagctgggattacgggcatacgccaccatgcccagctatttttttttatttttttattttttttatttttttttgagatggagtcttactctgtcacccaagctagagtgcaatggcccgatcttggctcactgcaacctccgcctctgtgctctgtggttcaagtgattcttctgtctcaacctcctgagtagctgggactacaggcgcgtgccaccacgcccggctaatttttgtatttttagtagagatggggtttcaccatattggccagactgatctcaaactcctgacctcatgatccacccagcttggcctccgaaagtgctgggattacaggcatgagccactgcacctggcctgttatctggttcctttttttttttttttttttttttttttttgaatcagagtcttgctgtgtcacccaggctggagtgcagtggcgtgatctcggcttattgcaacctctgcctcccagctttaagtgattcttttgcctcagcctctggagtagctgggactataggcacgtgccaccacgcccagctaatttctgtatttttagtagagacggggtttcaccatattggccagactgaactattcctccaatacggccaaaatgagattctaccagcaatgggaggagtttttttaattattattattgggagtctctctctcacccaggctggagtgcagtggcaccatctcggctcactgcaacctccacctcctgggttcatgcaattcttccacctcagcctcccgagtatctggcattacagctgcccgccaccacacccggctaacttttgtattttagtagagacggggtttcactatgtaggtcaagctggtcttgaactcctgacctcaaatgatccacccgccttggcctcccaaagtgctgggattacagatgtgagccaccgcacccagccctagttctccatgtattttagagctctgtagtggaccttgataagcaggaagatgttacccctggatgaacaaaatgggaatgtgctggtcctggccagggcgtaaggagccggaggtgcctttggacacagctcttgggattggaatggatacagccttttgggagggcattttggcaatacatatgaaaaactagcattgctatatttagaaatttgtcttaaggaattatttcgacgcctgtgtctttgtcaagatgtatgattacagtgttgaacagcttaaatgtccctcaataggttatagaacagaagagtaatagttgataatatttgggtttaaaattatacctatttatttatttatttattttttgagacagtcttgccctgtcaccaggctggagtgtagttgtgcgatctcagctcactgcaacctatgcctcccaggttcaagcgattctcctgcctcaacctcctgagtagctgggactacaggctcaccccaccacaccaagctaatttttgtatttttagtagaaacggggtttcaccatgtgggccaggatgatctcgatctcttgactttgtgatccgcccacctcgacctcccaaagtgctgggattacaggcatcagccactgagcccgccctaattatacccgtttagattgtgcacttttaaaaatgtctagaaggggctgggcgcagtggctcacacctgtaatcccagcgctttgggaggccgaggcgggcggatcacgaggtcaagagattgagaccatcctggccaacatggtgaaaccccgtctctactaaaaattcagagtagccgggcgtggtggcgggtgcctgtagtctcagctactcaggaggctgaggcaggaaaatgacatgaatccgggaggcggagcttgcagtaagccaagatcgcgccactgcactccagcctgggtgacagagcgagactccgtctcaaaaaaagtctagaaggatgtgcaccacactggggagattggaggtagttctgtagggaggctttccctttcacttgtctgtgttccagtttgcttggtgagcacacagcattgtgttcaggagtaggagctggcagagcacacttcctttggggaagtggtggaattaagtgatttgcttactaggatgggtaacttggaggggcaggtgactgtgtcatctaaaatttgtcctctagatgccccatcctggcccagaagggctggtttctatgtgggttgtgaagactttttctgccctcatactttaatttcacgcctcaaatttcccttgcttcctacatgttaacacaggcctgctccctgacatttgtctgggaatagcatatagaacccactggccattatgggtaagaagagaattgcgagaatgtgaccagggcactgaaacatctgatatctctaggacagatataggaagcacagatatagtctttcctttaacttataaaggtaaaaataaaagtattgtgaaagaatttctgcttgccaaagttcaaaggtcttttccaaccacttatgaatcccttgctcagatttcattttcacgcctagatgccagcattaacactgctatctgaatcgggccctcctgctagaagttgtttttattcaggagagcctactactgaatttctccagatgtcatggtcacagttctgttcccagtgctccattttccttgtcttcctctcttttaggtactgcttctccgagatggccccagtgtgtgcggtggttggagggattttggcacaggaaattgtgaaggtaaaacatcactgtggagcagaaaattgttaaccatgactttgtatatgtgctgacagagagaatggaaactgtcttagacagctgcctgctttctctcaccccattcatctttgtttcatgccctccccatttccacctcatcccattttctctggcccatccaggtgccattcagcaaatgaccttggagtgcctgctctgtgcttagctcacagttggccatagtgcctcgaaggtgtgatctgctctcccctaactgtattagttatccagtgcctgttgtattggtcagggattctgcttctcatagctctataagtgagtactatcatgatccccacttaagaggaagacacttgggcccatgaaagggactccagaacctgtgctcttaacctctgtacagtttatctctattcatcaccatgacatcaaagccctcccttttttttttttttttttttttttttttgagatggagtctcgctctgtcccccaggctggagtgcagtagcacgatctcagatcactgcaagctccacctcccgggttcacgccattctcctaccttagccttccaagtagctgggactacaggcgcctgccaccacgcccagctaatttttttgtatttttagtagagacagggtttcactgtgttagccaggatggtctggatctcctgacatcgtgatctgcccacctcagcctctcaaagtgctgggattacaggcatgagccactgtacccagccgcaccccccccctttttttttttttttgagacagaatctcactttgtctctcagactggagtgcagtggcatgatcttgactcactgcaacctccgcctcctgggttcaagcgattctcctgcctcagcctcccgagcagctgagagtacaggttcccaccaccacaccaggctaatttttgtatttttagtagttcaccatattggccaggctggtctcgaactcctgaccttgtgatcctcccacctcagcctcccaaagtgctgggattataggtgtgagccaccgcacccggccaagcccccgtctttttaaccacacactgtaggtatttgtagagaaatcagtttctgtgtccccatgaacacaccaggagcccctcaaggctctgtacaggatgacccgtgaccctgttaggtaggtgttagtgtgtctctcagaagggaagcatcttatacagggtcacataaccagtaactagcacagccttttgagggtcttctggaacatttgggttgctaaaactataccatacccccaaatatattgtacattctttgcagactttgctatttgcccgaagatgttaaatttgccttttgcaggttcttggctgccttcgtggactccggtgaggctttttccttctttcttatggagcagagtcgtgcctggttaaatgattggccatgtccatgtacatgtcaagtttgagcttgggaggacagtttggaggccagcccttaacactttgtcttggggtctgtacattctggaggcgtttggctcaatttgttagtcacaccgttttcctaaggctactttttttttttttttttgtctattttttctgatccttctctctggtctaaattcttcctttgatcaaatctaactttcttctatgtaatgggcaccgaggagatatttggagggggaagaaaagtgtgcaatggccatacctctttccttgctcacattttatacatagcccagagtgatgtgaaaattacagtttatatgcccaatctgagaagagggtaatggccacccagaggactgttcgagcaggattctgaggctccctgtagacaaactgcaggaaagagtgcagcaatgggaatgttctaagtggggaatgggaatgtacatatttttgtagcctaaaatgacgacaccaccaataatagacaagacttactgaaagcccactgtctgccacacaaagacagtgttttttacgtggatactcatttcatctcccaccggccctatgaggtaggaactcctgtgatccctggtttataaaagagagactaaggtgcaggaaagaagatgcttgcccaggctagtgagtgtggtgccaggatgtgggcccaggcagtctggtttctgagcctgtcctcttcaccacggggcagtcatgcatcaggtgttgccttcaatggcaccatcatgtagagactgcatggaccccagggccgctgcccttgcattgtcagccttacttctgcacatcccattgaggggctccccctaaatttttcatgtgggatggagactggaggttggggcaggtagccttgaccccattgttggtggtagtttctcacatccccatcctcacacagccccctccttcctgcctgctggagacagctggtgcccagcatcttgtttctgtttatcccagatagccagagtactctgcattcttcgttgctgggtgtgtttggaatctcctcctaccccatcttgcttgggaagcactttaccttttgccccatgtcaccccatgccctgctctcatccccagtactccttcatacttattactggtcagccttcagccagctggcaggcggggcctgcagtccaagggcctcagactcacctttctctcctgaggcactgtctgagcgcctatggaaagcttacactaggagatgggtcaagcgcaagtctgctcctttggaatcatcttttgcgtctttcctttcttacgtccttctagataccctattttatatccatgtctacttccttgggtttaaagcagttttcctttctctccatccccaccgtccacggcaggtctccctgtctatggtaagagaggtgatagtgaaagcagcagccatcccaggttcatggtaaaacacataccatctcctgtatcttgggtttgagggtctaagagttccacctgtgtactgttggacccttccacctggctaggttggtggcatccccagtattggtaaaggactcctggccctattattattaatagcagctcctacttactaagaatttactacgtgctcggcactttacaagcctagtcacatttcattctcaccaaaactctagcaggcaggtgctttttatttgcctatttgcccagagaagcaaacttctttctgatccaagctccatgtggacagagacctcagaatccttaatgtctagctgaatacctggcatagagtagatgcttaataaatgttcccttgactgggtgcagtagctcatgcctgtaattccagcactttgggaggattgcttgaacctagaagttcaagactagcttgggcaacatgaggagacctcatctctacaaaagtcccagctactcaagagggtatgggaggatatctggagctggggagacggaggttgcagtaagccgagaatgtgcctcccacctgggtagcagaacaagatcctatctcaaaaaattaaaaacatttacaaataaataaaatttccctggaaaaatggctgactaacactatttgtatatggtagatgtgattgtccctgttttatggatgaggaaaagggtttggtgctgagtttgaagaggagcagttcaggatgtgtagccccaccttcctcatgaatgatgggacggtgctcctgggaaccgttaaaccctgccctggcagcttgcctaggtgatgtcttcctctttaaatggtagcttgtggtgaaatttcaatcctttctgggttaaggacctgtttgaaaatttgtgacaattgtgaaccctttctcagaaagatgtatgtgcatacaagactcagtatgttgtttcgggggctgaccctgcctcaaaagacagggccacgtgctcactctccttcccacccctctctctcgctctctgttgcccaggctggagtacagtggtgccatcacagctcactgcagacttgatttccctggacttaagtgatcctcccacctcagcttcctgaggcactgagactataagcacacgccaccacatccaactaattttttttattttttgtagatatggggttttgccatgttgcccaggctggtctcgaactcctgggctcaagtgattctcccgcctcggcctccctaagtgctgggattacagatgtgagacattaagcccagccctgttcttgtattttaaagtgctctgtctggtaaccccacaagataatcaccattgccattgctaaatagcattgtccaggccctctggatcccagccctgaccccctgtggaagcctagcgactctatgtcctcatggaatagcccccgcttctgcatcagtgtgttccttgattaaatgtgtccccttaggtgataaaggccacagcctaagaactgccacctttctcagttgaatagtcatgaataattatttctgctgtttgcccaatggtggtgcaacacagtgttagtcattgttttagttttaaggtgtttttttgtttgtttgttttttgttttgagacagggtctcactctgttccccaggctggagtatagtggcactattacagctcactgcagcctcaatgtcccaggctcaagcgatcctcccacctcagcctcccgagtagctggcaccttgggcatgcatcaccatacctggctaatttatgtcatttttctttttctctttttttttgagacagagtctcactgtgtcgcccaggctggagtgcggtggcgcaatctcagtttactgcaacctctgcctcctgggttcaagcaattctcctgcctcagcctcccgagtagcatgccaccatactcggctaatttctgtatttttagtagagacaggtttcaccgtgttggccaggctggtctccaactcccaacctcaggtgatccgcccacttcagcctcccagagtgctgggattacaggcgtgagccactgcgccccacctattttagttttcatatagacgggatctcaccatgttgcacagactggtcttgaattcctgggctcaagtgattctcccacctcagcctcccaaagtgctgggattacaggtgtgaatgtgcctggccctggcctgttttacatttttgagatacatagtttaacccaggcaaatacatttcttaatctcatgttaggaaaataaggtaatgtttggagaggttaaataatctccccatggacacacagcttgtaagggacagagcaaggagataggacaatcaaaattgtctccagacattgccaaatagccctttgggagcaaaatcgaccccagttaagaaccactgccctagactgcttttagaatttttttttccctctattcctcttaaagcacttgagctaaaccctcttttcatttttctccccaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctattctga

SEQ ID NO: 1498 - DNA, 2149 bp, Homo sapiens
  misc_feature (290)..(290): n is a, c, g, or t
  misc_feature (376)..(376): n is a, c, g, or t
  misc_feature (453)..(453): n is a, c, g, or t
  misc_feature (473)..(473): n is a, c, g, or t
  misc_feature (540)..(540): n is a, c, g, or t
  misc_feature (762)..(762): n is a, c, g, or t
  misc_feature (872)..(872): n is a, c, g, or t
  misc_feature (894)..(894): n is a, c, g, or t
  misc_feature (923)..(923): n is a, c, g, or t
  misc_feature (1247)..(1247): n is a, c, g, or t
  misc_feature (1544)..(1544): n is a, c, g, or t
  misc_feature (1928)..(1928): n is a, c, g, or t
  misc_feature (1996)..(1996): n is a, c, g, or t
cccagtgccgccgcctttattcacagaccctcgagctccacagccacacagacacttagctttcagagggcacaggaaggaaaagggacctggtgaccctcccagcacaccccagagccaagacagacccagcagcagcacctcagggtcagcctgggtgcccctgcccaggggccactgtgaccgcagacaccaggaggccaggcctggttgctggggacccccttggggggcccggcagtatcctaggcccaaagagctggtgccatcttgaagctgattcagggaangaggccaggctggacggtaggggtaggtgtgagaagctccccagcgtgtccaggccacgggagcagcaagggtctgcggggagccnaggctggatggggtggggctgcccttgtcctgtatcctgaccacttcaaggacaaaaccagcccagtcccagcagcntgggaggcagcagaggctcnttcttctcccctcctgatcctgcagtggccaggggcaggagggtgaggggagaggagagaggtcagngtcagggcccctgggggccaggcagcttcaaaaatgcagccaggtggctgggggagggcaggagggtgggcagggcccagacccccatgatgggggcagcctgagacccccaaggatgaaggaagggggcttgggaaggagaggcaggcctcagccgtcagtcacgccagtgctgggatctgcagcccgctggagcaaggcacccccatcccaggggcaggnaccacaggacaggagggaaccgacacctcgcaccctgatcttccggaggccggggaggggcaccgggcgctctaggacttcttggcatcctgcgtgctccggcgcttcanggtcactcaggtcgatgggctngaaggctgccaggggacaacgcggtaggntggtgggcacaggcccctcctgcccatgaggcccggcctgccggcccagccctgcccccaggtcagcccccactcactcttcaggctggggttagggaccttctccacatactcctccaccaggccccgctcgccacccggcacctggcctcgcaggtctcgctccacaccctgccaggctgcagaggcagagagtggtgtgctcagggccccctgccccagggggtggcatccacgtcacgagagtgcctgccctcagctcctgccctcccagatcctcttctccctcagaagtgtcctccatgctcccccacagccctctgncccaccccagcctcactcacctgcagaccccgtccccgctcctctggcaggcctgtcccttccccgcaagatgaccaggactgtggtcagagggacccctatgaccctaccccaggcttccctgcgcctcggaggcagcgcatcctcctcagctaggcctctatctttcccacctcatccacgcacctccccggccccagcacacggcacactcccctaatcccagacaaccacctcccggccacttctgcaacacgcccgttcatggctggatgcgtgcctgtctgtcttcaaagngcccctccctttccccagcaaactcctccagtgctgctagcatggatgactggctcccagtgcggcctctatctgtggcatggcccacccccagcccctcctcccgggctccccccatgatcagaaccaggtctcctctctacacaaggtcccctcggccacccctacccgcctgggccctgaaggctgtggacacagtgatggggctatctgtgccctggaggggcaggggcaggggccgcaggaggttcctcggagcgtgggtcctgggctgggggcagagctgactccgtcaaggacagggcaggagctgtgtgtggcaggcgcacccaccttcgtaaatgaagcggacgttctcctcgtgggctggggtgaagatctcgnctgctgctgggtggggagcgggggctgctggtcctcttgccgttgtacacgactctggagacgggggnagctgggggagcctggcgcatgagacagggcacacagcagggtgggagcccacaacccgccccggtggagaccagcccacctgcctgagacccacctggtcatcgcgggggcgtctgatcctagcgctccaccgccagatcccctcagcctct

SEQ ID NO: 1499 - DNA, 2149 bp, Homo sapiens; identical to SEQ ID NO: 1498
  misc_feature (290)..(290): n is a, c, g, or t
  misc_feature (376)..(376): n is a, c, g, or t
  misc_feature (453)..(453): n is a, c, g, or t
  misc_feature (473)..(473): n is a, c, g, or t
  misc_feature (540)..(540): n is a, c, g, or t
  misc_feature (762)..(762): n is a, c, g, or t
  misc_feature (872)..(872): n is a, c, g, or t
  misc_feature (894)..(894): n is a, c, g, or t
  misc_feature (923)..(923): n is a, c, g, or t
  misc_feature (1247)..(1247): n is a, c, g, or t
  misc_feature (1544)..(1544): n is a, c, g, or t
  misc_feature (1928)..(1928): n is a, c, g, or t
  misc_feature (1996)..(1996): n is a, c, g, or t

SEQ ID NO: 1500 - DNA, 9936 bp, Homo sapiens
  misc_feature (13)..(13): n is a, c, g, or t
  misc_feature (32)..(32): n is a, c, g, or t
  misc_feature (52)..(52): n is a, c, g, or t
  misc_feature (56)..(56): n is a, c, g, or t
  misc_feature (197)..(197): n is a, c, g, or t
  misc_feature (203)..(203): n is a, c, g, or t
  misc_feature (985)..(985): n is a, c, g, or t
  misc_feature (1062)..(1062): n is a, c, g, or t
  misc_feature (1514)..(1514): n is a, c, g, or t
  misc_feature (1972)..(1972): n is a, c, g, or t
  misc_feature (1976)..(1976): n is a, c, g, or t
  misc_feature (1981)..(1981): n is a, c, g, or t
  misc_feature (2070)..(2070): n is a, c, g, or t
  misc_feature (2169)..(2169): n is a, c, g, or t
  misc_feature (2205)..(2205): n is a, c, g, or t
  misc_feature (2214)..(2214): n is a, c, g, or t
  misc_feature (2297)..(2297): n is a, c, g, or t
  misc_feature (2300)..(2300): n is a, c, g, or t
  misc_feature (2303)..(2303): n is a, c, g, or t
  misc_feature (2340)..(2340): n is a, c, g, or t
  misc_feature (2552)..(2552): n is a, c, g, or t
  misc_feature (2595)..(2595): n is a, c, g, or t
  misc_feature (2626)..(2626): n is a, c, g, or t
  misc_feature (2885)..(2885): n is a, c, g, or t
  misc_feature (3167)..(3167): n is a, c, g, or t
  misc_feature (3276)..(3276): n is a, c, g, or t
  misc_feature (3332)..(3332): n is a, c, g, or t
  misc_feature (3440)..(3440): n is a, c, g, or t
  misc_feature (3643)..(3643): n is a, c, g, or t
  misc_feature (3652)..(3652): n is a, c, g, or t
  misc_feature (3659)..(3659): n is a, c, g, or t
  misc_feature (3769)..(3769): n is a, c, g, or t
  misc_feature (3804)..(3804): n is a, c, g, or t
  misc_feature (3807)..(3807): n is a, c, g, or t
  misc_feature (3835)..(3835): n is a, c, g, or t
  misc_feature (4036)..(4036): n is a, c, g, or t
  misc_feature (4134)..(4134): n is a, c, g, or t
  misc_feature (4300)..(4300): n is a, c, g, or t
  misc_feature (4477)..(4477): n is a, c, g, or t
  misc_feature (4523)..(4523): n is a, c, g, or t
  misc_feature (4565)..(4565): n is a, c, g, or t
  misc_feature (5004)..(5004): n is a, c, g, or t
  misc_feature (5652)..(5652): n is a, c, g, or t
  misc_feature (5834)..(5834): n is a, c, g, or t
  misc_feature (6245)..(6245): n is a, c, g, or t
  misc_feature (6283)..(6283): n is a, c, g, or t
  misc_feature (6297)..(6297): n is a, c, g, or t
  misc_feature (6334)..(6334): n is a, c, g, or t
  misc_feature (6351)..(6351): n is a, c, g, or t
  misc_feature (6393)..(6393): n is a, c, g, or t
  misc_feature (6404)..(6404): n is a, c, g, or t
  misc_feature (6406)..(6406): n is a, c, g, or t
  misc_feature (6409)..(6411): n is a, c, g, or t
  misc_feature (6414)..(6425): n is a, c, g, or t
  misc_feature (6427)..(6429): n is a, c, g, or t
  misc_feature (6431)..(6438): n is a, c, g, or t
  misc_feature (6446)..(6446): n is a, c, g, or t
  misc_feature (6464)..(6464): n is a, c, g, or t
  misc_feature (6470)..(6470): n is a, c, g, or t
  misc_feature (6473)..(6473): n is a, c, g, or t
  misc_feature (6475)..(6475): n is a, c, g, or t
  misc_feature (6487)..(6487): n is a, c, g, or t
  misc_feature (6506)..(6506): n is a, c, g, or t
  misc_feature (6509)..(6509): n is a, c, g, or t
  misc_feature (6516)..(6516): n is a, c, g, or t
  misc_feature (6522)..(6522): n is a, c, g, or t
  misc_feature (6527)..(6528): n is a, c, g, or t
  misc_feature (6558)..(6558): n is a, c, g, or t
  misc_feature (6651)..(6653): n is a, c, g, or t
  misc_feature (6655)..(6656): n is a, c, g, or t
  misc_feature (6658)..(6660): n is a, c, g, or t
  misc_feature (6662)..(6664): n is a, c, g, or t
  misc_feature (6666)..(6677): n is a, c, g, or t
  misc_feature (6679)..(6679): n is a, c, g, or t
  misc_feature (6707)..(6707): n is a, c, g, or t
  misc_feature (6728)..(6728): n is a, c, g, or t
  misc_feature (6737)..(6737): n is a, c, g, or t
  misc_feature (6879)..(6879): n is a, c, g, or t
  misc_feature (6884)..(6884): n is a, c, g, or t
  misc_feature (6894)..(6894): n is a, c, g, or t
  misc_feature (6896)..(6896): n is a, c, g, or t
  misc_feature (6899)..(6899): n is a, c, g, or t
  misc_feature (6902)..(6902): n is a, c, g, or t
  misc_feature (6904)..(6904): n is a, c, g, or t
  misc_feature (6921)..(6921): n is a, c, g, or t
  misc_feature (7354)..(7354): n is a, c, g, or t
  misc_feature (7498)..(7498): n is a, c, g, or t
  misc_feature (7523)..(7523): n is a, c, g, or t
  misc_feature (7650)..(7650): n is a, c, g, or t
  misc_feature (7770)..(7770): n is a, c, g, or t
  misc_feature (7995)..(7995): n is a, c, g, or t
  misc_feature (8045)..(8045): n is a, c, g, or t
  misc_feature (8063)..(8063): n is a, c, g, or t
  misc_feature (8087)..(8087): n is a, c, g, or t
  misc_feature (8090)..(8090): n is a, c, g, or t
  misc_feature (8092)..(8092): n is a, c, g, or t
  misc_feature (8476)..(8476): n is a, c, g, or t
  misc_feature (8814)..(8814): n is a, c, g, or t
  misc_feature (8860)..(8860): n is a, c, g, or t
  misc_feature (8865)..(8865): n is a, c, g, or t
  misc_feature (9190)..(9190): n is a, c, g, or t
  misc_feature (9330)..(9330): n is a, c, g, or t
  misc_feature (9340)..(9340): n is a, c, g, or t
  misc_feature (9342)..(9342): n is a, c, g, or t
  misc_feature (9344)..(9344): n is a, c, g, or t
  misc_feature (9351)..(9351): n is a, c, g, or t
  misc_feature (9649)..(9649): n is a, c, g, or t
  misc_feature (9718)..(9718): n is a, c, g, or t
  misc_feature (9728)..(9728): n is a, c, g, or t
  misc_feature (9735)..(9735): n is a, c, g, or t
  misc_feature (9786)..(9786): n is a, c, g, or t
  misc_feature (9923)..(9923): n is a, c, g, or t
  misc_feature (9932)..(9932): n is a, c, g, or t
agtttgcaccgancccgatctggcagcgccgngaagacgagcggtcaccggngccngacccgagcgcgcccagaggacggcggggagccaagccgacccccgagcagcgccgcgcggtgagcacctgggccgcggccccgaggggacgttggggagtcgacccggtggggacagagaccgcggggcgggcgcggcgnggccgngggcgcggggagcggggagccggccgggcggtctccggggtccgggctggtgcgctcctcagtcccgtcagacacccccgttcccaaccccggctcggacaccacccggtcctgcaccgtcgggcaggtccaggggtctcagcccctcccccgttctctggtcctggggggcgcggctgggggcgggggtgtcgctggccgcctggcgccctgcggcggccacactgcagcggccacactccccactcagggccccgggccccgccgccctggggagcgcacaaagcgccgcggacgcgtccccgaggcgcggggtctcaccagcgctgtctcccctcggtgggctcctgccccgaggactgcccggtggcaccggcgcggcccaggatggggtgaggggtgtctgcgccccgcctggccgctcctcttccgcggcccacactggcgactttgaccccggcaagcgggtcactgccctgcccggctccggcccccccggcgccccaccacccggccgactcggccaccgggcttatgctccgactctgaaccgactgaccccggccccctcggcgcccgcatcctccaaggaccggccagggctgctctctgcccttggtattggggacatcagggttggggggtctgggtgcacccacgcctgccccgcccccacggggtgagggcgcagggatagggctttgtcaacagcctgtggcccctgatcccgccccggtgccctgaccttccactaccttctctggtttcacaaaaacatcccnggctcccatcccggagctcctcaaagcgtctgagaggccccttgcggacgccctgggagccccgctgccttcctggnaccagtggccgctccacccatcctgggggcccagctccaggtctgcgggtccctcagccgcccccagtgggaatcggtggagcctgacgcagccaggagcgcccaagagtcacgtgttctgccagggaggacatgggacaggacacggggtgccagccctgcaaagcggccggggcagtggagctcaggtggccctaagccctggtggtggctggtgtggcccggcaggcagctgtgggagggaggaagggggtggcatgcggtgggggtctagagaaggcgggcagggcacctcgggagcccccccattgggcacctcgggaaccccccacattgggcacctcgggaaccctcccattgggcacctcgggaaccccccacattgggcacctcgggaacccccgcattgggcacctcgggaaccctcccattgggcacctcgggaacccccntattgggcacctcgggaacccccacattgggcacctcgggaaccccccctattgggcaccttgggaacccctcccctaattctcagctgactccaaggcctgagaaggagcttggtcacctggactgtgaaggtggagggtggggtccctggtgggtcgtcccacctaccagctgtgtcgccggaagggtaatacggagcactgtggccccggggagccccgagtggcagctccacagctgggagtttctgtccactccttcagtcaacaaacattgatcctgggctgaccggggcccgggggtgtcagtgtctcctctcgggggagagggctgggtgagatcaacagaggagcctcccttcttcccttcaggctggtgtcaccttcagtgatggggcagggtccccacttgggaagttaaatcgtcgtccccgtcccaggaccacagcagcctcagncctnctctncaggccaggctctctcatgggtgctcagctggaaattggtccccccccggctccacccacccctgttggggtgaggagctggagtctcncctacccatatgggacccaccacccgcagggaacggaggacgctcacacttctgcacctcctgcctcactatcagagacccagtggagaattgcctccncacctcacctcttgtattcagaggccctgacccctnagggatccnggactaggggtgccctatggggagcccacctgtggcctgtggatgctgagctgtcgggggaatcctccaggatccccagcccnacnttnccaaccttctgttgaggctgaggggacacagagcccncactcctgggtcctgactgtttcaaagaaaggcctgggggactgggcagccaacccctccctcggctcgctggggtctccagactggctgcccggctggaaggtggggccctggcacgcgaggacctcatgtgtggaggcactggcttggggggtgctcccagtggctctagagtcaacatgacaggcatcgaatggctcctgtttctctgncagagttggggcagagccaggcttggccacgctgggctctaangggctgtcattttgcccagggagctcctggnctgggtggtcctccccccagggtgagcacgcgtcccccccacccccacttcgaggcgcccaggcagggaacagctcattggccagtgtccttcctccttgtcccccgcctgcatctccaccatccaccctgctccagctgccccttgtccctctccccgtcccctgcccagagccccaggtctcccctgcacccctgagcctgcccacctagcagtgcccctcgtccagggcccctctgggttgggggtgcacacagtnggggagaggcggctcctgctgctcctcacccagcccggctcagtggccggagccgcccaggacagtggcagtagatggggctgtttgatcaggatcagggaagataaggccccttgcgtgaccccagagctggggacgccaaaactgcccctcctcccccacccgcctgccgctgtctccgccagggagaggcccctactctgtgggtccttcgccccagcaccaagcctgcatggctgctcacctggctcaggaactggggatcagcgacacacgggtccntgcctcccatcggcccctacatgagcccagggtccaagggctgcggttgggagctctttagcagtctgtgacgcaggtgcctgtccctgtcattcagctgtcacactgncttggggcatctcaggccccgttagcggggcagccctgggtggagctggccccacngcgggctcacccagccgctacctggaggaggctaaaatccaggctgtcccgtggcagccagcagtccaggcctgcccggaaaccctctgctccagctgcagccttcgncccatctccttgcccctctccccggcttccccctggcactgccttccagctggctggccctccatctgcccagccatccatccacacctcttattccatttgagggtgccccaaagaagagcccgtaacagcccgggggctcatagccagccactcgcgggaccccgcacatgcacgtggacccacaggaagaccctccctgncttctcccnacagaanttcagttggtgcagaaactgggctctgtagcaacgaaaggccgatttgtgtagctgttgccaccccgaactcccagctcagatgctggctgtggcatggggaccaggggnctgtgactcccacagccctggcaggcaccacgggnggnatgtcctccccaccctgtgcccccaccnctaggccagctcctcctccaagtcgacgcccgcagtgctaacctcaaaggactgtgcagccagcctgtggcgtcccatgggatccaggaagcccaaccgagccttgcacggcacccacgaggcacctaggcaccccggtgctgggcagggggcacacatgtgacacagacccctgagtgtgggccccacacacttggcctnggcacagctgcaagccagcccagccactttgctcgctgtggcactggggccaagtgatggaaggtccaggcaccgccaccctcacgcttggcacattnggctcaggtcagcctggcaagccagctttcccaggggctaagaataggtgaggaggatggtgaggaagcagccgggggctgtcaactgagggaggaggtcaccatctggggaggctggtcccccacccaagagcattgggtcaccctgcaggaaggtggctgccanccagcaatgagacgaggggctctgcgaccctcagagctgccagccagccagccctgggtggcaagagtgactcctcctggggtctcctccctcctatcgccctctttttttttttttttttttttgagacggagtctcgctctgtcacccaggctggactgcaatggcttgatctcngctcactgcaagctctgcctcccgggttcacgccattctcctgccntcaagctcccgagtagctgggactacagacgcccgccaccancgcctggctaattttttgtatttttagtagagacggggtttcactgtgttagccaggatggtctcgatctccagacctcgtgatccacccccctcggcctcccaaagttctgggattacaggcgtgagccgccgcgcccggcccccagctccctctttatccctaggaccctgaggctcagaggggcagcttcaggggaggacaccccactggccaggacgccccaggctctgctgctctgccactcagctgccctcggaggagcgtacacacccaccaggactgcattgccccagctgtgcagcccctgccagatgtgggaggcagctagctgcccagaggcatgcccccctgccagccacagcgacccctgctgctgttgctgctgctgctggcctgccaggtgaggactcacagcaccctcagcacccaggggccntcctgtgaggactgcacactgatggctctctgtctgcctgcctgcctgcctgcctgcctgcctgtctgtctgtctgcccgtctgcctgcccatctgcctgtctgtctgcctgtccgtctgtctgtccatctgtccatctgcctatccatctgcctgcctgtctgcctgtccgtctgcctgtctgtctgcctgtccatctgtccatctgcctatccatctgcctgcctgtctgtcggcctgcctgcctgcctgtctgtctgctgcctgtctgtccgtctgcctgtctgcctgtccgtctgcctgcctgtccgtctgcctgtccgtctgcctgcctgcctgtctgtctgcctgcctgtctgcctgcctgtccgtctgcctgtccgtctgcctgcctgtctgcctgcctgtctgcctgtctgcccgtctgcctgtctgtctgcctgtccgtctgcctgtctgtccgtctgtccatctgcctatccatctgcctgcctatctgtctgtccgtctgcctgcctgtctgtctgcctgtctgcctgtctgtctgcctgtctgtccatctgcctatccatctacctgcctgcctgtctgcctgtctgtctgcctgtctgtctgcctgcctgtctgtctgtctgtctggttgcttgntgcatgtgtcccccagccacaggtcccctccgctcaggtgatggacttcctgtttgagaagtggaagctctacggtgaccagtgtcaccacaacctgagcctgctgccccctcccacgggtgagccccccacccagagcctttcagcctgtgcctggcctcagcacttcctgagttctcttncatgggaaggttcctgggtgcttatgcagcctttgaggaccccgccaaggggccctgtcattcctcaggcccccaccaccgtgggcaggtgaggtaacgaggtaactgagccacagagctggggacttgcctcaggccgcagagccaggaaataacagaacggtggcattgccccagaaccggctgctgctgctgcccccaggcccagatgggtaataccacctacagccccgtggagttttcagtgggcagacagtgccagggcgtggaagctgggacccaggggcctgggagggctcgggtggagagtgtatatcatggcctggacacttggggtgcagggagaggatagggctggaggactcacccgggaggcagtgcctgggttcggatgagggaggcagccaccanctgggcagaggggggcaggtgtggcagcctccattggngcagagggagcagnatgtggcagccacaggtttggcgatgcacctgggaanggatgaaaatggcattngggttcagcccccagagagggaggtgctgagagaaggtcacngagaatggggnanccnnntgnnnnnnnnnnnnannntnnnnnnnnggggtctnccaagggaaggtgtcctncagagntgnanttcagggctggnctgggcgtgctagcggagnctngtccagnggaggnggatnntcaggtgaggaaggtggaggtcagatgggngaggtggaggtcaagtgggggagggagcagcccaggccatgtcctgggcgaggtgacggccgagctcaggcttccagagagaggagagaggcnnncnnannnannncnnnnnnnnnnnntnccctgccctgctctgccctgccctaccntaccctgcagagctggtgtgnaacagaacnttcgacaagtattcctgctggccggacacccccgccaataccacggccaacatctcctgcccctggtacctgccttggcaccacaaaggtacccatagaggggaggaactgtggggggggcgggcccagggtggggctgacncccangcctcccccncnacnacncncccagtgcaacaccgcnttcgtgttcaagagatgcgggcccgacggtcagtgggtgcgtggaccccgggggcagccttggcgtgatgcctcccagtgccagatggatggcgaggagattgaggtccaggtcagtgggcggcaggcaggcgcggtggggctggatgggaacgggcatgggggcccctgcctggccctcacaggccactgtaactcgcagaaggaggtggccaagatgtacagcagcttccaggtgatgtacacagtgggctacagcctgtccctgggggccctgctcctcgccttggccatcctggggggcctcaggtaggattccgccagcgcccggggcggccgcagaggacagggaggaggacgggcgctgactggctgtgcccacagcaagctgcactgcacccgcaatgccatccacgcgaatctgtttgcgtccnttcgtgctgaaagccagctccgtgctggtcattgatgggctgctcaggacccgctacagccagaaaattggcgacgacctcagtgtcagcacctggctcagtgatggagtgagcccccctcggcggccccaggcaggtgggtgnggtgggcagccaggcaggtggccangtagccgcgctcacactgcacctgtaccaggcggtggctggctgccgtgtggccgcggtgttcatgcaatatggcatcgtggccaactactgctggctgctggtggagggcctgtacctgcacaacntgctgggcctggccaccctccccgagaggagcttcttcagcctctacctgggcatcggctggggtgagtgggctggcatgagagggggttaaggcaggctgaccaagcctttgggaccancagctgctgccccccacaggtgcccccatgctgttcgtcgtcccctgggcagtggtcaagtgtctgttcgagaacgtccagtgagtatgagcggctggacagcctggggagggaccggggggctggggtgcggcgctctggcctgaggcagggaggggccggggatgagcctggtgcctggggagggggtcatttgtgaccttctcccttccttttctgagaccncgaattagatcctggcaaaatcgggacgggggtgctgaggggcggagggngctgggggctgtgccccnagtatgtgagtggcctggcctcgncangntgctggaccagcaatgacaacatgggcttctggtggatcctgcggttccccgtcttcctggccatcctggtgaggaaatgaagagccaggaacgcaccccaggcccctcctcccttggcgtcctgaggctgccccaggagacagcagcatcctgtctgagagcgctgggagggagccggcacccagacaggacaccaggacactggccagcaccctggacactgagccaggctgttcctccctggctgtgtgcccaccagccccagggctatgtggcccagggcctatcttgctgccaggcccacctgcaggagggtcaggtggggccttccaagggcacagagctgttccctggggctcgggatgcccctgactcgcaccctntctcacacagatcaacttcttcatcttcgtccgcatcgttcagctgctcgtggccaagctgcgggcacggcagatgcaccacacagactacaagttccggtgggtgccgcggcagctggcgtctcgagacctggagaccctcagggccagagggcagctgggggtggggactccaagctccacgtggatggtgcgggccgagggtgggggcggtgggtgactcaggcgctgcctctgcaggctggccaagtccacgctgaccctcatccctctgctgggcgtccacgaagtggtcttcgccttcgtgacggacgagcacgcccagggcaccctgcgcntccgccaagctcttcttcgacctcttcctcagctccttccaggtgnccgcncgcccgccggctcccccgcccggggcgcagtgtgccacccctgaccaccctgtctctccagggcctgctggtggctgtcctctactgcttcctcaacaaggaggtaggtgggagtgggggcatctgagaccatcagcactggccgtcggggtcaggggcagagagaggcacagggatgccagccccacccctgcccgggggttggaacacgtggggcccaagcctttccctccccctgctcttattgggtgcagttgccatggcgctgggtgtcaggcccccaggacaggttggcctcagccccatcgctacggtgtccaccgtngggggtccccaggtgtctgcagactgctttccgtggcgatgctgggtggcatagctgtgcccagcagggagcttgtgtcgctctgcacccctcagagcggagactgggcatctccgatgaggcccacagcaggtcccggntggggtggangnanggacagngcaggccctaggactggcctgccccgtccccctccccaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagnagggcgtcgctggacaacccagaactggacgcccagctgaggctgggggcgggggagccaacagcagcnccccacctanccccccnacccccagtgtggctgtctgcgagattgggcctcctctccctgcacctgcnttgtccctggtgcagaggtgagcagaggagtccagggcgggagtgggggctgtgccgtgaactgcgtgccagtgtccccacgtatgtcggcacgtcccatgtgcatggaaatgtcctccaacaataaagagctcaangtggtcacncgtg

SEQ ID NO: 1501 - DNA, 2925 bp, Homo sapiens
atgcgcaacccgcgcgccgtcgtccctggcaacactggctgctctagcgcctggcggggtctcacgggcgggcctgggcgcacggccaaagcgccaggtctccacccccagcccccggcgtcctgcagccggagcctgcctcgcctggctcctgcgcccgccgtccagggcccctgtccaagctcgcggacgccggcggcgttttccagctcgagtgctcagcctagggcaggctctgcgtgcgccccctcgagtgccggcctgggccctgccaggcagaggcgctcttgcgtcaggacggcgccgccggggccccgcgattccaactcgggggtcccggagcggcgcggggcggggacggcctggcagctcccagcagcgaggggcgatccccgcccgcgcagcagaccccgagctgcccaggcccttcctgcgccacgtgtacccagagctccgcccgggggagacttcgctgcttgttggagatgcccagcggtagggggcgaggactcgggaggaagataaacgggggatcccgtgtctggactttctcctccaccctcttcccttcgcagctgtgaatcctgggaggggaagggtggccgccccgccagcaggtgagcggggaggaaggggcggggacgggctgtggggtcctcctgggctccgtccatgaacaggccggccccaaagtcccgaagccgtgaggtgtaaggctcagaagcgtccctccgcctgtccctgccagaccccaggaactcctccgagccccacagcacgttgtcgccgtgtgcgctgtggggctgcgtgtggttcttacggtggtgtccttagtcgtcggggacctgctccccctgctctggacacagcccgagtctcacaggctctaggggcatgatatggtcctggcgtggcttccgaggcctcaaccttagtgtacaaaacagcacacggggccctgaggccaggagtgcagctccgtctcctgcctctcctccctgctcgcgtcctcatcctaccacaccacactgggctggcgaggggagggcgccctgagccgctgggcatcctgctccgcgggagggtgaagtcgtgcattgctgggcggtgagggctaggtccacacagcggggacctggcgggcccccgagtctcctcaggacccgccctccgtgccacacagcgggagctggagccacggtgccgtcaggagccaggggtgattggccctggggctggcagcccccaccccgcgggcagacgctcaccaggctgtccccactcactcccacaccccaactcctcctcacagggtcgagcccgctctcatttgcacctccgcgcgaatttggaacggatttatgaatcgtcctcactgcggtgctgtcttctcctgggaaggagcctcagtcctcccctccctgggcactgtcatagagatgggcaggacgggctggggaggacactcagggagctgcccaggctcctttgctgcccctcaccccagaatcttcttggggtgggtggggtcccaggcacctgcagagtagcatacggtggcttgtagaaagagtatcgagggaggggaggtgccacgtggaaacagcccaagccaaacccctaggacctgtctccctgtcctcctagagagctgaaggtgttccgtggtcagtgagggctggcactggctctgcacgaagatctcctcacctccccagcggctcctggccagctccccacggagagcccaggacacttgtccctggacacagtggtgcagccatgcttgggccaaaccatgaggccaccagaaccgcgaaaggctactgtactgagagggatactgcgagagaggcccacaggtttccaagcatccctctcactccgcacactcatctccacgaccggctttaagtgcggccttgaggcctggctccctgtttggacttctctgcacctccaggagctcacttcccgtcacagctggatgcctcctcccgcaggcacctcccgggcatcctcccgccccaggctgcaccttctgtgggactggcccccgcaggcacctcccgggcaccctcccgccccaggctgcagcttctgtgggactgagccccgcaggcacctccccggcatcctcccgccccaggctgcaccttctgtgggactgagccccgcaggcacttccccggcatcctcccgccccaggctgcagcttctgtgggactgaccttaagaccccatcggttcctcctgagagcagcagatctcagccagatgctgccgggagggaggtgctagcgtccacacccagacgggtccagtccagccctgctctccctggtctccaggcagggccctcccagggtggacattgcccatctctgcctggccaggggctgctgacccactggttccagagtctgagcctgtcctgcacaagtaccatggacaggggtcagccgggcactgaagaggcgtggcagaattgggcagggcaagggccccagctggcaagctggagtcagggcaattccaaccaagaaactgcggcaggccgggtgcagtgtctcaagcctataatcccagcactttgggaggcagtgggagaatcgcttgagcccgggagtttgagaccagcattggtaacatagagaccctatcgctacaagaaaaaaaaaaaaaaaaagctgggcatggtggtgcacacctgttgtcccagctattcaggaggctgacgtgggaggattgcttgtgcccaggggttgcaggctgcagtgagctgtgatcataccactgcactccagcctgggcgacagagaacctctctaaaaaaaaaggaaaatgaaaaataaatgggggcagaagctgagccaagcagaggcgggcagctcctcctccagggcccacctggcctgctgggga

SEQ ID NO: 1502 - DNA, 4700 bp, Homo sapiens
agattacattgacattttaatcagtaaggcagatgccctccaagatgtgggcgggccttgtctaatcagttgaaggcctccactattccacccacagtaaccaccctcccacacaggcagggcctccctcctcatgtggcagacagaagtcaggacactgggggctggaaaccaacttataaaactgaaagggccaggacagaactgatagcaccctcccagggaggtcaggagcaggaggtggtggccacagaagttcaccagcagcccaaggagccctttccccaaatgtccatgggatctgcgtgcttggcagccaagaggggctgtggcccttcacgctggacttgggatgcctggaccctctggcccttctcacacgggaaggagaggtttctccctgaatggagggcagggaggggccgggagggggcgtgggatcccacctctgctgagccttcacagagggggtccttgacctttgctctcaggaaggagcccgtgccagctgatactggagtaggagtgggtgaagaccctccgggctcccgagctctagaggaaggtggtcctgacatggtttgggagcagagaagaaaggaggttgaggttggggaatccacccctgttctgggctgggaagcacttgcagaccacagagatttccagtgggaagtgatgtggcccctccctggctatgtccctggctggcccctgcgctgatcagagccacagaaagtgggccactttggggaccccctagtccccctagtgacaagagaagagaaggtggtggcaggatggtggtcaggcaggacgtgtcaatccttgcccgctggggccaggctgcgggggagcagcttggtgtggccagaaggcgacagagcggtccctgcaggggagtccagcttcaccttgtccaggatggtcttcttgatggcggctggtgacacctgctcctggtcagccatggactgcagctccctagagaggcagggagaggttggctttggagcacaagcgtgcacccaggaagagggagtgaagcccacagctcccagtgccagtcagccctgggcgatgctgtcaccctcacctcagcacctttattcccctctgccagcgacacgcccccacacagctgctgggctccttctcacctcattcgaatcagctcagcatcaccaaatctccccgcagtgccccccagacctgagttctcgtggccccaccacgggatgtgggtttacacctgtctcccctgcaggctggaggtgaggccaggcccctcgtgttcccctcactgttacagggtggcactcgcagagtctgagggtgtctggactggagagtgggcagtgtggcgagaaagacgtcctcacccaccctgcagacctgaactggggacagcggctcccagcctggctctgcctttgaccagctgtgggatcccaggcaaacagcaaactctgtctttctcttgctctttgcttctttcaccttccatggaattttccttgtgcctggatgttgctgcgtgtcctactggtctaacttaatcccacagcgagggcaggaggaaggtgggcccccacagaagtttcctaatgtggctggccaccccgccaccccactggtgtggcccctggctcaaatgacactcctagctatgacaatggtgaacctatgtggggagcacagggcacagcatccgggtccctctatggatgttccctcctcgcaggaaacggaaggtggggaggggcactgcccacagtaacccagggaacctcggggccccctgtgtcctgcgcaacactgggctggagctcaatacgtatctgctgagtgcgtgaatgagcagatgtgtgtgagagaggcctctgccatgcaaggactggagaccagggaagcgggcagcgcgggggcccaccgtgtgcggatgcaggaggcctccacagcgttgatgagcagggagcggaagcccccactctccagcacatgcaaggcatggatggtggccccaccaggagagctgacgttgtccttgagctggcctgggtgctgttctgagtgcagcagcatcttggcagccccctgcagccagaagaaaggctgacggctgtgggcacgcacctgcctctgcggggcactgccccagccactgtagcacacactgacgccccacttggctcctcccagtgaagccccagggccccgcaaagagtggccccaccagagggtcaggaaacacactgaccaggagggcctgggccccgaggcggactgccaggcgccttggaagtcccatcttcacacccccatcagccagggcatccagggctgtgaatgcctgtggggagaaggcaccctgagcctctctcctgggcttctcctccttcccttctgggcaagctccagttcccacagccttggagccctccaccctggccctcccagggggagcagggacagatgtgcccggtggtcccgggaagtgcccgccgccgccagcttcccccgcagtccttacgtaggcggggccgctgccactgagccccgtgacggcatcaatcaggtcctcttccacctccgtgcagaagcccacgctgctcagcagctgctccatgagcctcccgtcctccacctgggcgtgcgtgcctgtggcatacacggtggccccctcccgcaccacgactggagtgttggtcatgcagcggatgaccctgggggctggccgaaacgctgacagcttctggaagagaaaccagcgtgtccgtctggccatggacgcagtgcctagatgcactcaccccaccaagcagtgcccgagctctcccagtgggccgggacgctgcaacccttttgcagatgaaaactgaagtactgagggcccgggctctagacagcccctctccacaccccactgggcctgcggtgctaccttctcaatggagctgatggtgacgccggccgcgcaggacaccacaatgtgtctgtcctcaatgtcggcgcctatttcatccaggatgaaggggatgatgtgtggcttcacagccaggaagagcacatcactgtgctgcaccgtctccttgttgtggggtgtcaacttcacccccatcttctgcaggggcaacaggtgggctcagcctggtcccgtggctgtctgtacccccaccaagccaagagccccacaggtagaatggcacagagaatgctggagttgggggtgggcagggctgggggctcagggctctgaccacccccttgatgacccttcccacccagaaatggaggaagaactctgtgtggaatatgtccctgctgcagacagaaaaggaccctccatccatgccaccaatctgcccccagcctgggactgccgtcctccagaccgggctctccacgtgggagtggtggtctcaagcagcccccaggtgtgttccttggctgccaggctgtggccccacctgccaggcccccagaggacccctcgaaactttaaccctgtgcagggaactccattccagaacaacaccctcctatcagctgtacacacgcccaccacccaggtcccaagagcaatcagcagggcgaggaggtggggtccatgagaccccagcccagggcccctgccctcactggggtgggggctacagcacacactcctgcctctcacacccagccccacagagactcagtctcctttctccctttcatctgcacctaccctgagagcagaaactgtggccaggtccatgtctggggagctagccattatcttgtgggcagccaagacgcctgaggggagaaacagttcctcttcagttctttattatttttttttttttgagacggagtctcgctgtgttgcccaggctggagtgcagtggcgcaatctcggctcactgcaagctccacctcccgggttcacgccatgctcctgcctcagcctcccgagtagctgggactacaggcgcccgccaccacacccggctaatttttggtatttttagtagagacggggtttcactgtgttagccaggatggtctcgatctcctgacctcgtgatccgcccgcctcggcctcccaaagtgctgggattacaggcgtgagccaccgcgcccggccggaaacagttcctcttcatggctagctttggcttccctccctccccattcccaggaagaagagtgagacagcacaggtaaagccccaaacacacagaagttgccagttcccgcaggactcaggccttgtgacccagcacccaccttcagcccccagccctgcagaagtggaaagaggccagtctctcccactgggcctcaccgtcccccacctgggggcctacctgctgctgtgaagcccttggccagggcaaaagccagctggccagcgccgatgaagcccacgctcatgctgtccggagacccctggcccaaagcccccacagatggcaccggctctgcgggacgagaccggcaggatcgagagcaagttaggggggcagtgccagcctggccgctcctcccgcagccgggtgcccacctcccctggtcccagctggtctaactttccactttgctgtccggcccgttaactgcttcggggcccccagtcagagcggcggtgcctggcctgctgcctagggtcccgcacccactggaggggtggaggttccgcagaagaaatgact

SEQ ID NO: 1503 - DNA, 4702 bp, Homo sapiens
ttagattacattgacattttaatcagtaaggcagatgccctccaagatgtgggcgggccttgtctaatcagttgaaggcctccactattccacccacagtaaccaccctcccacacaggcagggcctccctcctcatgtggcagacagaagtcaggacactgggggctggaaaccaacttataaaactgaaagggccaggacagaactgatagcaccctcccagggaggtcaggagcaggaggtggtggccacagaagttcaccagcagcccaaggagccctttccccaaatgtccatgggatctgcgtgcttggcagccaagaggggctgtggcccttcacgctggacttgggatgcctggaccctctggcccttctcacacgggaaggagaggtttctccctgaatggagggcagggaggggccgggagggggcgtgggatcccacctctgctgagccttcacagagggggtccttgacctttgctctcaggaaggagcccgtgccagctgatactggagtaggagtgggtgaagaccctccgggctcccgagctctagaggaaggtggtcctgacatggtttgggagcagagaagaaaggaggttgaggttggggaatccacccctgttctgggctgggaagcacttgcagaccacagagatttccagtgggaagtgatgtggcccctccctggctatgtccctggctggcccctgcgctgatcagagccacagaaagtgggccactttggggaccccctagtccccctagtgacaagagaagagaaggtggtggcaggatggtggtcaggcaggacgtgtcaatccttgcccgctggggccaggctgcgggggagcagcttggtgtggccagaaggcgacagagcggtccctgcaggggagtccagcttcaccttgtccaggatggtcttcttgatggcggctggtgacacctgctcctggtcagccatggactgcagctccctagagaggcagggagaggttggctttggagcacaagcgtgcacccaggaagagggagtgaagcccacagctcccagtgccagtcagccctgggcgatgctgtcaccctcacctcagcacctttattcccctctgccagcgacacgcccccacacagctgctgggctccttctcacctcattcgaatcagctcagcatcaccaaatctccccgcagtgccccccagacctgagttctcgtggccccaccacgggatgtgggtttacacctgtctcccctgcaggctggaggtgaggccaggcccctcgtgttcccctcactgttacagggtggcactcgcagagtctgagggtgtctggactggagagtgggcagtgtggcgagaaagacgtcctcacccaccctgcagacctgaactggggacagcggctcccagcctggctctgcctttgaccagctgtgggatcccaggcaaacagcaaactctgtctttctcttgctctttgcttctttcaccttccatggaattttccttgtgcctggatgttgctgcgtgtcctactggtctaacttaatcccacagcgagggcaggaggaaggtgggcccccacagaagtttcctaatgtggctggccaccccgccaccccactggtgtggcccctggctcaaatgacactcctagctatgacaatggtgaacctatgtggggagcacagggcacagcatccgggtccctctatggatgttccctcctcgcaggaaacggaaggtggggaggggcactgcccacagtaacccagggaacctcggggccccctgtgtcctgcgcaacactgggctggagctcaatacgtatctgctgagtgcgtgaatgagcagatgtgtgtgagagaggcctctgccatgcaaggactggagaccagggaagcgggcagcgcgggggcccaccgtgtgcggatgcaggaggcctccacagcgttgatgagcagggagcggaagcccccactctccagcacatgcaaggcatggatggtggccccaccaggagagctgacgttgtccttgagctggcctgggtgctgttctgagtgcagcagcatcttggcagccccctgcagccagaagaaaggctgacggctgtgggcacgcacctgcctctgcggggcactgccccagccactgtagcacacactgacgccccacttggctcctcccagtgaagccccagggccccgcaaagagtggccccaccagagggtcaggaaacacactgaccaggagggcctgggccccgaggcggactgccaggcgccttggaagtcccatcttcacacccccatcagccagggcatccagggctgtgaatgcctgtggggagaaggcaccctgagcctctctcctgggcttctcctccttcccttctgggcaagctccagttcccacagccttggagccctccaccctggccctcccagggggagcagggacagatgtgcccggtggtcccgggaagtgcccgccgccgccagcttcccccgcagtccttacgtaggcggggccgctgccactgagccccgtgacggcatcaatcaggtcctcttccacctccgtgcagaagcccacgctgctcagcagctgctccatgagcctcccgtcctccacctgggcgtgcgtgcctgtggcatacacggtggccccctcccgcaccacgactggagtgttggtcatgcagcggatgaccctgggggctggccgaaacgctgacagcttctggaagagaaaccagcgtgtccgtctggccatggacgcagtgcctagatgcactcaccccaccaagcagtgcccgagctctcccagtgggccgggacgctgcaacccttttgcagatgaaaactgaagtactgagggcccgggctctagacagcccctctccacaccccactgggcctgcggtgctaccttctcaatggagctgatggtgacgccggccgcgcaggacaccacaatgtgtctgtcctcaatgtcggcgcctatttcatccaggatgaaggggatgatgtgtggcttcacagccaggaagagcacatcactgtgctgcaccgtctccttgttgtggggtgtcaacttcacccccatcttctgcaggggcaacaggtgggctcagcctggtcccgtggctgtctgtacccccaccaagccaagagccccacaggtagaatggcacagagaatgctggagttgggggtgggcagggctgggggctcagggctctgaccacccccttgatgacccttcccacccagaaatggaggaagaactctgtgtggaatatgtccctgctgcagacagaaaaggaccctccatccatgccaccaatctgcccccagcctgggactgccgtcctccagaccgggctctccacgtgggagtggtggtctcaagcagcccccaggtgtgttccttggctgccaggctgtggccccacctgccaggcccccagaggacccctcgaaactttaaccctgtgcagggaactccattccagaacaacaccctcctatcagctgtacacacgcccaccacccaggtcccaagagcaatcagcagggcgaggaggtggggtccatgagaccccagcccagggcccctgccctcactggggtgggggctacagcacacactcctgcctctcacacccagccccacagagactcagtctcctttctccctttcatctgcacctaccctgagagcagaaactgtggccaggtccatgtctggggagctagccattatcttgtgggcagccaagacgcctgaggggagaaacagttcctcttcagttctttattatttttttttttttgagacggagtctcgctgtgttgcccaggctggagtgcagtggcgcaatctcggctcactgcaagctccacctcccgggttcacgccatgctcctgcctcagcctcccgagtagctgggactacaggcgcccgccaccacacccggctaatttttggtatttttagtagagacggggtttcactgtgttagccaggatggtctcgatctcctgacctcgtgatccgcccgcctcggcctcccaaagtgctgggattacaggcgtgagccaccgcgcccggccggaaacagttcctcttcatggctagctttggcttccctccctccccattcccaggaagaagagtgagacagcacaggtaaagccccaaacacacagaagttgccagttcccgcaggactcaggccttgtgacccagcacccaccttcagcccccagccctgcagaagtggaaagaggccagtctctcccactgggcctcaccgtcccccacctgggggcctacctgctgctgtgaagcccttggccagggcaaaagccagctggccagcgccgatgaagcccacgctcatgctgtccggagacccctggcccaaagcccccacagatggcaccggctctgcgggacgagaccggcaggatcgagagcaagttaggggggcagtgccagcctggccgctcctcccgcagccgggtgcccacctcccctggtcccagctggtctaactttccactttgctgtccggcccgttaactgcttcggggcccccagtcagagcggcggtgcctggcctgctgcctagggtcccgcacccactggaggggtggaggttccgcagaagaaatgact

SEQ ID NO: 1504 - DNA, 16396 bp, Homo sapiens
aactttttgttcttttatttgtggttattgaggtttcaataatagtaatggaagcagacctcattagtccctttaacaacctgaatccagaggaacaacttctggaccctcatgaatttgagagccaccagctggggatagcctgtagtagtctgaggagtgtctaaggagggtggtggattctgtccacatgcctgcggctcgaagggaaggttttcattggcagccagttacttaaacttaagaaagaacaccacattgaaagcctaaggtcttccttctctttggggagaataggtacatgtaaggtgatagggaaggagaaaaatagacattctcttatccagcctcctttgaatctccctccaggttaactacttcctctaaaacatttgctgacccacatccagggcacccggaaagcccacaatgtggaggcctttttctaatcctcccccaacacttttgcccctaccagctgagcagtctgcttaccaagggtcacttctgcttgttccaaaactcttttacgccagttgttcttattgttatgattaaagtgcaaaccaagaaaacttaagtgtagaactcccaccagacaaaacatataggtcacaaaaaagcacagcttggacccacatcaaaagtttggcagccaggcacagtggctcatgtctgtaatcccagcactttgggaggccaaggcgagtggatcacgaggtcaggagttcaagaccattctgggcaacatagtgaaaccccatctctaataaaaatacaaaaattagctggggtgatggcacgtgcctgtagtcccagctacttaggaggctgaggcagaagaatcacttgaacccgggaggcaaaggttgtggtgagccgagatcacgccactgcactgcagcctgggtaacagagtgagactcagtctcaaaaaaaaaaaaaaaagtttggcaaccaagtgaactttttatgtcttcaaataaaatacgtaagatgtttaagatgtatattttaagtgattctcaacttctaccaattacattaataagccaatcaactctttcatcttgatagtgttggatcagaggttttccaccatcctatgattctctgtccagattcaagtgaaaatccaaaaaaacttcaaaagggaagttcaaaaccaaatcattcaaaaaaacttttttccactgagggaatacacacttttcccccctgttgattatatctcctccgggtattttatttaggctactattaaggtccacttgcattttctgcatgtgtgctggtagttgagggtagacacttccccacccatcccccttacaccccacttcaaccccagagtgtgtgggaaggcctcctggccttccagattttccatgggtgatccacacattgggtaatccacatgcccatcatcaaggcctaaccatgttagaaaagggaaggacaatgaagctgcaggaagctcttctagaacatttcactcagctgcctcaaggtcagtcaggggtttgggcatcactttctggagaaagccagagagcaggtgtgaccagctgcagaaagcggaaccctggaattgagaaacctgggctctttagggcagcatctgaagtccttggagctgagcctctggaagaagctgttagggactggccacagcccatgcgatgacattgtggcgtggggtaatgagtaacctacctccacccctagctacacttcttggagagcagcttagattctcatcccactgccaaggtaagagatggatcaggccacaggtaggtagagatgtagcctttggacctgtcccttcatagcccaggattccaaactcaggaacagacactattcatgcaggaacaatctcactgttcatgaggagctggctgcagttaaaggcagaagaagtgtccctctctgagcctcaagttccacatttactagctgaagagagtggatctaaatgtctctctggtcccttccagctgtgcctgcctatgaggctgtgtgtgacccacctgcagtggtgagctcagccagtcactagcaagaaggcataccagccaacaggtcccttctcattggggatgggggtaggggggtgaatgggacatccctgaaattggggtgagaacctaggtcttgccaaaaggcagggcaactgtccccttttagacagaaccaggagatgaggatggggcaatggtctgtcttccaaaaccttgaatctgccagttagggaaggggctgctcctgcagactagcgcaggagagggagagggcggtgccgctctacgacctaactcagctttgtggccagaggaagaggatggggcagggagtcgcttcattttatagcagcgtcttgggatggggccgcctcttgggtctcctcgtcaggcctaggtggggaggttccagggcccggcgctccggtcaccggcctatcattccccctgcagaaggctccgcttctgggcagggaagcggccggggtcagtcggctttgggcgcccggaattcgggcatgctccaggaccgcagtggcggcggtgtgtcccgctccacgtcctcggagatggtcctgatgtcgctggcgaagggcgagatgcgcgcgcgggtcttgaaggtggccaggctgccgcggggccgcaggctccactggcgcgtcagcttgtgggcctcctcttcctgcttcatcctctccaggacctcctgcagcaccgagcggaagagctgggacacctcctgcacctcgggctcctgctccgccagcagctgccggaacctgggcgggaggggagggcgctggggacattcacccacaacagcgggtctggcaccccgggcgtctaaccccgaggggctgcccgtgcatcctcatggccaattagtccactctactctgctcctgaagcgaatcaggaaccaccccacgctgctactgcttcaaccaatcctgcgttcaaatcccagctctgccacttctggcctcagttggcctcagcctcctcgtctgtaatctgagatgacagctgcctttgtgtgagctataatgaactaagatatgtaaagatcctgacacttacctaaggttgttgatgacgaagcattaaggggagccctttgccgtggcagccttctggctaagcctctcctgtctcttctccacccactggccagcatgatctttctgaaacctatatctgattatgtcactgcccctgtgatattccttccaggtgagctgtttgccatgcacaggggtcccctgatacttccctggaagaccctgcacatcagctgggaagaatcacttgtggccccgacatgtcccagcttctcccaaggccctgtgttttcccaagctgtttactctgcctaggctatctttgcttagagctcacaagttaatgttagcaagtctatttaataccaggtttcctccaccagattgagagtcaggacttcccagcagtgacatgagaccggaaatgagacaggacaatcatgacctgtgtgtacccagccttccccctcacttttgaggcttgatttgccagcccagattcccttttcagcagctccaccccatgacccacccccgtccccaggtgcttctggaatagatacactttggaggcttccacagtacagaatcagagctgggggagagtaaggttctccatctggaggaagaaaggggagggatggtaaaagctctgcaaaaaccaaggagtgtggacggggctgaagaaggtgaaaggggctgaaggagaggagcttttgaagggaatttcaaagaaaaaggtgtataataaatgcatatgttggttaaagggatgggtgagggaagattttgggagactaacaggagttttaagatgttttattgtggatttatattcctttacaaagagaaatgtagacaaagaacttgagttattttgaaattactcgatgcttccttgacatcagcaccaatccttctgagacaggaccatgtggtcacagcttcagtaagtcagtaaggttacatttatattcaaggaacattgttgtacccaagctctaaatgtgcagtgccccagggttttgtttgaacccttcctacacacacacacacacacacacacacacacactcacctgtggtcagactagcatgaaagctaacataagctaagataattaagaatctgactttggagaaatgtctggaaaacttctccgagaaggtaatattgaagataaactgacaagagaaaagaagccaggtaagttaaaatccaggacaataacaatctgggcaggaagaagagaaaactcaaaagtattgtgttctcttgaatcaaaactcacgcgcctccaggagctgcctcctgcctcccgctggacccctaaccctagtccagcgtttcatggtctctttcagactccttttcccctcttgctccttctaacagataactaggtcatccaggctccctgactctagtcctggtggcctcaggcccctgccactgcagccacctttcctggagcctgcagcccagcaagggtccccatcccagtgctcacctgaggatagcaggcccacaataggatgggtggatcttaacgcagacatcttccagctgcaaccgctcaatggggctgaggtcataggtggaccggggtgtgctggccagccagctgtagtccacaccggtgcagacctttctgaccgcattgctgcgctcccgctgctgcctctcagcctctcgcatctgccccgtcagctccatcataagcgtctccagcaccatctcagcagggctcctggtggacagccgggatggggcctcgttccaccgaagccatgagatgagagacatagcccctggccctgctgagacaggacagatgtgcatctttcctgggcccctctgttagtcagagtggggaacctgggaacccaagggggagagaggagagctgggacccaggagagaagacctgctctgccctaacagttgagtggcctcaagtaggtggcttaatttccctgagcaatcatttctaattctgtaagacaagatagggctgttgtgagaagcagttgtgaataaactttgtacactgtaaacatcacataaaagtaagagactcttgtgattatgatccttaaagcatccccaggattgtgcccagagaaagggcctcctgaatcctcactaactcccaacaaagctggaaacacatggactatggctgagcacaagctttccctatgacttaaggggaacacacacacacacactcagaacagatacatcctatgtcagtctaccaggaaaacaccctcagcttctaaatgcctccagcctattgacgaaagacacttagaactctatggggttggccagccatggtggttcacacctgcaatcccaatactttgggaggccaagatgggcagatcacctgaggttgggagatcaagacaagcctgaccaacatggagaaaccctgtctctactaaaaatacaaaattagccagatgtggtggtgcatgcctgtaatcccagctactcgggaggctgaggcaggagaattgcctgaacccgggaggtggaggttggggtgagccaagatcacaccattgcactccagcctgggcaaaaagagcaaaactccgtttaaaaaaaaaactgtatggattaacattaacctgaaaaaaaccaacttacccaccattcattcattcagcattaatcaagcactgtgtacacatctgtggagggacataaacacgaaaggatgatgccaggatcctgctctccaggagaggcaagatttgttgagtaaacgctgcaacatcaatggagagagggaactctgctggtgaagcatagagtcagcactgatgtgggaggggaaggtgtgaccctagatggtgaaaagtgccagagtgggctgagaggtgagtgcgggcttcagacacatgggctgatggagaaggggtcccaggtggagggaggatccagccatagaacaaggtgagacaggtggaggtctgacagcagcgagcctaactcatcatggagcccccacacaggcctgctaaatacaaatttagtgaaggacagaccgagtagatgaatgaacgaatgaatgaatgggtgaatgagctactccatgacctgtcagatgtggtctgtgcttctgacaacagtgaagggaaatgacattcccgagctaaagcctgaagtgggtcttcgaggggtctcacttcatctttctgcacctttctccctccaagccgttcccccttccatgcaccaatgatcccatttctgcttagaccctccatacgcagagaaaagaggtcagatgaactcagtctcaacagcatggtgatgaaggaggtgtcacctccagaggacacatgcatttttaggccaccctcccatcaccctgcaccccagtgcttaatgcagagaaatgaattgttaaggtaaataatcagacacaaaggagaatattatgatggggtagcagcagccttctggaaggccacagctaaatctctacttaccgatggagacttgaatgaccaactcctttagcaaccaacagaattaagaaatctgaaaacaggccaggcatgatggctcatgcctgtgattccagcactttgggaggccgaggagggcagctcacttgaagccaggagtttgagaccatcctggccaacatggtgaaaccccatctctactaagaatacaaaaattagctgggcatggtggcacatgcctgtagtcccagctactcaggaggctgaggcaggagaattgcttgaactggggaggcggagtgagctgagatggtgccactgcattccagcctgggtgacagagcgagactccaactcaaaaaaaaaaaaaaagaaatctgagaactttcattctccacgcaacctaagcctatcaccaatggaggcttcagattacacagctgaccgcttcctgggagagtgggacgaaaggacgaaccattagaccctactcctggggtcagtagcagctaggacgtttacttcttagcccttacctgctttatgtgcccagaataaagaggttgggtagtactgtgtgtactggggggtgggagtgcaggggtgggggtgtcatggccagagagccatgagcatcaggagcctcgcctaaggctaaaggattccatcagttcaggcacaaggactgtaactgtaactgaatgtgtcactttccctggagtgtttgtatttttaaaagtctatgggttagattgatgcttagcaccaaaagagtgaatggtgtagccactgaagagcactgcgagcatgcggagtcactgttcctgcaagggctactgaatgtgctgggctactgcacagctccatgcctttgtcatgttcctccctctgcctgaaatgcccgcccattctacatggagaccaggtctagggtcagcaccctcggaagcttttcttgaccttcccatctccgaggtagatgtggccactctctaccttgtcccctgactgcactctgcacaggtgcttttcagagctcaggagcactttacggaacgtgactgcctacctcccctgaccccgggtgtggtatgtggtcagggcctgtgccttattcacctttccatccctggggctggacatgtagtcagtaggcacttaataaatagcaaacaaatgaatgaatgaatgcccgaacaaaggaacgaataaatgatggagaagctataacagttggatcaaggaacaagccccacagacctgacctgacctgatcctgaacaagaaggcattttccaaagctccttagggagcttttttttcttcttaatctgggtttgaatttgagctgaaagaagagagcaagagagtggcttggcagcagagggttctcctgtggccgggagaaatgtgagagaagaaatggaagacactgaagaaaacttttgcctccagggcaaattgactgcagaatatccatgccacagccacataagctaacaaactattaaataaagtatgttccgtttcctcccttgtgaactataccttcctaacaacatggagggtgagattcagacagcattcttggactcctcagagttcttctctgacacatggaggtgggttgggactgctctcggccctcagcctgcctccctctcttcccacctccgcttcatcccacatggtaaggggccttgcaaacacgtgtggggacaccccagctttcacctccaaggcccagccacacccctgcaaccagccacctctgtgccaccctctgacttagggttgctcgctggcagtgctgtctgccctgctcagtggccccttctgtggggaagtgggcgggcgactgtctggcagggaattctgatttcagtccctaagcctgacctcgaagggaagtgcccacagggtggcatgtctcctggacccccagacacttcacctcaaggcagagtaaggccagaagcaagcccgagtacagtctggggtgcagcctgtatggggtcctgcttccctgggcttaaggctcccgacctgagctggccgctagagaaggtgctttgtgacccacctcccccatctccagatggcaggggctgagtggagtgatcccacctgagtcctgaattttgtgggctctaagcctctttggcccaggtgtagggtctcaacaggggaggagggtgttctgagtcatctcctccccatcccctcacttcccgcaactctggccaggactggaggctttggcagaaacaagatttctgctggtgctatttctgtccccagtgccagctgctcccccagaaggctcttcagtgggtccgattaagttcttaagggcaaaggagggagggagagacagagggaggaagaacagagacagagaggcaggagggcaggctagacagactccagagggggctgccttatcccagggtatccccagaacctgaacctcggctgagactgggaaggacgtggtgcctgggggaggtctgttaaacaacagaaagagtgacctttggtgagtgtctggcacaattttctacactgcctggctccagattcaccaccgtggcagagccaactcctcagtgtaagccccaaggcccccgcacttggctcaccacctggcgagtggcagcgccatggtgacctcagagtcttcccatgatgaatggttcccactcagtcaaaggcacttacaacctgcctcaaacacatgaacactgattgaatccttgttttaaaaaattaggataggccaggcacgatggctcatgcctgtaatcccagcactttgggaggcttgagttcaggagttcgagaccagcctgggcaacatggtgaaactccgtctctaccaaaaatataaaaaattagctgggcgttgtggcatgcgcctgtagttccaactactcaggaggctgaggtgggaggataacttgagctaacttgagcctgggaggtagcggttgcagtgagttgagatcgcgccactgcactccagcctgggtgacagagtgagaccccatctcaaaaaaaaaaaaaaggagataccctttatcaagttaggaaagatccccttctttatatttaaaagaaaaaaaggctgggtgtggtggctcacacctataatcccagcactttgggaggccaaggtgggtggatcacctgaggtcacgagttcgagaccagcctgggcaacacagtgaaaccccgtctctactaaaaatacaaacattagctgggcatggtggcgggcacctgtaattccagctagtcgggaggtggaagaatcgattgaacctgggaggcagaggttgcagtgagctgagatcgtgccattgcactccagcctgggcaacaaagagagactccgactcaaacaaaaaaaaattaggataactgaggaaatctgaatatgagctggatgttagaaaataatccatggggctgggcacggtggctcacatctgtcatctcagcactttgggaggccggtgcaagtggatcacctgaggtcaggagttcgagaccagcctggccaacatggtgaaatcccgtctctactaataatacaaaaattagccaggcatgcatgcctgtaatcccggctacttgggaggctaaggcaggagaatggcttgaacccgggaggcagaggttgcagtgagccgagattgcaccattgcactccagcctgggtgacaagagcgaaactctgtctccaaaaaagaaaagaaaaaaagaaaactatctgtggaatattggccaatagctcaatcttaggaggtgctgaagtgtttatgggtgtctacaatatcttacattcaaatagttcagaaaacattacataaatatgtatacacacaccccataaacaggatgttggggctcagaaaccaatatcctaagatatggcatttggacatgctgagctgaagaagcctcgtggtctctctggccctccccacggccaccgtctcttccaaagcctttgtctgcctaagatccagatccaccaaagggaacaatggtttttttcttcccctttcttaagaccgagaatgagcccccacctgaacagaccctctcccaggataatgtacaagttcatttctgatccctgccccgttcattctccctagtaatcctctcaccagaactgctgttctccccctcccataacctgctttgccaggatgatatataagcttccgaaccacagtgtggggtgagcagttcctctgtgattctccccatgtacgcgtttgtgataaatgtgtacgccttttctctaattaatcagcctttcttgagttgatttttaagtgaaccttcatagggccaagcccttggcccctacaagagcaaatatggcaaaatattagcaattgttgtatctgggggatattgatagatatttatcacacttttctgcatgtttatgcatattcaagtttaaaagttgggaaagctctacctcaaaactcacttgtgcaggaagccttcctgattcactctacctgatggcctgcgttgttcctcgggacccctgcctgcagtccctattctgctcatttctgctgctgtgtctttcttcacccacgagcctgggcatcgaggccttgcacagtggcgtgtgcggggagggcctagggcctggagactgaggcgcagggctgagttctcatccactcactcgctcagcagacacaggaggagtgtgtgacctgcctgtcgctgtgctaggtgctgggactccctcaaggagtgtacactcaagagaggggggaaaacaagcagacaagcaattgcgatgccaccaaaggcacagctctcctgagtggaaagggactcctgggcctcggctgtgtaagcagtgcagggtgtgcccaggaagtgcctgcccctgttctctgcataaccgctactgctcattaaccagcgaggccttggtttctgcatttataaaatggtgttcagacaccagctcagcccactccacagggcttctctgagactcgggcaggagacaatatgtgaaaacattcagtaaactatacaaatcctgtgcagtgatcaggggttgtaattcttatgagacacaatcaggtggctaaaaagttcacctggaggccgggagcggtggctcacgactataatcccagcactttgggaggccaaggcaggcagatcacttgaggccaggaatttgagaccagcctggccaatatggtgaaaccccatctctactaaaaatacaaaaattagccaggtgtggttgcagatgcctgtaatcccagctactcaggaggctgaggcatgagaattgcttgaacccgggaggtggaggctgcagtgagccaagatggtgccactgcactccagcctaggcgacagaacaagactctgtcaaaaaaaaaaaaaaaaacccacctggaaagaggtcttgaaggctctatagagaggagacagatgaccaaatgcaatgatgacacaaaacaagaagaaaagaaatgaaagccagctaggaacatgggctgggccctgcttgttaagacccctatccatcttggggtccttagtaagaatctttgggctgcgtttccctcttttgtctgggagccggggtggggacagagttgctgctgtccattgacacatacatgccttccgttccctctccccatattccctccgtggagtctggggcctggggtccagtaccatccccactctcacccccactcaccacctccactgcttttgacctcagatgcatgctgggtggcctggctgcacccccactccgcctctacttgatcaccagctcaggtggagcaggctgggcttggggagacagtgcagccttcagcagataaaacctgaattcagttcctacgcccttcccctcccgtgtatgctgcctttgtccaagtcaccttcatggccccaagcctcagtttccccaatctataagggaataataaaggtacctatttcaagttactgtgaaaatcaaatgagattatgtctttgtaaatgttttatttttataaactaacaataagctgattcacctagatcagtggctaccattgtcgcttagtacagattcttacccttgggtcctagggaaaattcagggatttatgaacttgggtggggaaaaaagtcatctttatttccactaacctttaactgaaatgtggtatttctttagttatgaatgagggtcatagaccacagtaatatcagtagccccatggctttatctccagcagaaaccacagatttttcacaaaatgctttaaagttgttattcttgaattatctggtatgctcatcactactatgaaattgtggcatttattagacttgctactaggttttattatttcacatgttgatagggaagcacacatattattatatcataaatcattttttctttcttttttttttttttgatagctgcatttcaatagagcttgtttcctttgtaccccagtgaatttacttttatgcatttagaagcatttttctaggaacgtgtccacaggcttcacagactcccaaagggggcacaaaaataaaggatcccctggcttggtgcaagcttgaccccaactttgttcctggccttccccagccctggcttctggtcaccgtgttgggagagctgagcctccctgtttcaagagaaggcccaggtggtgaggcctcaggtttacagagcagagtggatgatggggaagccctcgcacgttctgtctctgccttttggtgtcactcacccacgcccgttatcttccattctctgatcttctctttcctctttcctttctccttcattaccccttccacccccacactctcagagccttcctttcagcctatttttgaacatccctgaggataatgtcttttctgtggctcctgggaggcgccactaccagctgtggctcgttagctgtgctggaaaaactctcgcgttgtgcctcaagggcaagaggagtctctggttccacttggcactcagagggggaccagggatgtctcaatggtgggaacaatggggagtgtgaccttggagctggaagcagggctctgaccccctgcaggagggatgagagtgccctcacctctagtgagaactgaggccctgcgccggccccagccaaacagtgagggcgtgcagaccttgcccaggaaggccaatttctcagtgcaaagggagccatggccagggaacccggcccgggtcctccacctctgaagctgagctaggcatctgcaggccagggtgaggggctgccctgtgtgacccgccggacccaggcatagagcagcacctgagtcaggctgtcccagagcactggcagcttcactgcaggggcaggctggctctgctgacgccagacgctcagtctgggcagagacttctcagtgggggcagagagtaggtgcttctctggctaatctgcctcccagctctgtgtttgataaggcccaagtccaactttacagattgcaaattgaccttatttctctttggcatcacagaaaaacaacctataatccaccaagccagatatgagcgggcctgacctgtggatcctctgcccacctgacagacatctgctcatttgtcgggaacccctcaagagacaactcctccctgcagccggcccctcacttccccccacccatggagcactgatcccagccaccagggcctgacacaagggcccatcaccatggcatctagcaaacacgtttctcacgctttgggttgtatttatctcttccccacctagctatgaattctgcaagggcgagaggaatgtgggttgaatctgctgcacatggtagcacttgataagcggttcctgaatgaatgagtgaatggcagccagtccttcccattctgaggcagaggtgcagccaggagagggcgtgtacacaggtctgactgaccacagtgggaggggactgaccctcatcccttggtcgcagctggactttccttctaggcccgatctccctggcgccccaccctgcacccatctgcctgggcccactctcctgggcatgttatcagggatgcacagactgctccatgttcgaggggactgaggcacatccatcaccctcgtgccctgggtgctgctgcatccccagagcctgactctgtgccttggacttagtagatgctcgaatcacagttcgcaaacccatgcaagagtctctgatttgggtttcgctttccttccccctgcctgtgtccactctataaaggcagaaaggaacctgctggagctgggtcctccccgagaggcttgcagttccagaacaggcaaaaacaatggcttcccacaggtttacaaaacaaggagcaggctatagccccgaggaagctgcaggaccctcatcggttccaactcctgtggaactgatgaggactaaaggggccttcctgtggccatctgggtcccggaggtgggcggctttctaggctccccagcctgccacaccccttgaggccaccccacccagcttcaagcctcagccctaacttccaaaggtgcagctgtgccagggtgcgggtggggaagacactgtctcctggggagacctccatcttacctctgaggtcagcctctgctcaggtgcagcgtcacagcagggggcctgcgttctgcttcccagtctgggagaagagagtgtctggatattttcaggaaaaaaaaagaaagttgagcagccacagcagggcagggcagtctacatcctcaagtctccctcagcttctctgctgctgccggctggcctcaaattttgcctctctttggttctctgagaagttttaccaagagaagagacaggaggagagatccagcctggactattgtttgtggggtgtgtaggtgtgtgtgtgtgtgtgtgtgtgtgtgtgtgtgtgtgtgtgtgtatgcgtgtatgtatcccgcgaggctggagccacagcttccctgatgaaccatggaggcgggccagctcctgagctgcggttgccctggagacccacctaagcctctttgcctggagcagcattatctgtagagggagtggctgatctgacacaaaagcctgaggcgacccaggcccaggcagtgagggagcacttgtgtccagatggcattctgtccgcttcctcctccagccggtgctcagtgtggcacaaactgggcaagaccattctcacccaaccctctgctgagccctaggtgtacctgctgttggcaaatgtttccagctgcctggtgggtggctcctggatggagatcccctctttctatcagctccctcctacagggaaggggtgattctgggtgctgaggacagggacctgtgaagatacatctccgcctttgccccaccacatcccttgcctgtcttcctctctgcttatctaaattatttccttccctcaaggcaagctcaagagcagacagttctgactttcagaaggaggggctgtccagggagaagaggaacatggaacagaaagcattgacgttgaggtatttgagataacatttggggatagcagaagcatcctgttgctgttctgcagcatcccacactcatgtctgggcctccttcctgtctctgctctctggtcacgctgtcacttgtagactgttctgcctagaagccatgtgtgggccagcttgcacctaacagacattaggtagcactaaaacagatgcacactgccctgtgaggggcatgggaatactgtaatgggcatgaa

SEQ ID NO: 1505 - DNA, 16396 bp, Homo sapiens; identical to SEQ ID NO: 1504

SEQ ID NO: 1506 - DNA, 26811 bp, Homo sapiens
caggaactaatagaaatttaatgttgttttaagataatacttaaatattaagaaagctaaaatttaaaatgtgttgactaggtttttctacacaattatatttacataatgactaaggtaaaacctttccacaaatagttgcccaggaggaagaaaaagcaacctacaacagtctctggggcttgcactgccttctcaggccagctataccctagctgagcaaagaactgaagaagcaagtgtccactccccacccctctcccctgccccccttttgttacttgaagtgtttctgagtaacaaatgcaaaactaggtttgaatataaaagctagacgaccatgccaattcaggattgtgtttcatctgaggagacctggcatagaaaaaacaagaattctctctcatttacaaggatactgtgatgaaagtcaaagatcacacataaatttatgatctctgagcaaaggcacagctagcataaactcatctgtaaaatgaggggttttgacttggccatctgtcaaggtccattcagcctgtcaagctagcgtcaaagttcagatcttccacgatgaaagaacttgccctctgctaaggtggatgcagaaagaaaagtcccattatattgtgggaccaaccttctgatataaaaaactatgttgggattaaagtagatcaataaagtataaatatttatcatagttgtagggtaaatattcaaaagtttgaaatttatgtatactgtaaaactggcaaactggtcttaaacacataaagcaaagattttcccatggggagagaaaatttgagagtaagcccagtgaattacttaagtcctgagcgtccataatctgcatccatgatgcctctctttttttccaggtcacttggacaagaatatttcttgtcttatgttggttctgaaacaccttttttaaaaaaagcatcaagaaattatgattcaggggtttgaaaccccaatgttacaggcagcgcctcatttctacggaatataaaacattttgtttcttccacttctaacagttcatcaagagaagccactactaaatcgtgttcctgcagcatttctgggtagcgggacactgctcgctcaatcctcgacgaacgccgtacaggagtgataaatttcatgtcttgcacttccggcatcccatttattctgagagacagcaagagatgcattaaaaaccttatcatttaaaaaaattatctttattattttttgtttcttattcaataataaaacagggaagacattttaacatagggtgatacaagagatatgtctagagcagctttcatcttcagatggctttttctaggagttcgagaccagcctgggcaacatagcaacacactatctttaccaaaaaatataaaaattagctgggcatggtggcacacacctgtaatcccagctactcaggagggtgaagtgggaggactgcttgagcccagaaggtcaaggctgcagtgagctatgattatgccattgtactccagtctgggcaacatggcaagaccccagtctcaaaaaaaaggcttttccctgatttccagaatgtactgggtggtgtccatctgttcttggatggtgtaagcataaggatttattgaatgaagtatgaagtgtggtttttatttgaagtcaaatatttggcagttggtgttcatttattctataaactttcaaaacagatgacaagttttaaggaaatggggcctaataccaaatttggttgaattaatgaattccaagattctttctagctttttctttttaaagacagggtctcactctgttgcccaggctagagtccagtggtgcaatcacagctcactacagcctcaacctcctaggatcaaggcatctgtccacctcagcctttcaagctggtgggagcacaaacgtatgccagcatgcctggctaattttttatttttcatagagttggggtctccctatgctgcccaggccactcttgaactcctaggctcaagtaatcctcctgcctcggcctaccaaagtgacaggattacaggcatgagccaccatgtgcccagccttttcattttttttttgagatggagtttcactcttgttgcccaggctggagtgcaatggtgcaatcttggcagacttgcctgctagttttccttaggctaatgtaattagtggttttgtgaattctagagccattaagaggtagtttttggattaactgttttcatctacttatgagctgactgtagttcatccacttatgaactgaactgttttcatcctcttatgagctgactgtagtgggaaaatggtgtgtgtcagagagtttaggattggaagagattcggctgtgctttccaggtaactaaaacaaagaactgttgtcttggtgcccttgtttggaattctttccagatcatgatcagagaagagtggtgctacactcacattttagaaaatgacactgacgccctgacatagctccttaaattactatggattctgccttaaatttatatttgttaaaaaataaaacgtttctgactttatgagcagtctctgactagtacatactccactgctctccgttcttagaggggtattcactgtcccttttctcccacagctacagagtttgctcccgcttgggactttgtgccccatcttatcaccccaaccatacccagctgtgtcaggacttgcaggaaaggcagataggatctgcaagtgcaggacaaatgagagtgaaaaggtaggcgagaccataggacgggggtgaatgcattctaatacccctcctgactctggcagcaccttcctcactgcaggtcaggtctcagttactctagatctgtgaaggaaaaatcgagacttggactagaattaagtctgtgaacacaaagtctgctttagagtttgcttacctagggattggaccaatctgtaatttgataccaggataattatgctgttctgccttggctattcggggtgtcgccgtgacttgttccctctcttttggagaaagacaagacttcacagattccatcttcttggccagctcttccactgatgttatactagtttcagcaactaaagagtcagaagtaatccctgtgtatgtaagatcatgaaggaaagtaagatttaccaatttaatacttcaactagaagtcaataacatgaaaaatacatacatacaatgatttcccagtgatcttcatgggctccacatactgaatagtgattgatttgaagtgtgacttataacttgttttttcacgttaagctctgtagcagtgtcttgctacatcaggctaccctcgtagccagcccccgagactgctgtacgtagattcttgacaccctttcaagactctgaacatatctccagtctcctattcactctcaagagagctctcttagggactaatcactggccttctacccttacaccacaccttggatcaattttcttgactcactaaggttaactcacacaacctcccaatcccattcctccccaggatgaccacatggttactgccttggacagtgggcaaaaactgtcttgcattaatagttttcatggtagcccaaacacaatcaccaaaatgaaaggaaggaaatcagactgtgccaggcacactgtggctagaggctgacaccctaagtgaggtcaatagggtgcaacaaaggcatggattcctgtcttctctttttattccttttaaaacactaccatgttttaaccaaataactgaattgtagcctcattctcaaagaatctactattatctattttatgtccttcttaccacatgtagtgggttacttagctacatgacttgattgttccccagttaaatctactctttttttttgagatggagtttcgctcttgttgtccaggctggagtgcagtggcgtgatcttcattcactccaaattccactttctgggttcaaacgattctcctgcctcagcctcctgagtatctgggattacaagcacgcaccaccacaactggctaatttttcttttctgtttttttttttttttttttttttttttaaagacaagacagggtttcaccacgttggtcaggctggtctcaaactcctgacctcaggtgatccacctgccttggcctcccaaagtgccgggattacaggcgtgagctaccgtatgcagcctaaatctactattaaaggaaaaagatttgtcaccttttaagataacaagaagaatccaatttattttctaaagatagcttgttttttctttccattcatataacaagtatcgtaagcaattataatgtcactcgtgtttggcacaatatatgtctcatagaagagtcttctaaaggttatgaccactgacagtgatggtcatccaattgaagagattcctgagatagctatttttaaagcgtaacacaaatttagatgagtatgttggtgggtttattatgattaaacatgtaacttaaggcatttctcctttctgcctcagtctcttccagcaaagagctgtttgtcttctgccatctaggattccaaggaagtgggacactccagtctaggctgttttggtggaaacaacctttgttcagtattgagtagtgcatttacttgtaataatacaaataagtcagctgatgacaatggctgaaagggccaggtcatggaaaccaagaagtgagaagcatttcaggggatgattcttttcttctttttcctatatgtcctggatgatttttactggtacagctagagaagatgaatttaaattcaaaaataatagtaccttctgtggttctgtttgagtcttgcaagatattaagaacaactttccgcaactcttgtattggctggaaggaaggaagaaaacatacaaaatcttaaaaacattcatgcaaaaaatttgctaaggaactttaacttcaaatacatgttttataataaaagtttccttttaaaatctcgtctaactataaatcttttgtctagcttgacagttttatagcttcatgagaaaagtaaaggaacagagaaaattctgattaagtgttggcacactcgacttaatgaacagatgtatttaaagttgtccataatgtaatttgtctacatcaaattctattttcctattgatttgtataatactgtcaaatatgtattcctacataaaaattctggcccaatgatgtaaagctagccacacagaaaatgcattttatatatagatatagatatattttcttgagacagagtcttactctgtcccaggctggagtgcagtggcgcgatctcggctcattgcaagctctgcctcctgggttcatgccattctcctgcctcagcctcccaagtagctgggactacaggcgcccaccaccacgcccagctaattttttgtatttttagtagagatggggttttaccgtgttagccaggatggtctcgatctcctgacatcgtgatccacccgcctcggcctcccaaactgctgggattacacgagtgagccactgtacctggccccaaacacaatgttttttgagatggagtctctgtcacccaagctggagtgcaatggtgcggtatcggctcaccacaaactccacttccagggttcaagtgattctcctgcctcagcctcccgaagagctgggattacaggcatgcgccaccccatctggctaatttttctatttttagtagagacggggtttcgctacgttggccaggctggtctcaaactcctgatctcaagtgatccgcctgcctcagcctcccaaagtgctgagattacaggggtaagccactgtgcctggcccagatacaatctttgtaggcattttgagtaattttctccagcttttcctgtctttcttcttttatttgttaacatacttagaaaaaaaaaccttcatggaaaagtaattttctgataaaattatctgagataggctttatttttcaagtatgtaaaccatgccatgaagcagaagctgcactttcccacaagaaaattatagttggaggtttgtcttccttacctggaactctgtatcaaatagatataaactgacaataaagcataaaagcaaagctttccgtacattttttcaaaatccaaaatagaattatgatttcagctaaatgaatgggaataaatgtatagaatatattacaaagagtgaattctatacaacattcatcaagcatattttatatttgtatagccttctggttaatgatggtggattaaatatacgtttatttctaatctctcttgaaaatcgactgaaaggataataaagggattaagaagaggcaataaccacaaaacataggagagaagaaatgacaataaggttttggaagctgcagtgcagaaggaagagaggtaaacaatttgatctacttgagagagttgaatcccaagctggcagtgtggctaagaaacaacctgacagaaaggctaaggaatgggtggtagggcccaaattaggaggactctttagcatctgttcaaaaagcagtcagacctccaaatccatcctgcacccctaaactctatgcagcctagtaactgtgtctgactcccttcatcctaacagaaaactgggaatgtattctgcaagtctctgagggatatcatgcaagattaggatagggtgctttctgagaaaaggagataagcaaaagtttctatgttgagggttgagactccctgctctcttctctcccacagcactggcagcctggtgtctagctcccaggaaggagattggaacagatttctccagataacttgaccagcttaagaggaaagacctaaagatactgatattgagggttttctaactagtcaactcagccagatcaccctgtgttgaagccccatccatgtgtctcgggctttaaataagctttttcagacccaccttttatatgtgcaaacagcccagtttcaccagcatctgtgtaaagcctttaaagaataatagagaacaaaacaaaaagaacaaacaaacaataacaagagagaaagaaatgaaaaacattggagaagaaatagacaatgtaggaagaagaaaactaatatgggttctaaaaacaagggatccacccaacttaagaaggatgtaaagggaatctaaaggtgatggtaaagagatcccagaaagacagctggtgaagacggcagtaaaaagtaacttgttcagtctggaataagccagaagggtctaggagaaagctctttatctaagaaaaaggaatcaatagaatatctgatgttttcaaagtattgaggaacttagacaattagcgaagagtttgtgaattaattatataataaatactcagaaaactaagcaaaggcaaaacaagacaataactccaggaaaagtagaaagttgtgcttgaaaggcaaagtaatcatagtatatattgcatggctcaacatattcatgtatttttttttttttttgagacagtcttgcactgttgcccaggctggagtgcagtggcccgatctcggctcactgcaagctctgcctcccaggttcatgccattctcctgcctcagcctcccgagtagctgggactacaggtgcccgccaccacgcccggctaacttttttgtattttttagtagagatggggtttcaccatgttagccaaaatggtctcgatctcctgaccttgtgatccacctgcctcggcctccccaagtgctgggattacaggcgtgaaacaccgtgcccagcccatatatttcttatatattcataacaatgtgaatgctaaatagtgaccagaatttccatgactctaatgaaagtataaggaatggcaaaggtctataaggatggtaaataggggtgtgtatttgtgtgtgctggggatctgtgtatgtatgtgtgaaagagggctaaatcttcactctgcatagctggaagtccataaatcatatctaaaactgaaaaatcaagaaacagaaacacgttttctgaaactatagaggttaatataaaaataaatcagtttgctctaggaaggggaaaatgggagggaaggaaggcagaggtcttactgaacgaaacttatcaaactacttgactgcttaaactatgtgcatgtacaattctgattttgaaccattatggaaaaaggtatcacacagaatacagaacatgacatggaaaatgacattttaaggaaaagcattataaaactatttgatgcagtttttgtaaataataattatatagtttttttttctaaattttagaattaaaagttatttcatgcaatggctctgaattattgatttaaggatgctgacgtattgggtttaatatatttttaagttctttatggtaaggtatgactttataagtgttggatattgatgttgcaaacttctaaccatcatattacaaacaacaacagagaactcacatgaaagagaattttaagaagttacccacccaagacagatactcactgttgccccatttttaatggcctcttcatatagcccaataacatcaaaggtgcctttacttgccaacaactttgctttgcagatccagaatttagcaaatttttcagcttcaggaatgctggacaatatgttaagtatttcattagaaggtacaccctgaaataaaccaaaatatccagaggtaattattaccatttcactgttagtctcacatctcctaatatttattacagcaggtatgcagaaattggtttgatcactaatatttttgaacttttaaaaaaatttcaattttactgaggtacaatgtacatgtaataaaatgcacctgttttaattatccattttaatgatttgagattaataataattattattttttttttgagatggagtcttgctctgtcgtccaggctggagtgcaatggcgcgatctcggttcactgcaacctccacctcccaggttcaagcaagtctcctgcctcagcctccccagtagctgggactacaggcacatgccaccacatgctcggctaattttttgtatttttagtagagatggggtttcaccgtgttagccaggatggtcttgatctcctgacctcgtgatccgcccacctcagcctcttaacgtgctgggattacaggcatgagccaccatgcctggcttaatttttctttttttttttgagacaaggtcttactctgttgcccaggctggagtgcagtggtacgatcacaactcgctgcaacctctacctcctgggatcaagcaatcctcccaccttagcctctcgagtagctgagaccacaggcatgagccactgagcctggcttcctcatcattaaattttaagagttatatgagaccaaatagaaaatgtttatcatagctgaaggtaagaaatatgttcatttttacatggtacaaaaacaaaacaaatcctagagtaaacatttacatattcataatattccatatttataataacgagaacactgagtagtgatgagaatttccataggactaatagcagtgtaaagaatgacacaggcatgcgaaggtcataggggtgtatatgtgtaagtgtcagggatttatgcaggtgtttatgaaagagggttaaatcccacaaaaagataatttgaaatggattcactggtttggttcccttctggcttgtgccgtaagcaggacagtgacatggacccaacgaatggggagcactaccatgcccagaaatccaggtactggcacactcagccaagcagcaccttctactgctagaaatgggggagacgcaaaggtaagttcacaattgagaatcactaacatttgagaaaaccaacactacatgaaagaggcataaaactcaacaaacaagaatgaacactggagcaaagaggaatacttttaagagtatcacagtcaatatcttcagagtgataagagagagtattgctatcctaaaactagaatgggctgttatgaaaaataaccaacagaaaggcagaacaactgcatggacagcgctgaagaatacatctgtgagctgaaaattcagctgtgaaatcctcctagaaaccagtgtaataaaacaatgaagtgaacagtatgaaaacaacatttagagttctgaaggatatatccattactcaataactccaatatccatctaagagagtttctagaaggaaaaaagttcaacacacaaagtggttgtagaagaagaatttcaagaaatgaacaaagaaacagttgttcaggttgaaaaggctctcagatagttaagcaggatgaatgggagaaaaaaatataatagaaaaccaaagataaaaagaaaatcgtacaagcttccagagagggggaagaaaaggattacctataaaggaatgagaatcagactgacgtgagacattaacaaatcaacaactccagatgcaagaaagaaaatgaagcagtcacttaaatttttccagggaaaacaagctgaaattaagaaatttcccccagccaaactatgattccagcatgaaggcaaataacaagtttcacaagaatacagactcaaaaggtttgccattcaaaaatcataaagtcactagtgagtaaactttagaattcacatgaaagacttgaaataaaagtaactgcaggccaggtgcagtgggtggttcacacctgtaatcccagcactttgggaagctgaggcagaggactgcttgaggctaggagtttgagaccagcctgggcaacacagtgagaccctgtgtctacaaaaaaatgtaaactataatgggtgtagtggtgtgtacctgtagtcctagctactcaggaggctgaggtggaggatcacttgggtccacccaggaggtttaaagttgcagtgagctatgatggcatcactgcactccaatctaggcaaaagagtgaaaccctgtctcttaaaaaaaaaaaaaaaatgaaaaaaggaactgcaagaagaatatgatatatattctgcaaatcatgtttgagcttacatctatcactttattttcatttcagtgtattattttatgaaataaaactagattaaacacagaaatgaggaaaaaataattcatgtaagctgaattacaaaataaaatagcaggcataagtttaaacatacaagtaatcataataaatgtgtacgaactaaatttgctttttaaaagcagagagtttcaaatttgtttaaaacatttaactgtgtgcatttatatgagacatacctaaaataagtcagcccatgaaggcttaaagtaaagggatggaaaaagagctaccagagctaccagacatattctaacaacaaaaagcaggtgtggcaagattaatcagacaaaagaaatcaaagcaagtcatgaatctttctgtacctaacaacataactttaaaaaatagaaagtaaaaattgacagacatatgaagagaaattgtcaatgattaatcacagtgccagtgacagactttggcatatttctttcagaaagcaatagatcaaataaacaaataggatatacattattttcaaacacttttggaacatttaccaagaatgatcagatattaaggccacaaagaaaatttcaacaaaatccatcaagtagagtacacataggccacattcaccaactacaatgcaatataattagaaattaacagcagaaaaaaaaaatctacacatctggaaattaaaagatacttttctaagatattttttgggttaaagaactcaaaatgggaatctcaagctatttagaaatgaacaatgacaagatatgtcagttatgaagcttttgtctattggccccaaaccccatcctctgctttgtgatgctggggataaaactctgtaaaactttctgctgggcagcagctccctgctcagctctgccagcagggggcacgagagggaggctgcagggatggagaaggaagacacttgcttcttcctatttgctttcatcaccccagcaacggtccctcaccctggcagtaacagttggttctagcatctttttttccccctcagagcccacctccctgtgcagcttcagagcagaagcaccaaatggatagcatcttttcctcaaaatctgagccccagccctgcagggcctctcctccatcatctgctgggtagtatgccttccttacagttggagtcccatttctaccagggtttgtctctcctgcttcttggttctgataccctaacctctctttgttctcctagacccagtgggtacaagctgcttcctacagttatcacattacctcaggttcctgtgtgctgtcagccctgtgtgtagcacccacactccttctgatcccttcagcatcttgtgcacacaggcttaccgcgtgctttcacagccagcatctgtgctccctcgtatgtgcccagagagtgagaagtgcctgacaattcttgtccgcccgaggcagccatgaataaatgaccatggaagctttaacaatgtagctcccttgcctctgatcaggatgactctgagagatgtgacctacactgtctccagagctcccctgtggggctgtgccagagtcaccgtccatggattcgcttttctgatcctacaacttcactcccctcccagttttccctggagtgtcttcctaataaactactttcacatggattctcctcttaggctccacctctagagaacccacataagatactgtgtaaccaattacattctttctgtggtttgtttttcagacttgatcctgactgataaagagtattacttagtcaaatctgagggatatgaccaaagtaaaattcagaggcaaatctgctatagcactgaacatatttataaaaaaaaaaaaaagaaagactcacttttaaatgatctaaggtttcaattaaaaagctaggaaaagagcaataaatataaaaatagatgcagacattgatgcaagagaaaaaataatcaataaaacctgaggtcttttaaaaagattaatgagaaaaaatctttggcaataaaacctgagatcttttaaaaagattgagaaaaaatccctttaaaaagtcacaaaattactaaagttgactcaagatatatgaactctagaacaatgaccccataacaaattgagaggatatatacaaaattatcctccaaagaaacacggtccagatgatttttatgggcaagtttttatcaaaccttcaaaaaataaaaataattctcatgtcatacaaactattttcagtttatagggcaaaaaggaaaatactcaactcatctgcctaagtcagcataacattggtactaggaaaacacaagaaaagacaaccaaagtacacaaaaatgtgaataaaagaattgcaactcacaaaaatataatacttcatttctcgacatacctatactgtatggacatgcatgaaaacagaatgaatgactggcaatggtggtcacctccagagagaagtttgggatgcctaagtatgtatgtttgtagagggagagggctgatcatttatctgcattacttgaaatgatttcaataataaaaaggtactcatttttaaataatacaacaacaaaaaaagaggataagaaaaagaactcaagttcaattccacaaggagaaatagttaatatttaactggatgttgtgaaaatgttgcctggagtagacttaaactgaacttttccttttttttgctgatgttcaacattaccagccaaaggactgaatgagttttgctctaggcaaggatcttagaagtttattccatcattttttattaatatatttttccttcaggaaaaatttctcctaaggatcatactctttgcctaccatctattttatccttatctgcagaatccaagataaaatttaaatactatttgtagctacccagagtattcagaatactccaactttacacagaaacttgccttctgacctcagtttcaatgttaaatgtgtactcttcagaacttgatacccaaagaaagcaaagttccttttggagccagtttgtttggattagttttccaacttctttgtgcctcagttttgtttgtaaagtggtcatagtaacagtggttatgataattatgtgagataatcttagctaagtgcttataaaagcacagatacacaaaagacactgtttatgggcatgtcattattattattactctgtatttacaagagtagctaaatttctacttagatgaaggctatctctcctatattatatttaggaatatgtttaaaaattataagactttgggccaaagctggaggagcttatcttcttcacttaccccttcgatgaggttcagacattctgtcagagtgttgttaattttactggacagttcgagttgtgctttcttttcttcctcttctttttcaatgctcttccagaatgaaatattcatttcctttattacttttctttttgttttaagttccataggaggccgtttataggtttttcccttagatttctgccattcttctagttgtttcctgaaattcaattaaagggagagtggttttatttatttttaaacatagtcaagctgctaaagtatatgatatgtatagatagagtataattaaatactttcaactacagacaaaatcaggagaatggaattaaaaaacaatttacaaatgggtaatggcagcattgggttgcgcccacccacgagaaggcagacaccaagattctaagatcacacgtggccagcacttcagacttcaaatagaattcgtgattatgcattatttttctcggaaagttttcacttcactatatgctacttgacacttgctttcctaagacatccctctatttttgagatgactaactcagcaattcatttctctcacgcataagctgtcactcaacccaaacccaccaagcctgcattctaccctcaataaggtcttggtgtgtaaactgacccacttcacctagttccttagccctctcttgaccagacatgactctttcataagctagacctataaagtcagggctcttaagtagctgatctctgatagtgccaagtgtcccccactgttcacattttccactccagcttctaacaggtgatagactgctttttgggggtaggggcaccaagacatatagacctcatgtttggatgtagacactccagtttctttaaattacaactacatattaataatgacttccaagtgtacatttcagtccagatctctccctggatccccaaactttgtaaaacccaccgcctagttgatatcttttgatgtctgacaggcatttcaaatttaatactgtcacaaacaaagttattgattttcatctctgcatctgttacaaatttttcttactttggtaaatagcaccccaggctgtgtcactgccaagaactttccacagctcttggaataaaattcaaaatattttccaaggcagaaaggcacagtgtaatctggctcctgcctacctctccaacctcgtatcacactagtctccctgtcactcaccccctccaggagctcaggtatccttaaagtttcttttctttttttttttttttttttttgagacagttttgctctgttgcccaggctggagtgaagtggcatgatctcaggtcactgcaacctccgcctcctgggttcaagtgattcttgtgcctcagcctcccaagtagctgcaattacaggcgcgtgccaccacacccggctaatttttgtatttttagtagagatggggtttcacaatgttggctaaaccggtctcaaactcctgacctcaagtgatctgaccacttcagcctcccaaggtgctgggattacaggcgtgaaccattgtaccctgcctccttgaagtttcttgatccagactcattcctgccttaaggtcttgcatcttcagtcctcccctcaaatgacacctccatgaagacgcaattacctgtaattaccgtgtcttatttagtcaatgtgttggttttctgtctcctccactagagtgtaagctctatgaaggcagaaaccttggcagtccagttcccagcacagtgcctagcacacataggtatttaataacacacagtaaaattcaccttttagtgtgcaattctgagttttgacaaatgcatcaagtcatttaagtctgactattatcaagctataagatggttgcaacactatcactaattccctcatgctccttggtagtcagtctcacccctaacgcccccctcctggcaatcactgatccgttttttgtctttatagttttggtttttccagaatgccaataactaagttttgaatgaatgaatgctattaactctcatttctgactccagagcaacatccatgcaatatttattatttcagccccaaatactgccccctcaccttcactccaaccacctacttgatgatacaaggtgagacatttggcatgtgcttcctccatgttcctagcattttccctatctccttagccttccttctaatcataaacgaagagtgaactttccctttctaaaggcaacttactcctaggacctcgatgccataattttgtttctctagtactttctatatatacaccaaacaattagctccagaaaggtaaagactcactgtgtgctcatcactgtgtctcctagcgcctggcacactgcaggtgctgaagaaacacctacagaatgagtgaatgaatctctccctctctagactccttctcttttgtaatcaaacatgttcaacctgcaacacagtcttatgaccaatcctctgttgtctgacctaggctgagctccagggctgggaccctgacttccttattcaccacctcaaggtctctgcactcacttctctttctgctcaggattgtttttcttcttgtcaccagtcttttctcagacttaggtctcagctcagacattgctgttgaaagtacttctactgatccttttatctaaagcagccattccagccctactctcttgatcatagcaccctgaattaagttgtttacttactgtctcttcaggagggcaaggagcttggtggtggtgttcagggctgtaccaagctgtaccttgcttcaccctgctacactttttagcaaccatctaattttacatgctcccttcactcgtcagaaatttccttattttctacttcaagcaggtatacatatgtgcttctcctgggaggctcacccacttcatgagactacatttggtcctgggtagaaagtgtacaaaatccactggctcagttttaatcaatgtatgttaatattaaccaacctgagatcttgatttccacgcctggctaattttgtatttttagtaaaaacagggtttctccatgttggtcaggctggtctcgaactcccgacctcaggtgatccgctcacctcggcctcccaaagtgctgggactacaggcatgagccagcgtgcccggcctaagatcttgatttctaccatctgaactctgtatttgaactgactgctcctgcttgagcttactggccaaaacttggcccactcagactcacggaagtttctggttcttccctggtaacttttctgaacttaaccactggtttgcttgacaagagattaccatcttctcacttcctagctatgtgaactcacttatctgctctattgctgttcagtctagcacggcacttattgaacgagtgtctacatctgcaccccctacttcttactcatccattctgtttcaatttcttaaaaagaaaaaaaaaaagctattgtaaacatacgattacagaaaatgatttataacatgtgtatgtaccacctagccctgtcaagtcttaatatttgttatatttgcttcaaatcttttttcagactgtagttaaaaattacttaggagccattatttatggcctatttcctgacctagtcttcttgatggtcaatttgcctaatcatcttaagttgcaaaagcttagaattaaagcaaagtaccttcgatcctctgctgttgccttctttttaatatttgggtttgtttgggtcccatttacggttgtgacatcagcttgagttttgggagctgtcttgttcagaaaatggttctggggaacagcctttttcaacttggagtccaaagtctgtgctttttgctgaaagccattattgttatgtttattaccactggttccatttggtcttatgctaggggtgcttggaatggctgaattaaatctgccaactgtcaaattaggcctctggcttatggcttttgacttttgcagtacacatgatgtctgaggtatacaaacttggctggacttctgatcttgcttgatgtttggatgtctgttgttatattcaccctgaagcaaactggggtatgttctgggtttggtgtgcttcactctctgttcagtaacagggtatgaccgtatcttagtttcatttggtctttcatattgactcctattaacctttatatctttgatgttcttgactactggtttctttgatgactgaactttactaagggtccgaataaagtgagagggaaccgtccttgagggttttactcctggtcttgcaagatctgctcctctagagagttgctgtgattttactgggaaagtcctgctttgtgtttctccaacaaattgtttattaaccctatctttcagaacagcactattaactgaacttttgcccaaggcttgtttaggaactaaactgttcttggtttgattataagagtcagtctttggcttacttctggtatataatttaggatctggcttcctctcaggttctgttaagatatcgagcaagttctctttgtttgtttcttttagaaagttatccaaagattcgttttcaacatggatattattcataaagtctatacatttaccatttccttgatctgttaactgctgctttgtagttttcaattgctctatattaagtgaccccacaggttttcttgacagttctcctgttgtggacgatccagcttcacactgttgaaaactcttgctagaaggcttagagtatgggttagaagaaacacattctgaagtcagccttttgcccagaagttttggtggctccaacttcggcttctgggaccctgcagtattaggtggtctgggctggagtttaatgctgatggaccttttaggtttgacaggcaaaacaacatggttggtaacatcatttttgggtctaatagtctgaaaaaacaaagaaaatacatattaaaaaatccttaacatatcttattgtttttaaaataataactgtgtttaacacatgctaaaaaaaataatcatttttagaatttcatctaagaaagttgaatcctcagaaagtaaagaaagactcactaataggtagtttttgtgttttttttttttttttttttttgagacaggatcttgctctgtcacccagtctggtgtgcagtgatgcaatcttggctcattgcaacctctgcctcctgggttgaagcaattctcccaccccaacctcgcaagtggctggactacaggcgcatgtcactacacctggctacttttttgtatttttagtaaagttggggtttcaccatattggccaggttggtcttgaagtcctgacctccagtgatccacgcaccttggcctcccaaagtgctgggataacaggtatgagccaccacacctgtcctaacaggtagtttttacaacttgagttcctatcagaagtatattagaatcttttagcttgacagaattaagcagagatgcagtgaatatacaaaacttgctctttcaaaaatgaatttgcctcaaacagtagttgttgaatgcctattatatcctaagtgccctccaaagaaccctgaaaaaatacatacataatgaacttatgttagggtacctcccaacaaatctctcctagtactttgtatagccacactatatgttttttaaaccactgcctttgtaaacatcacagtatcactcaagaacctctgtctcatccctggagatcagtgacaaggagataggtggcagatgatgtgaggcctgagatatgctgccacagctctcaataaacatgtaacatcttaatagtcatatttgtaaaatcagccaggacagggttttaaggttagagtctatgttaataataaacaaatgtttagtcatgtgatttaagtttggataagaaaggtaggactcgattacagagaattttgaaaactagggaagggagtttagaattcatatggtaagtaattgggcaagccactatgaattcctgagcatctctcatgaaagcaattactcagaaaggagaatttcacagagatttatggaatatgtttccagggtaagatatgggaatgctagagttaccactctatttttgatttgacaaatattgtgaagaatcactacataaacttggcgagtatgtaaaggatttctaaccagaaccatttggcattgagggcaaagagatgtctactctggatgatagcggtgtgtgtggtgttactaggagtgaaacagcggagttgggagtgggaggcagagagatggatggtatacccacaatggctatatctggattaatctttgagcaccaacatttatatacacctcggatctctccatcattgcttactgaagaggtggagggacgttggcatgaaagcttccaaatgtgtttttttagttgctttcttatatattaaaaacaaattgatataatccacaaaccataaaattcaccattttagtaagtgcacacttctgtggattttagtatagccacactattatacagcaatcaccactgtctaattccagaacatattcatcaccctagaaagaaacttggtttacttgttggcagtcactccccattttctgctccctgcagttcttggcaaccgctagtctactttctgtctctgtatgtctatagatgtgcctattttagatgtgtcatataaatggaatcatgtaatatgtggccttttctgtctggcttctttcacttagcataacgttttcaagatttacccatgttgtagcatgtatcagtacttcattactttttaaaattaacttttttagagcaggtttagattcacagcaaaattaataatagtaaaagtatctattatctaggaaggatgccatatatcccggttttcacaagatagttttgatttatgcctgttggtcaaagagtactgctttttactctcaaagtgtcctggtttggacattaaagcatatggccaacttcctcacatggttgttctgagtgaggtaatgtatataaacatgtctgggtgttagttattgttgtcatgtatcgaaagtgttatataaattgtcaagcattatataactgtaatgatgactattatttacatcgtgcttttagtttctcctaaattctgtaattcccttcctgagttcactttttacttttacaactgtgtaaagcagataaggtaggtatcatcctcatttacgagctgatgtactgaagtcagtattgtcaacttccagagaagcctctgggaagtctgaatgagggccctttccagtagatttttccttaagacttgcatactatactggttcaatctgcataaagtaaaagtgtaacccagtgcttcccaaacgttaaaccattgttcataaattttgccttatatacattttgctatccttcacagtgtctaatgatgtcatgtatacatacaacatatatatgtctacatatgcatatgcatatgactgaaatatgactgaagtgatttggtgaatcattaaaacttattaaaattctcaccagtgagaatttttcacttcaggaagcactattttagttacatttcagaacacagataaaaacttatatgtctatatatgcatatgcatatgactgaaatatgactgaagtgatttggtgaatcattaaaacttattaaaattctcaccagtgagaatttttcacttcaggaagcactgttttagttacatttcagaacacagataaaaactatgttttaaaaaactaaaggtgagatttttattgcagatgaataatctgtgcctctttcagagggctaatttcttccatttaaactttaagttaaggatcctttaccattctatctaatgtagctaaattaaattgattaggaagcatatacttgttaagtggcttggaaggttcaatgcaaatgttctcttttaatgactactgagctatttaacttcatggcagcataccaaagtggttaagatcacaggctctcagctttgtcacttaatagctatacgacctatttaacctttctgtgacttagtttgcttatctgtaaagtggggctactaatagtagcctcataagattgtgaggactcagtgaggtaatgcaagtcagaaaagtatcaggcacacagtaagcattcaataaatgttagctatcaagaggactaaagttcacttgaggcttttcttggttaataaaactaaactacttttcaaaaaatgtcatacttttcaaaaaatgattgtctcttattaaaccaaactgtttttatatctgtaagaaatacctttcaaatacatgttctttaggttgctaacatctttattatttttattactaatcatacttatgaatgcatatttttaaaaagactaatttctacttacagatttagaaggtggttgattctggcaattattcttggattttagataaggcctataaaagacaaattaaaattaatcctcagcacagaaggattctaagctaagcttgggaagtacagtgattaaaaattatgaatagaattttaaataattagaatttctgtaatggcaaaataattcaaaattatatttaataaagtctccttatcatcatttctttagttctgtatcctcccccttggagaccaccaactgctcctactctttttttttttgccttgtgatccttacagagactgtctatacataaatctagcattctcacaatattaatgagatatatgtgtttccttcatatttatatagtcttactcattcacacatcattcctggagcactgcaatgtgccagacaccgaagacacaatgccaaataaaaccattaactgcttctttaaaaaatttccggctgggcgtagtggctcacgcctgtaatcccagcactttgggaggccaaggcaggcggatcatgagatcaggaaatagagaccatcctggctaacacagtgaaaccccatcgctactaaaaatacaaaaaaattagctgggcatggtggcacatgcctgttgtcccagctactcgggaggctgaggcaggaaaatggcgtgaaactgggaggcagagcttgcagtgagccaagattgcgccactgcactccagcctgggcaacagagtgagactccgtctcaaaaaaaaaaaaaaaaaaaaaaaaaatttccttgttttcagtatcttcaaatactatctcttctaactttaagggggtaaagaaatattaaaaaaaaaaaaaccaagacacacatgaaatatagctagtgagacaggaaatgcagaaaaaggattggaaaacagaggtgaatttagaaggaatcaatctgcatggaccaaaaacaattgctagactaacaaggactttgattatgacttgtttgatgtttgtctctcccatctacagcataagccctgggagggcaggaatgtctgtcttgttaagcgccattatctctagcatcagaagtgactgagatgttataggtactaaataaatatttgttgaataagtgaattaggttcatttaatcaaggaaatagaggtgagtaaacacccaagataaaataaagggtgaaagctaactttgtaaaaattaattttcaaataaatacttagcaactcaaatggggaaaaaattaattaatgctaagaaaggacaaataacacgacaaagatggtaagaatctacaaaggataaaaatgaagtggacatgttctgtctaccttaacagtaaatgctaagagaatgacccaagagcagagggtatcactctgctacggaggattgattgtaactggctctcctgccttagcaagaaatgccagaaccatggtcattcaagttcttgaccaaaaactgccttcatgagaatcaacttccccaagaaaaaaaaagcagaaacaggcaaagcttccagcatggtaggtaatactgacccttcttccctccttcctttggagattcacacagtaataatgcataaagctttgccaatggactaagcactgcccaggggtttttgtcatgcctggactgaaatgctctttttgcgttatcatagaatcccagtgcagtctgagtagactctaagcaaaagggacatttttcaaaaaggctttaaattgctagtacaaagaaggcaacaaaacttgcgtaactgtggacagataaactcacttggtgttttggctcttcagttttcccttggctgcaaggtactcctgaagctttctctgccgctcttctgcaacacaggcaagcaaacaaacgacataactttagttcaagattttaaccagttcattaatattctaaaagatgacacttttctctagtgattttgcctttgcaacataatgttataaaatccctagtcctataaatgtgccttcaagctaacatcaacatcaacaatatcatttatatgccaggcctacactaagttctttaaacttactacttttttttttttttttgagacagggtcttcctctgtcactgaggttggagggcagtggcacaaccacggctcactgttgacttgatctcccaggttctagcaatcctcacacctcagtctcctgagtagctgggaatacaggcgtgtaccaccatgctggataattttaaaaaaattttttgtagagacaggatctcactatgttgccaggggtggtctcaaattcctgagctcaagtgaccctcctgctttggcctcccaaagtgctaggattacaggcgtaagtcaaagcactcggcctaaatttacattattgctttcaatccacaaaacaatccaatgagtttttgcaatctgaaattcagagagagtaaatgtcatgcccaaagttacccagctaatatgtggcaattccaggacttgaaaacaggcttttctaaccctggagctcacagccactgttctcagctacaacagtctgttttgaagaatttctgttactggcccacctgagctggtgagccaggcctggtcttacgtcttttgtttttttacagggatgatgatttttacccacaaacccttatatggcttcctttgttggtactaaggataaaatacgcccggtctgctcacggcagacacctatactatggtgactttctacgcaagccatttgtgaggggatgacaagtcaataatttctgccttcaagaactttcaaactagtagtggagataaaatcaacacagcaacaattacagtataaggtaaaatctaagggccataagagacgaaaagaagtatgggagttcagaggtagggcataaatgaggggagtaggtggctagaaaaggttaaaagtaaataatgatgtgaaggaagacaaaaagacgacaggggtgccaaacgactcttaacctcatctgaacggagttgccctgttttgctctctgatgctcatgtatctatccttagagacagcttggcgggcaatgtagagcgtaggggctgacatagggggttggagtcccacctccgtgacttctagcaaattagcaaactttgctgctgctaagcctataaggcggacagaaatgccatctttaaagcttgttatgtaaagtgcctaggacctcgtaggcatcaacaggaataatggatgaaacaaaacaacggtgcgtatcttggagaaagtggcatctgagcaggagtattttgaaaggtaggaaagggctccaagcacatctaagagattagggaacgcagaagccttagccctgggtgcagatttaaccaatcaacttctaaccaccgcaggctgagaggtgtggagtgagagccccgccagaggcaggagacccgggcttcggccagaccccgcctcctggcacagaggaccacgcccggctctgcctggagccaaatgtggatcaaaacagcgcgcagcttcccactgctggtgaaaacccgagcaaggggcctcagtttctttatccggaacgtggtgacaatgacatctctttgcaaggctgctgcagggctttctggaaatacgcccgtgaggtatctgggcctgcgcacagcctcccccgcccaggacccagacgtctacctgggggtcccgtctgcgctcccgggatggaaaacgcccaggggaaacttaggcaggcgagcggacgggcacctcccgcgggacgaactcactcggtggcctcctacttccccggccgtgttccaacgcctgagaataacgggaacagcggtcgtactcaccgacagcggcagcagcggtaggcccgggccccaccatgactcttcagtgacagtttttcttcaaacgccgcgcctgtagccaggaccggcgtgccgcgcgtccacgcgtcctcatt

SEQ ID NO: 1507 - DNA, 81154 bp, Homo sapiens
ttgattcaaagacaaatatgaatgactctacctatttgtaaaaatgtgaacattaaaaacagtacaatgactgggctctcacaaaccgtgcaaattcaatttgaaatgttcatctggtataatattcagctgtcaagaggaagcaactcaaaggacatcacacagtctataaaccagctcgaaggagccttccagactttgccctgccgaaccctctctgggtgataattacacaaatcttcatagatgatatactgtgtgcagaagcgctgatcagaatcgggtctcgcatggtatgcgactgtattgatggtctgagtcacgtcactgtctggcttgggctttctactgaggatctggcccccacctgcagtgacgagcttaataaggttgtcctttggatggtgtttgaaggttccccacaaatagaagtagcatccatcaaacagctttggcaactgaaataatgagaaaacatttgttaaaggcagatcaaaatactgtattcaaaaacactgtatatgaatgaggaaaataaaaatacaagttgaatatcccttacctgaaacatttggaggagaagcatttcagattcataaattttttgggttttggaaaatttgcatatacatgaggtatcttaaggatgaggctcaagcctaaacacaaaattcgtttgtttcttgtacaccttatgcacatagcctgaagtaattttatacaatatcttcagtaattttgtgcatgaaacaaaattttgactgtgttctgaccgtgacctgtcacatgaggtcaggtgtggaattttccacttgtggcatcatgtcaaagctcaaaaagttttggattttggagcattttagatgttggattaggaatgctccatctgtaacaattatgagcagctaagaagctacttaatgaggtgctgggacaagttatatttcaagcatactaactggatcaagaaaaatacttaggcaaataggggcttcctatttacaattttttccctaagattcagtcaccatctcggttccttttcactcttctaaaattttagatatgcttggtataaagaaaaaaacaaactattcatcaaacttttttcatcaggatgtttatgcttatttggtgggacttaaagcctccacaactcctagcttatttgaaataggcttcagagacaccaggctaaacattattaaattacaagagtaacatcttttccgtggacttttatccaattctgcccatccacattcaggtccttacatattaccaacctaaggtctccagggcagccaccatgggggtgtgccctccagggttccagaaatgtattcacggggcacaaaagatttttgtgctgaggctagggatccaattagctatgaaacatacttccgtatgctcgttggaaataaaaaaagtttcataattcccttctatggaaattttctttgtgacttctaatatacttatataatatcaacaggataatgcgatattatccattaaagctacaatatgtggccatagagacatatggtaactaaatccaagcagcagctgtaagtcttctttcaagctacttcctgtatctgagatttacctcagattctgaaaggtttatggcaatgttcaagatgccaaaaatccattaacagtatgaaattattaccttctggattttactgctcatcgtgatcatctttcagaatcaagtgcttgaaataagcacaattaaaattttaatcagtcacctgtagctgttgaaagggcagaagttcttcctgatggtgataataatagtatgtcataataagaacaatgaaagttgtattaaaagaaaaataccagctgttctctgttgagcctgcttctgcgtggaccttcaggaatttcatacttttcttcctgttcacatacttttcttcgtagacatgcttttacccctgacaaaaacacaagaattaaagcaaactaagtatcaagtgagcactatatctctctcattaaaatcaagcaatttacctaagtggtttttcttcttcatggcagtttttaagtattattctaaaatgcaaacagaaatcttacttatgccaaaacaaaatgtaatacaactggttttcccatataaagaaaatattttaaaaaactctttctttggaggattaagccataagttagtactgaacactaactgtaattttaatctcctttctgaaaaacctaagccaggatactatttcaaagacaaaaataaaagtctacatttccactcatagcaattacccaaaattaaggtgaataaaaagtccatgacacaataacctaaactgagcacttaccatctatactgctcattttgacagttatatgtctaatcgtctgttaaactgtaagtgatttgacatgaaggaatgtgctttagtctacagcaccaagctcagctagccacacaacaggggttcaacagcgcttcctaaaataaacaagcagagcttgggataggtttggcatgtgacaggtacacaactgaggttgctagtctagagatgatttgattgggctttgcaggaaaaaaaaaagcattcttttgatggcttgagtaagtctgttcacagcttcaggttaaaaagcaaaagcaatagagacagctcagcctggcactgtttagagtcattccactgcttggcacctgggtggggaatccctaagtagggccactggctggcagccagtaccaattgtctcgctaggctctagaaatgaaaggaacccttgggattcccaggaccaatcatgaaggacatggtcagcttcagctagagacaacatcttggataatgcctgtttaccaccaagcgagggaactgatggcatgtatatatatttatcatgcttctgttctgatggcatataactaaactaaatttgagatttgcagttgaaggacttggctatcccaattacttgttctggaagcttccttgcctatggaaataaaaaatgaaaacaatgtttttcaccgggcttctgtggataaaatgcaagaagcattctaaaaactagatactacaatgaattatcttcatcataaaaacaaaccctccatacaatttcctatttgtctttgaggttgttttgctcaatacttcattttatcactgagggtaggaaccatatattattcacctatgcgttcttcagaatttcatacactttcccatagaacaggagtttaatagcagagggtatcgggaaagttggaacaataactcaggtatccccttcactgtctagtgttgttaacataaaggaacaaaagtttttaaaaattcactatggacacagcattgacagattgtatccacatcaataaaaataagtaattatatagcacctgtaagagttcagagttacacatagttttgaatatcaaactgttacatcctgttatcacttgatatctaatggcttaaaatgatcagaaaaaaatctatggctgcataaacatatactttatattgaggattagacatatatgttggatatactacagtgttttggaaacctcttgaaaaatgctagtgataaagttttgtccagctgatccctacttacttcaacagtaaattgattccaacacaggagcagaaccactactcggcatgtaaactgcatatgcctgcaaaagggctcctttcttgactaaagggtggctaagaaccaacagttaatctgctacccagaactgtcctgcgattgcatctaatataaattaagattcagttgtgtatgagtaaaatgtcttttgacctatgatgatttttttttcttttttttttttttctgagacagagtcttgcactgtcacccaggttggggcgcagtggcgcaatctcggctcactgcaagctccgcctcctgggttcacacctttctcctgcctcagcctcccaagtagctgggactacaggcgcccgccaccatgtctggctaattttttgtacttttagtagagacaggctttcatcgcgttagccaggatggtctcgatctcctgacctcgtgatctgcacacctcagcctcccaaagtgctgggattacaggcgtgaaccaccacaccttgctgacctataatgattatcttgagagcaaaaacttatactggagaagaaaaagaaatgcaatgttttccaagagtgagtaatggtccactttagactaactcagactttatggcataatcggttttaaactttcttctttattaccccacactgacacaataacaaaacttcaactgtttccaggagccacatctgcagaatttggagtaagcgacagaactgaaaaaactggtactttctgagggaaaaaaaatgtgtttgagtcctctttataaaatgttttatttattctaatcttgtaacttgaattttgaaaatacctagaatcaaataacttacgaggtagaaaagaccctgaagagctagtcctaccttcttgttttaaagatctgcacagtcaagtgcagaaacataaagtgacttgctaagatcactaatagcaaagttaaagtgaaccacttcctaaagcaacagacttccacttcggcgctcttcctatatcatatttataggccaagtatcccttatctgaagtgtttgaaaccacaagtgttttaaaattcaattttgttttggattttggaatatttgcacgtacataattaggtatatcttggcaacaagacccaagtctaaaaaagaaattcatttatgtttcatatacgctttatacagataaagcatatatgaagataattttatatactatctttaataattttgtgcataaagttgtgtctgcgtttagactgtgagccatcatgttaggtcgtgtgtgttgtgctggcactcaaatagtttagtattttacagcattttggattttcagattaggaatgctcaaactgtgttaaacacctatcatgtacaagagaagtcataatctcttccctaagaagaaaattcctgctgtttcctgtcactttatttcaataatctaatcctgaactttcattaatattgtatgctctatctcagagtgcttaattttaaatgaaattttattgctttattttcctctgtcaacaagcaatccactatcaaatttaatttttcaagcacatttaaaattacatccatgttttaaagatattaaggatgccactgagataatctcaatcatggtatatctaataacaagaaaactccctactcttgtccagaaatcctaagaacttcacattacgtaaacttctgttacaaagtcagtgaaagaaaaaaggttaatagcttatacatagacaaacatgagaagattcgtttttcagattcagcttttccctcttttcctacttaaaatggctaacctttcaaagaataacaaatgtgggagcagatttgcttgccagaaagataataaaatattcttttatattttgcatgtatttcaatgttaaaagcaaagataataggttttttgaataaaatgtttgaatgcaaagttgtttctgaaaataatggaggaccaatatattttaaatattaaaaaaatatgctggaagtattaatgatttacatgtattagtgaagtggtattcaaaaatactaataaagcaggaaataatacacagccagagttttagccatttatagctcttgttaaacaaatacgaaatcacaatattaaatatggaaagaaaaagtagaacatcattaagaaaatatggaataagttgttccattgttacttctctgggtttaaattgagtagaacctgagtagaatttatttgattgtatataagtttattttacacctgtaaatactatcagacagaactctcttcttataaattaatagagaaccatgagagcagtatcattttataaaaactatgaatgctatgttacctaatattcatccaatgagcaaaatactttactatagattgaacgtgtacattgtgcagtgctctgaaaactttaatttttccacaatctagaataaaatactcataaatcataaggcctaaccaatccaatgctaaaaatcacacaccaatattttctggtcaaaggagaaaaagaaaattcttaaaataccaatttattctattctgttttctttttacttttctaactttaaatgaccaaggacacaactgtttgttctaagaaaagatcctgatcaaaattactgtgataacagctaccaaaagtacttgtatccttccccaaatccagcaagagtagtatagtcaatgctcattatctacagtagttatgttctataaagatgctatgaacaccgattagtgaataatgaaacactgctgttaaaggaaatacagggttacatttctgtgggcctgtggctccagcatttccatcaactgatcaatacttaactttgttttatgtatgtttctgtttatacacattatttattgtatactgttgactcattaagattaaacttagggccagcagtactacaattaaggccttaacaaagcttatcctacacagtatttaatattttccctgaaaggcacatcaccatcttcttgagcttagactcacaaaacagcacttcagcactgtattatgaggccattttaaataataaaatcagcaacaaaaacacaaaaatgcaaaaaacatggcatcaacagactgtgaaagggccacttgtttacagcgtgagagctgaaaagaggaggtaaagtatcaccttgtttgacctcagctggggacacacttgtttgtcaactaaagttcttcactactctgtacatgtctacaaaagcactgtgagtattgatttggggattacaagaaaaattttagcaagtaagaaaactcacaaacacagaatccacaaacaatgaggatttactgtttattacttccaattcaggggagggaactgaaatgctaagaagtcaacttgcttaaagctgaatgcagccattaagtggcagaatgggaatttgaacctaaatctgcttagttttctaaaggctgtgtatttcacactgaaatataacttagtggtacacaagataaaccttgggtattatcttagcatgatgtgaatatgtcaaatgcttaaaagctgcttaaattgagtgttctaagatgttgtttattataaaaaggtcagaagactaacaactgaatactccatctctccaaaagcagaggtttgtcaagacgctgagtctttcctgaattgggtcattaatgcaaattcaaattcaacactcacactcaggacgtctatgattacccatcatgtcaatcttaatttgttagttttatctgtgttttatttggctctcagatctctctcccccatttttttaatatgaaagtcatattcacccaaggttgctaagctgaatttccgaatcttataattttaaattatcataaatgtgctttgaaaattgtttacatataataaaaattatactctaaaaaaggcataaattttaataaccactcactgaattaaaaacctttctaataaaggtaatataaatattaattttattatacattgaaaatgagactcaaaattcttgactgggtcaaaataccatactagaagcactgccagtgtgctggaattatgtcatatattgtttctatattaaaaatcaaataaaaaaccatcaggaatccagtgaaatggttaactcaaattcactattttatatgtgatttttttattttcctcattacgtaagcaggtattccccttcccaaatctccttcccaatggtacttacagagtattcataattgtatctttaactgcatatggtggcacagaaagccaaggactgaacattcttatgatatctactgtatcgaatgaatggctaatgtctaattgcagaattaagtaggctgtgcttgtgccagctgcttctccattttatgggtttatttgactgattatttacaagaaacacattaaaatggcatctattcctcctgaaaacatgctggcattagtcaatcaacagaatttaaccttaatagatactacagtccagtaagtatggcatcaaaaaaatgagatggcagataccaacagagcagcatggtacttccatgagaaggagccagtgtaagtcttaattcattaaatattctgtttcatgggagttatgtagtaagtttctgtaaagtaaagcaaatccaatgctctagttacaatgattgagttaaacaaatacatttctctaatatgcttttactccaagcaacaatttgcagaatcctgtgtcacctaagactaactaaggaagaatgaaagtagctctttttcttttcctgaaaagaaaggatgtttccaggtctacaactacatttgaagggtggcaaagtgttttgttaaagttgctgttatagcatagaaaatctctagaattttttcaaagctgggagtgacaactacttcaaggattgcgactcaaatgcctacaaaagccaggtagattacataaatgtgtgaagaacctggtgtgaggtggtaggaagctatggagactgtaacaaacatcatgcctaaatatataaaaattaattatgttagacaaaaccagacactgtatttccttcagccctcagagtcctcagcctgccgatttgaaacttttgatgctttgtctaatcaacctcttttatagataaggaaacttaagtcccaagagatttaagtggctttctcagtgacataactgagatgagaactgaaatatcctccatgtcacagatcaagtttttttgttcatctttatttttagttggatcaatgtgcttactcaatccgacatgctaaggttgccactgtctaacttgttatctgaaactgtgagtttcagaatgatgacctactccggagacaataccacagttacaaattcatatcaacttcctactgaacctttttttaagacaaatcaattgagttgatttactgaaaagtaaataagaatgaaatgctttaaaataaactttcagcaattcaaatggtgatacattatcaatgcactggaagaatctaccagccaaacattacttaattaacccaagcctaaataatgactaacattttaaggttttatttactgaataaaagttaagcaatctgcagcaagaattcttaacctattttccatttaaaacacagttacattttaagatttaaactattttatatttgtaataaacagttaataaagtccataattattccatcagtttagtagaaagatgaactcttctacttccttttgaagaaaaaaaaagcaaaaatacaaatataagaccacattttagttagctttcttggctaataatttccttactaaaattaccttgcatgagtaagtttacgtaaacataacttttgcatatgccagaatgatacatacttgaaaatgtgtcaagccactaaccttataaaatgtatgctttatttcatctttgttacttttcatatgttcctttatagttgaaggttttgactgaagctatcacttcgcagaaacaaacggatgaactacttagctattacaactagagattcttttagcccaggtgtattcctgatcatgttctccatttcatgtaagctttccttttttcctgagatcttattaattttttacatataggtaagcagccccatttctaaagtactgattaacccaaagtcattaaggtagctctgtctaccttagcaaagcctggaatttttgcataataatgacgcttatgaattccagggctacaacacttttctataaagaaacttgtactgtacagaaggtatttttttattctaaattgctaataaccactctctcctcctacctcataaaagcatatacatcagtagatgtatatttctgttttagctgcatggaccactgatgatggtcatggttttatattaagcttacatttcctataataaaaaaagataacacaaatgcaaggaaattaaaaaaaggaggggtgttcctgaatccacagttatacaaaaatgatgagagaatacaatgaagatggaagaaaacttcaaaatggagatctgttaaatgtccaaaggaggagacgattattaactctgcatggaaagccatacttagaattttctcactcttcaaatcccagagtagtaaacagatccacattttaaagaatttttaggccagacctggtggctcgcacttgtaatgctagcactctgggagggtgaagcaggaagaccgcttgaaacaaggagttcaagaacagcctgggcaacaaagtgagatctctgcctcaactaaaaagaaaaaaaaaattagccaggcatggtggtgagtgcctgtagttccagctactcaggaggctgaagcaggaggatcacttgaacccaggagttcatggctgcaaagagctatgattgcaccactgcagtccagcctgtgtgacagagtgagggaggggaaaaaagggttgttattattctggaattaatggctatttgtaactgaaatagctatgggaatcagaattaaccacttttagtcaatacaaaatatcctaaaaaaaaaaaattaaaatacagaatcaaacatcactattctatatgaaaacaaatgttctactacagtatgtcattagatctaaactaaagatgtttaaattagggatgtgtgtcactcaagataacagtatgtaagtaaaataaaaattaaagaatttcctttgattctattaaaaatcaacacccagattgtaaaagcaaaacaagtgttttgcaaatgattatattttagactttttagtcgagtaaactataacagcactaaactttagtaaaaagggacatcacaataggcagcctacaacaatgacaaaaatgaaaaaacagtagcatactatcactgcaatttttggaaaacttaagtaaaagaacagagaaatgagtttgaaatttgaaacttccatagcgaaaagtgaaaggacaatgaaataaaggctgaaaatataaaataaaggctaaatgtttccatttaagatttgagatatctcattaaatactgtcgacagtcattaaattctggctccatataaatatcatttagcaattatttatttttgacattttagtaaaaattctggctatcagcatatttatatgtagaaatatatttcttcacattacaagatgtgtaatttgctattttacttaatgcattgagaagcaggttaaattctattgcaaaaatatattattatatcataaatttttcttagacaaaacttgggtatcaattctaagaccttgtattatgcataataatatcaaaatatcaaaatagtctatctcttgtattatgaataatatcaaaattgtctgtctctatataggtatggttaaaaaccgaacacagtctaacgtccaaaaattctcctaattattagaaaactcatgctcagtgttcttttgaagtcatatattaaaagttcaaatttttatgtaaaaaattctgttctgattaggacaatcaccatattcaaatgtatttgctgggtatccattaaacaggtataaaagacctgttgtatcagatgggaggaataaatacatgcaggttctaatttccctaattaagaccaaagcccttccctatccaattaatcgttagaaaagtgaaaatacttccaattattattacaacttgaaaatttcaacgtattaatttattcctagagaacttaaatttgatctaacaggcacacactatttttaaaactgttataaacaaatagtcctcttcagtaacccaccaatttactgctctttgattatttttttacccacatgcatgcatacatttatatattgttgaaagtgaagatataattttgatgtgtttaaaatttaaacaattctatttttcataatcttttagtcttaatatttatcatattaaaaatatgcattttttccagagagtatcttcaggcatttcagaattttcctaatctttcatatgtaggttatattctctacttcttgctgttagaagtaacactgcaaatactttttctttcatctgtatttcttgcgtagggtaaattctcagaactgggactattagatcaaaggatgttatttttttttattcttagacaatctttggtggaagccttctgtcagcataaagttgcctaatcaatcttaatttatacgaatgtttttttttaaataattagcaaagtctgtatagaataaaagttgcatttaattttaaaattccatagtactctcagtatccatttaaagaagccaacttgttagaatttgtttgaaaagaattaatgtgttagcctgattatgaggttatttattaaatgatgatgtaatgattgtcttctagggtccatctctcctcagctaaaacaaaaatgaaaaaacactcaatttagcccttccccatctcacagacataaatccagtgtaaaatgtctggcacattccttcagtaattcccttaggtactggggaattttacaacttctacagctgcaattttatttaaacttagatgagagtggggaagagggaaagattattaaagaaaagatgacagccatctgttctccccttcataatgagataagaaaagaagatgtagaattaaatttattttagaaaaaaaggctaagatacaaaaaaattttgaaagcagtgtactaaaagaataggtcagtagaaaacattttatcttggcctagtttgcatctttaggatacagtttcatcttattcatactctatgagattcgtaagatgacttatttatataccttctattctttcattcttatcacctctttaatgccaaaatcaaccttgtatgagggtggtgctaatggcctgtgagaaattagcacccagactaggactaaagtagagtctccctcaccattttgatgttgaaggagggacttttcttatctatagctcctatttctgtaaaatataaaataagtatcattctgtaaaatatctgtaaaagaaatataagatagactggatggtctgtaaaattatggcttagtctcagaatcctcatgctaagttcattaattatggcactgtaagatactctgtataaacaatgtaggaaaataagagatattaaccaattaagacagaacacttcaacagaaaacttctcatagttaaatttggacccaatggatccaaatcttttgtataattctttttgttaaatggtttagtttataaaatgtgttgattatctatagagaaaattacaaataaaattctacttgaatctatttggtttatgagaaatcccatgaaaagttaatatgaaagtttcctaatagttaatcctgaagttttgtctaccagcaagttaatggacagactcaaacatgagacctagttttaaaaagtcataaatctttaaaattaattttgaaagctttggtccacctatcatcttttaatatgaatggttttcaaatagttttaaatagctctgaaacatttttaaaaatcaaactgagccaggtgcagtgatgtgcacccgtagtaccagctactcagaaggctgaagctggaggattgcttgagtgacacctcatctcttaaaaaacaaacaaagaatcaaactgagatgcttgacactgagaacagtatagaaactatgagaaatatatattaggaaagaactatttgaaggttcttgccttctttttgtaaacccagtgactatttaaaggaagtatctcaaactttgaatctgtttctctttgtactctatattagaaaatatgacgatatgaacttcagtaagggattccatccatcctttatcctaaaagaaccattgatattagaggatgttattcactactgtcagaatcaccaaatagcacactattaagttagtccgagtccatcagtggttctataaaaacgacacggccaagatattaaagtgacaaaacccacatttcccaaagaaggcatattttatggaaataaatcatgtagcctgtatatgtaaccaaatgccacttcagcatattcacaagaactagactcaaaagttaagtggtaaatgtcttaacattcaaaatttcgtatggcttctttattactgcgaccttactatgatgaaaatctatttctccttataaccactggaaaggtttctggcacaggtttgatacaaaagcatccctaatcatgaaaccattttaaatgaattttttaaacactgaggctcaataagactttcacagatttaaaaggaaaaagaaagttcaaaactaagtgagacaaattagtccaattacttatacttctcaaactcatcataactaggagggactaattaatagggattgatgagaacagatggagtggcattgctagtcacagcctcttagctggatcagactgcattggttgagacaagcatcacaaaaaaagaagtggtagctgtatttgaaaatgacatgaataccaattgatgaaaggaaactgttttacaaaccaaatcaacttctaactacagattaaattaataacataattaagatcttgataaatcaggcattctaccataaaaccttcaaagcacaaagccataaaaccatttttataaactaattttaatccatcagttgcttcataaagagtttcaataaatatacccactgttctttcttaacatcttatttaaaaataattatagtcacaggaagtttcaaaggaatgtacagagatgtcccacgtacttttccttcagtgtccaatgttaacatctaacaccgctataacataataccaacaaattgagttcaatacgatccatagagcttattcagatttcactagttatttatttttttttgagatggagtttcactctgttgcccaggctggagtgcagtggcgccatctcggctcactgcaacctccacctcccggggtcaagtgattctcctgcctcagcctcccaagtggctgggattacaggcatgtgccaccacgcctggctcatttttctatttttagtacagaagggggtttgccatgttggcctggctggtctgcctgcctcggtcgcccaaagtgctaagattacaggcatgagctaccgtgcctggcctgatttcactggttataaatgcacttgtttgcataattttatctcaggtagtcttgtgttacatggccaccactaacatcaagatacgcaactgtattgctccccacattcctcctctgtaaccactaatcttttgtaactactaatcttttgtaaacaattaataaacaaaaaaaggtcaatccactgttctatgttagccatagtatcaaaagtagatatgttaactattaaggagtagaaaataatcgtgtatgagctttcttttcattttaagtcccaagagaatccaagtagaaatgtaaatgagtgacagcagggaaggtgacaggcagctctgaaggtgatggtgggttgactatcagcaagaagaggggaacaggtatacattttcagtggaggttgagatagctggtatagtgactccaactaaagtagtaaaaggcagtcaatttcccaacagcttcctaaaaatactggattaaattaactaagaccaaaagggtgttatgcaggtaatcataaaggaaaagcaataaattgctttcatttcacagacatgtcatgcagtatatttaaaacatgtgttattaaattcaatatatcatttaacagtaacatgaatcgcttaggcttaaaagtatactatgtactccatttacttttcattgaaatagttggtattgtaggaaaaaagactttaaaaccagaacatatgtatatacatttactaaggacatctaaatgacaccataaatatgagaagctttttctttttttcttttttttgagacagagtctcattctgttgcccaggctggagtgcagtggcaccatcttggctcactgcaagctccacctcccaggttcacgccattctcctgccttagcctcccaagtagctgggactacaggcgcccgccaccacgcccggctaatttttttgtatttttagtagagacagggcttcaccgtgttagccaggatgatctcgatctcctggccttgtgatccgcccacctgggcctcccaaagtgctgggattacaggcttgagccaccacgcccagccagaagcttttccaaaatgcagtgactaaccagaggtaagaaaattaacatcaagttccttaatcacaggcattaataaccatgaaaaacaaaactagtctaattcatttcttaattctctcaaatccaacacttacattcaaattttagaatccagcatccattgagaatcccaagcatacacttcaaggtactttgaactgcatcaccaggaacaacaacatgagttactaaaatacaaaaaaagcagtaagagaaagaaagatacaagccaaagtatttctttggcctgcttcttataactcatctatattttgtaagcttatatctgaatcttcaaaggcaacaatttttacacttaagtgtaagactacttctatttagtatctagttctctaacctggccatcaatatgaaaaatcagatcataaaccatatatcttaaagccatattggcaaacacaaatttttattttcaaattacagctaagggattatgacattacactgcacaacaatttatttgtcactagcaaaagtcacaaatttgctcttctgaaatactgtcttgtcctaaaatatatgcaaacctttaaactttacatttcctaactacgttgttgtctataagtagtttattactgaaaaaaaatttagatgtattacaagatgcaaagtatacagccatctcccaatggttaaaacatatgtaaattatcaaaggtagttctccaaaaggatcatctatttaacattttttctaccccacctcccaaaattcaaaatcctcacctgtactgtcaaactcagtatattttttagccttaagaattactgcaagctcactgagcattttctgttgttctgaagacagcccactgcctataagtacaagaggtccatccctacgctgcccagtgttcatctgttaatataaaaggagataccagtgttaaaaacattagacgactagacaaagacattaaacagactgttacttgatataagcttgaatttcattacttagtttactctaataattttcaattatttccattgaatctacacccagaaccttttaaataaattttttctctttatttttccctcaagaaaatgtcaattgtgatagctctctatacccagggcatctcatttcttcaattttaaattgggtctctctagggttttacttcattcagtcaccagtaagtctttttcttttcccaagtaacttaaaatatccacttaaaatcagcaattccctattccacctccactaacttgtcccaatagagttaaaatcaaacttgtttagtttaaactgagattatctgaaaaatcaaagaatgccaaggcttctagaacagtgctgacctcaaagatagaaaacaaattagcatcaaaatagtaacccctcaaaactaggaaaagataaaaacagacaagttaattcaaaacttaggagatcagatccataaatagtaagaagtccatatagctcacgactaagaaagaagtgctgtaacaaagactaatagtttcactttaaaatctagacttagaattcacagaagacaaaaaagacaaaaataaagagaaggtaagagtggacagcattaaagctgagaagtgaaagactccaggaaacaatatatgtccatatatatatatatttccataaaagtgtttgtaaatgacagaattcagcacttaaaagttcagctcatctttcctagtcactaaattgtaagatgatgtaaccacatctaacctaaacgctataaaccctcctcacatagacctaaaaccattaaaaaccctagaagaaaacgtaggcaataccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaatttttgcaacctactcatctgacaaagggctaatatccaggatctacaatgaactcaaacaaatttacaagaaaaaaacaaacaaccccatcaacaagtgggcgaaggatatgaacagacacttctcaaaagaagacatttatgcagccaaaaaacacatgaaaaaatgctcatcatcactggccatcagagaaatgcaaatcaaaaccacagtgagataccatctcacactagttagaatggctatcattaaaaagtcaggaaacaacaggtgttggagaggatgtggagaaataggaacacttttacactgttagtgggactgtaaactagttcaacctttgtggaagtcagtgtggcgattcctcagggatctagaactggaaataccatttgacccagccatcccattactgggtatatacccaaaggattataaatcgtgctgctataaagacacatgcacacgtatgtttactgcggcactattcacaatagcaaagacttggaaccaacccaaatgtccaacaacgatagactggattaagaaaatgtggcacatatataccatggaatactatgcagccataaaaaaggatgagttcatgtcctttgtagggacatggatgaaactggaaaccatcattctcagcaaactattgcaaggataaaaaaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccaacatgacacatgtatacatatgtaacaaacctgcacgttgtgcacatgtaccctaaaacttaaagtataataataataaaataaaataaaataaaataaaaaataaaaaaattaaaaaaggaaaatattcagtgtactttatggattgttcaattactctttgataatatttaaaaacactacagtatttcaaaaattcttaagttacacaaataccataaaaatagctctaaacagaacacattacttctcaatttatataactccacttcagctacattagttctctgcacaaaacacaagagtgaaaaagatatcatttctaaatatagcatatgatactatttctaccaacccaaggaaagcaccaaagtgggtcaagtattttcctatcatacttttaaaaatttgcataaaaaatagaaactggcactaatttctcacagttaaagagtgctataataaaacataaagcaaacagctgccaaagccacatgtctgatttggggtgaggtggcatgggggctggggatttgacttgaataagcataggtctctgacccatgaggctcaaaagaggtacaaaaaacaccccaaaggtttaataccctgattttatagagattagatactatgttcattagcattaaattcaaaggaataattaaatagggtactttttcttagataaaatcattagtttttcttaagttcatcaaaaatggggttaaaaaatctagaaaaaaaattaaaaaggtaaacatgctgcttaaaatgaatcacaaacagagaagtctcaaaatgaatgaatgataaggagttttttaaatttttaaaagattagaggttgcttctcaaagcagatttccaacagccactaaattttacttaaaacataaaaattctaaagagaaaggagagaaattcaaaccccttcctttagggaagcagtgagctgcttccctaaagcagctcactggagatcactgatttaaagggttcccaatgacgctaccaagcacttgtgcttgtttcagaggcaagtatgtatcataaagaatactctaatgttccttcatgcattcagcacacactgaacactcagtatgtgccaaacactgttctcaatgctagggctactatagtaaacagaagagccagcccctgccctcacacagtttatattctagttgagaggggaaaacaacacaagaaaataaaaatacattacatcaaatgagaaatagtatggtacaacacaccaggggaagggggttagacagcactgggaggttgctatttactgtgcagtggcacagagccctctctgctaagacgatgctagagctgggtctgaagggtgtgaggaagctggccatgggaacatctagttcctggaaaaaaaaaaaaaaactaaacaagtggtgctgcacacctgaaatgagagtatgtttggtggactcaagacacagtaaggcagcccatgtgactgaaaaagagtgagtgaagaagagactggtagtggctgggggaaggtatattccagaggttccatctttaaggactgcacattaagaaactaccctttaaacctgaaggacttgatattatcttttccttagccaagtaccaaccattaagacagtaaatagtaaaactcaaaaggccatgtctacatgacatgcccaaagtataggtctcttccatgtaataaaaaccctccttttctgaaaggcactgccacccccagactccaagaataccataaagatatctttattcttgacacatttaaagtaatcattttccagcttttacataaaaggaacatcagcaaaggacaacttggttatgctatgctctgtcagacttcaagtacaaatgaagaaaacaagtcaatttatagttgctgagtacggtgggactgaattgagtaccgacctaagttttaagaaatgtgagttttaactggtccattaataaagaaaaaaacaacctttttttttttttaatggctggttaaccctggggcaaatcatagcctctttaggtctcacttttctcatttgtaaagtgagaaaattaaactgctgatttctagcttctcttccaattcattaccaaaactatagtttggaacagatttataaggctgaagtctaaagcagaagacatagggttttcaagatatgaaagcaactagctcatgaaagcatctatgagagtatcaaactgtagctaccttaggctacctccttatcttaaacaatggcatctactactactcttgtgaatgatccttgacctcagctcctccctttctgttactttcccccatctgagcagtactgggatctggtgagtctaccaactctctctaaaactcttcttcttctctccatccccacataactaccatctataattccagtcctcagcatttcaaacctggtctccactactgcagcctcccaatcagccttcagtctcttcctactcccagctagcctgcagacagtcctatttcagttataaacacactgaaggtaccctattaagtctaaactcgtatcagggaatttaaggcttttcacaatctggtcccaacctaaccctttaccctgaatccctcttaaacacacgtcatactcctctcacagtaaatgctatagtttctcaaattcctaaggtcctttatgcctccttgtctctgagcagctgttccttagatttgggctgccattctcactttgtacacctgactgcagtggggaatgttggctgttacactcaaaatctattgctcacttcctccacactaacagaagcccagttttgttcaggtagcccccctttcaaagactgaccctaacctccagccccaggaggggctgtcaaaatcaatttctgacaataagacacaggggaagtccacggaaaggcttcagggaaagactttagtgtctctttttcagttggccactgtcatatctagaattgtggcaatcattcgacaaccattaaaggaaacttcttagtgaggacaaatcccccaaactgaggatggcaaggtaaagagatacaaagaatttggttccttgatgcaaccactaagtgctaaattaagcaaatgcagagctatcctgcattgggattaattctatataaagtaataaattgtcttcaagcatttgagaaaaggttttctgttactggcagccaacagcattctattagacactctgctaaaatgtttaccctgaaagacttaggacacctttctctgtgaaattctgtgtgtgtgtgtgtgtgtgtgtgtgtgtgtgtgtgtgtatatatatatatatatatatatatatatatatattttttttttttttttttttttttttgagacagtcttgttctgttacccaggatggaatgcagtggcctgatctcggctcactgcaacctttacttcccgggttcaatcaattatcgtgcctcagtctccctagtagctgggactacagacgcataccgccacactcagctaatttttgtatttttcatagagatgggatggggtttcaccatgttgaccaagcaggtctcagactcctgacctcaagtgatccacccgccccagcctcccaaagtgctgggattacaggtgcgatccactgcacctggcctttctgtgaaatttttcctgacatctcctgtagtttctacttactttgattctactgtatatttttatagcttattttacaaatttattacaatgtacagtaaaagtttttatatctgaaatccctgctaagctatgggttcctaagaaacaggcattctttccactttatctctagcttgtacctctctcctaagctccagactttcatatccaattatctattcgatatctccatttcatgttttacagacatcaaattggcacatagaactattgatttccttctccatggcaacaaatggcattaccatctatttccctgctaaggtcatacttattccattcttttcccacacttcatatgtaatctatccgaaagtcccgttttgatgctcgctagtctccagcaataacaaacttctttctaaccttccaacataccagcctcattcactgaagggcctatacactgtgtcctccagatagtcacctggcagcctcctcacttcaacattcaggcttcaattcaaatcagtgctttaaggctccactctgtgaccctagctaaagcaatggccttgcagaagcccactacctccacccaacgacactctacaacatcttcgaaacactcatgtctaagtgtctgaaattattttatttatattagttcaatatttacagtttgtctctttcctacctctcaccagatggtaagctcctccctgagaataagagttctaccagtcatattcattgttttatgaatgctgcctaaaatacagagtgggctcaataagtatttctagatggtcgtactgtgattatgtctttgaatccacagtagctaatactcaggaagtgctcaataattgtttggtgaatgtaagcaattggtcaaatggaaatttttctattatgttcctttcataaccaattttaataaaatatataaatgtcccaaagctaaatccatacttactactgagcagtggctagctgaggatgattcattcttctctggtagcagcaatagcgatttcatactttcatcatctgtataatcgacaggccgcagaccaaatatattactggtaaaataagtgcagatgtgtttaagtaagtcaaatgtgtgactcgactcaatttttcaacatccttaataatatacaattttaactaaaataaattactcagaactcatattaggcagaagaatctagaatcaaaagctgctgaactcaaaggagaaatgatgtaaaatttcagtttgacatcagattatagggattgtttttactgaatatagtattatgaatttttcacaactgtattctgcattcttattcatattaaaatatggcttcataatcaccaatcactataagtgacagactttcaaatgccaataaaaatcatttactatagctattataggccatatagtctttataaaccaataaaaaattagataaattcacaggacagggattttgttctactagaaggaaaattatgccacataacaaacagtttaataatatagttaacagggtactttaaaaattaatttaaacatgtgtgcatacaataacctataataatcacaaccatcgcagaacaaagtattatggctcagagagatacaaacttctcagcatgtactaattcacaagtcacagaatgttacgctggaagagattttagagatcccagtttgatcctgttcaagataagaaaaaaaagagagaagaacaagttccaatggcttaactaaggtcatattctccttgttcaatttcactgaaattaaatattgcccagcctaaagtctttcaattataagtaacttgttaaaactaaaggacttctgtctactattctgtttccttacatatggtttcagaatatgatttaaatacactataccatggcaagaagttttcaaaatgagcaattcttttatagtcttctatgttttttttaaagattatgctatattcatataatggccacagaagtccatgtgaaaatccaatgcagtaaatgggacatgaagttataaacatggtataatactaattctgtaaattgtatcaaatgtatagaaaaagatctggaaggaaacagagagaaacattaggggaagtgaaaggtagaaaaatgccaattccgtttgatgctgcagagagagatcatgtagatgagggatataagcatctactgagttcacagacaaggtcactaatgaccttggtgaaaactgttttgatggcagagtgggaaaagaaagctaatgtattagaataagaaatgaaccacagcaaatgtttctctaatgactgcaattcgtgactatcaggtccaattgctttcttctttggacagtcctgggtaaacactgacaagtttgtattctgactcttctttatgtccaagtccaacaaccttcctctggcaacagtctttctccagccaagatataatacagcggattgcatttcagctttataatttaaaacaaagtgacacatgtcacagtatacatttacagcagacaatctcagggtattttaaaagaaactcatccactattcttgatacttcctaattcattctctaaattattatgctcatataccaactacacaatctcctcacccacatatgctatacatatgacaatcaaaaaatagaaatctgagttgaagaaccaatgttctaggtcttaaaccaccaagtgcaaaaatgaataaacaaaacaacaacaacatataatggccacattatatgccatccaaaaaaaaaaatcataactgcatagccatgattgcaccatggtactccagcctgagcaagagatactgtttcaacaaaaaaagaaaaaatgagaaaaaaaaaaatccatgcatacactaggactttttgacagagacaaacatagaccttacacctcaaaaaaataaaatctaagagcccaatcaagtgcactttaatgcacagcaactgaatcacattagcatagttattttacacatatttgaaaaaaagtgcatgatgacaacatgaaaaactgttcaagtgcttctcaaagtaccaccatcagctagggaggaatataaaccaaaaatcagccagtaaaacatggtctaagccagtaagatgattttacaaagtgactaccagagttccaatttacatttaggatccttactatacaaagcttactatgtcatatggtcttaaaacatgtggtttctctgcttggattatggatggcttctgctcacacacaattcactaaactcttagccctcctgtaacgctaatgaactgaatggcacattacaagtgctacagatggaaagataatcagtttacctcagtcctgcatcatgggaaatagagcctattaaatccagtcatgttgcttctgctttgtcatgaaccattaaaatttggaagtagatgtaagtttacatgtgggacgttcaaagaccatagcaagagaagatggggcatgtgtaagatttcttattatttgggcacaataatgtgtgctttcttcccactgatgtattttaacagactaacactttagttagagaattagtgtgaaaaatcaatttaaaatacacagaggtggattttattcccattgtaaaactaataggtactacatacaggaaaagttatgttgaaatgtatctcaggaactattaacatgacttattactaaatagagaagtcagtgataaatacattattcttcatcactatacaagggaagaagactcttttttagatttactacatcatggactcaaaacagacatcaataacttgatttgatatttattagaatgggttactggggaagcttataaaatggctttttctaaatacacttaaatatagtaaattctctcttttctagcatgatttaacctaaagttttaccaaactaggtgttttggagggacacataagacttagaaaaacactgtccttgcctataatcctactgaggataaacgttcattcaacaaacaggtatcaaactgataaagtataaacccaaacaagtaatgaggtgaaatagaagataagatttaaatggccttgatcccaggactagaaactggaatatggtggttaactgttaaggggccgtgtagggaataagcaacatgattactgaaatggatgcaactgatggaagaaagctttctatcaaaccttctaggcactgtgtgctcatgtgtagaaaccaaacacagtatgaaaaaccaatgaaaaaatcagatataaagcaatgaacattacagacacaaagcgtatgttgctgtgaaaatggaaaggcacatgtgtctactagctaaatgacatgggtcaatgcaacaccaaaatatttaaaactattttggaatatatgaaaatgtcgagatcttaactgctgaatttacatctagtacacgacagtatattaatatcttttacatgtaccactttcgacagtcagttcttttaatgccttatcaacggacagtcgcgaattcagtgaattgaaaatgattatatgtagataatatactttacctatactgataaggtttctatttgtgtccccgcccaaatctcatgtcaaattataattcccaatgctggaggtggggcctggtgggaagtgactggatcatgggggcggatttcctccttgctgttcttgtgatagtgattgagtcctcaccagatctggttgtttaaaagggtgtagcactaatgaccaggaaaatgcaaatcaaaaccatattgataccaccttactcctgcaagaatgggcataattaaaaaataaaaaaataacagatgttggcatagatgtggtaaacagggaacacttctacactgttggtggaaatgtaaactagtacaaccactatggaaaacagtggagattccttaaagaactaaaagtagagctaccatttgatccagcaatcccactactgggtgtctacccagaggaaaagaagtcatgatatgaaaaagatacatgcacatgcatgtttatagcagcacaatttgcaactgcaaaaatgtggaaccaacccaaatgcccatcaatcaatgagtggataaagaaactgtggtgtatatatacaatagaataccactcagccataaaaatgaatgaactaatggcattcacagcaacctggatgggactggagactattattctaggtgacgtaactcaggagggaaaatcaaacattgtatgttctcattcataagtggaagctaagctatggggatgcaaaggcataagaatgacacaacagacttcacggactcaaggggaaaaggtgggaaggtggtgaaggataaaagactacaaactgggttcagtgtgtactgctcgggtgatgggtacaccacaatctcacaaatcaccactaaaaaacttacttgtgtaaccaaataccacttgttcccaaaaacctatggaaataaaaaaattataataaataaataaattaaaaggctgcagcacctcctcgcctcttcctcctgctctgaccacgtaagatgtgcctgcttccccttcatctcccaccatgactgtaagtttcctgaggcccttcctgtatagcctggggagccatgagccaattaaacctcttttccttataaattacccagtctcaggtgtttcacagcagtatgaaaagggactaatacatatactgaatcctaaaaattcaaaggctctaattttttttctgttccttgacaacacagtacactggcagatttcaccagttttttttttttctaatgtactcttgcgctattcctttacctatgattttaaatcataatgtggaaaatatgctttataaaatctttaaagatatgactggagattttacattttaaaatcttgaacagacaatccaggtgttcatgtgtcattgctttttgctatctaaaatgtagtatgaaatactggatgatttgttactgatgttgatagaacctatgtgaaaatggatatatgtattaatatacataatgcatgatatatatattgcatatatcagaagtagcaataatcgtttatttatttaacacacatggaatgaatatatttgtataaacaagtagggggaaaagtcacaaactctgttttgcaattagtttggaaaatagtcatcattcagcaaatactttgaaaaaaatgtaccaacaacttttggcactatagaaacaatgtcctcacagaactcagaggaggaaagcagagaggcacacagaaaaggttttgcagtctggtaaagctccccagacctgaaagggtaaggaagaaaagcgggtacacaaacagaataagaatatcctagcagacagaaaagtgtgtgaaggactttaagtgagatagcacttagaactttttagaaccaccaaaaaaaaggaaaaaagggggtaaagggagagtgagagaaagagagggaatgtaccacaggaatatgaggtactctcgaactgtaagctatggtcagattatataagaacaaagaggaggtgttaaagagttggacttcctcccaaaggcaataagaaaccctgaacagcttcctaaatcattgtaagcaggagggatggcatcaacgtagcatggtagttaagagttggggttaccgaataagactgcctgaacttacatttcagccctgccactcaaaagtcttatgactttacacgaattacttaaatcccgtgcctgtttcctcatttataagatggaaataataacactatctattttacaggattgttgccagaatcaaatgaatacatcaaaagcatttaaaacagtacctagcatatatgaacagctcaataactgccattatattactgtattggatttgcatttttggaagacagatacagaatgaagataagggcacaaaataagttatgtctggagcattaacctcatatcttcattttccccaattttatgatacaattgatgcatgtttttcatgataatctggaagtttactaagggaaagtatagaattatgtcttcttaacaacattctaagagtagattttcattttcccatgtggcactatctaaagagtatgaaccacataactctgaaaatccttttcctaactaggaatccttctgatcctgaagatgaggaaaaggaagtacttatgaaagggctaaactgtggtgttcaatgtttcagttttgtcccaaaggccacattcaggatgcagtataaccttttaatatccttttcccctcagtaataatatggcagacacctgcctacaatggtgatctgaattcattacaccactaataaaagagagaaaggagagatgggcaaatttaaacttgtacttgcatgtacagaccatccaaactgcaaaaacatatgcaaaaaggcatttttactaatactaaatctatcacgcatgacaggataccaagagagttcatgaatgaaacccttcatgaataactacaaaactgcaaacatatagatttaatttttcaagtcactttgcttgctatggagcaggataaagcagagtaattcaaactagcaacatgggtttttaaagctataaaacataaattatctctggcaattaattttttaaaattaacctagggcagtgggacaattaataggtccaatggtccatgtaatattttctacttcagaattcaacatccttccaaggaaaactgttaatggcagatcaagtaccacattctaaaatcctacatatccattaaaaataaaaaaaaagaagcacatgttattcgccacacactcaaaatggttctcatgtgaccgtaagagctgtggttctagcttcacactgggatgtacagagggcagtggggaagacagattaccaatgatgttttgaacagttataaatactcccagacaacaaagattataaatctttttttcatgatctagggttaaaacagaactgactttcttattgttttagctcacaaaaggtactttttttatgcaaaaaaaaattaagggttaaatgacttaatactgttatttaaatgcaagacatataaaaacagtaagttgccagaatattagagttaaatcaaaacaaaagagaaagtatgaagtagatatatgactttccactgtacattcgaatcctccataattataaagatttagggcccaaaaacattgcagtaggaaaattaataaagaacacagcctctatgggaaaaaataggattgggagacttcactggtgaactataaaagctcatttaatttaaaattaaatagtgaagatggcaaataaagagtatcattgactttaaattcataccacaatatggttaattcttagctattttgccttgccttataaggtttcaagatttccctccaccaatattcaataggacgcttttaaattcacttggctttgcagcagataatactccattctttttcctatgtctagtcttccacacacattcaatgtctaacttatatgactgagttggttactgtccccacttcctgggctacaaaaaaagctctcagttatctttatattttatatgtcactactgaaaaggtacttcttaagcctggtctccaatatttaaagtcacatcttacttagcaccattcatgatacattattattattatttgagaccgagtctcgctctgtcccccaggttggagggtggtggcacgatctcggcttactgcaacctccgcttcccaggttcaagcgattcttgtgcctcagcctcccgagtagctgggactacaggcacacgccgccacacccggctaatttttgtatttttagtagagatggggtttcaccatgttggctaggctagtctcgaactcctgacctcaagtgatccacccgcctcggcctcccaaagtgttgggattacaggcatgaggcactgcgccaggcccataacttattaataatgccagaacatgtatcaggataaaacctggattacttagccctcttatacaagccttcctctctcccagtgacatccgagactaactctatggctggattttgtcttagtttttcttctctctcctagggctgcattacaaaaatatttactcttctaattcaaactaatattcttacagtaacaggaaagttataaagttaatcaaaatcacagcctcagataaaacgtcaaaataggtaaaagttttacagttcacagggacttttttcttttttttttttttagatggagtctcgctctgtcgcccaggctggagtgcagtggtgcggtctcggctcactgcaacctccgcctcccgggttcacaccattctcctgcctcagcctcccgagtagctgggactacaggcgcccaccaccacgcccagctaattttttgtatttttagtagagacggggtttcaccgtgttagccagaatggtctcgatctcctgacctcgggatccacccgccttggcttctcaatccacagggactttttaaggatgaacttgatgggataaaaaaaaaaagtccattttctctttagtgtctgtattttattatgaatacactggtctatcagagtgattactactaataacaaaactagagagatctccaaaaattatataatatgtgagttatcaaaatagatactgttatgctaagttggcagggggcaggatatttccagaagacattctattcatgttccagagaagaggaaaggtaaaaagaaaaaaaaaaaaagcattctgattactttttagaaactatgagtataattttggtatcaaaatccgaggcaaaaaaatgaaagataaaaatcacaaatcactctaacttataatcataaatgcaaaattcctaaaaccctagcaaattcatgtaaaatttgtgtttaaatgatgcacaacaccaagtcaaggttatcccaggaatacaagcattatttaatatttttaaatgtattaacaacatcaatagtcaaaaaagcataagctttgggaggctgaggtgggaggatcgcttgagccctggagttcaagaccagcttgggcaacacagtgagaccctatctcaaaaacaaaaacaaaaaaagtataagatcatctctgcagaagctgaaaatcattcaataaaataaaatacagtcttgttagaaaataataaagggaagaaagcttccacagggcaataaagaacattaatctttgtatttaatatggatattagtattgactataactctatgggtcagtacttttttaaaaaaggaagaacaaaacaagcaagccaactatcatcattattgcatcattctggaagcactgacaaatgcaataagaaatagaagttaataaatgataattagatctttagaattaggtgttgactggatagaaacgtactaaatcaacagctctcctatatatcaagaataacaaattatatttattaacacaatatccagtttactagcaacaaataatcaaatactatacaggttgagcattgctaatccaaaaatctgaaatttgcaacgctccaaaattggaaactttttgagcaccaatatgacacaagcggaaaattccaaacacagtacttaaaaaaccattttaatgcataaaattgtttaaaatattgtataaaattaccttcaggctatgtgtataaaatgtttatgaaacacagataaatttcacatttagtcttgagaaccatccctaagacatctcattacgtatatgcaaatattccaaaatctgaaagaaatcccaaatacttctgatcccaagcattttgggcaagggatactcagtctataactagaataacctcaattaataggtatatgcatgtgtatacctacatacatatatatgaaacagactaaaaactttactaagatatatataacagaatgcttaaacaaatggagacatgcagcttggtcctgattactttttagaagctatgagtctaactttgatatcaaaatctaccgacaagaagtgaaagataaaatcacaaatcactctaacttttaaaatgcaaaattcctaaacaaaaacctagcaaactgatgtattcatttaaagaataacacacgacataaagtttatcaatcgacttgatagaaaccaactttattaatccactgtatatacttaccaatttcaatcaacatcctaatcggtactccactagaatctatgtacgtacccaacttcaaaacatcctaatatggtatttttgaaacagtacaaagtaaatcaaacttcatttgaaagaataaattaataaatatggctaattctccaccccacccccctcccaccactactgtcactactttgatttgactctcatcactcctttcctggattactggacaaacctcttaactgagttccctccccagtgtgaaggaggaggttttcaacttaaaatcagcactctgtttagcacacacagcctttcaaagaccctgcccatcttctctggcctctcatcctcctccatccttttattccacttacatcactaacggaagttcctagaatgaatgaagaagcagtctggccttgagtaccttagcacccatatcttatctttctcaaaatcccatcctcccgttctattttttcaaaactcgaagttcttcttcttccagaaagccttctgtgacttcctctggtcttactttcagccctagctgagactttcatactactgtgagcaccgtgctatgaaggcatacctcacaccattctataatcagtgctttaacagactgttcactgttcactcctactagaacagaagcaggcagacaactgaggggatgatgaggcaaaggagcaatggagggactatgagaagacttaagaagaaaggaaggcatctaagagaaaacttcaaccttgaggtcatgaagaacacagccaaaatgtctatgctagagctaaaggaggccacttagaaatttacagtaagcaaaaaggactttacttcttcaatcagccaaagtagcaaaccctaaagagggtcagacagaatggtgtttgcccttgctggttcttacccttcttccatgggaagagttcaggcctggttattgagaaaagagttccagcaagagtaagagatacagtaagcagagacagaaaaagtttgtttgccaactcagattccagaatttgagatgttaatggtttataaggagtaagagcttcaggaagaaatagaagagtagtaagaatcccatagtctccatgctccagacccccttcccatgatctccttaagaaatggaggaaagggcaggaataaatttcatctattctcacctgttactacctaattctagaagacagtctctagaacattgagacagcatgcacttaaaagtcaaggctataggaattactttgggtagccacaatcccacaaaaagtaacatgccatggatgccaattgggcaaaagctgccaggaaccagttcaaccaccttagaaaaggcacagatatgggaaacttggttttagacatcttgtcacacagtaaaggtagtggcagaaggaggcaattcccattttcatgtcatctgaccttttatcaaaaaagaggaaaaagtataccataatcttcattcattcaaacactaattcactctacaaacaaatgtggatacagactacattaggcacttggcagaactagggagggcagacatgatccctggcccatacagcttacagcctcacgagaagggaggaaacagtaagtcctacgactggggagaagtaccacatcaggaaaggtggccaaaaggacaggataacccaggtgaaacccaaatgagaaactggctaccaaaaacaaatattctagacaatgcaaagacatgtacaaaggctaggaggtaaaagaccctacatattttaaggaaacaaaaattcagaaaagctggtgcaaaaaatgcttgaaggaaagggggaaaggagaagctgtgaagaccgatgagaacagagaggaaagtagcaccagaccatccagggtcttataaaccatattttgggatttaacctttattttaaaaacattaagaggaagccacggaaggattttaagcaaataaatgacttggccagactcgtgttcttctgcaggtgctctggctgcaggatggagagtgaataaagaaaagtaacctgaaaaggaggagaacagtcaggaaatttgtaaagccaatcagatgaacaacaatgactacgacatgtttttaagaggcaaaaaacacaggaaaaaagtatgaagaccaatagtctggaaaggaaatttttagaaacagccaccatactcttgtaccctaggattaaatctgtcccttcatctgccctactatcctttatccaatatcaatcccaacctcttgggtgaaataaaccctacttcccaactgcccagctgtatcaaccagctgtccaacacagtagtcactggcacatatggttaaaataaaatacattttaaaatttattccttggtagcaatagctaattttcaagtgttcaatagtaaaggtgactagtggctactgaatgtccagcatagatataaacatttccaccaccacagaaaggtctactggacagtgctgaggaacagatatacctaaatttgccacttcactaggtagtcctacttaaaccaacactgaaggcacctgtgaaggcagactcactcactgtctcatgccactccttgtatattaataagccctcacagtgcagtgacgaatcatggtgtacaaaccacaagacaggctctgtgttttggctcattaatcctcactatgctctgaagaaatagaaatgcagcaggcatcacccatgttttataggtgaggacaccaaggcacagaaattaacctgcctgaagctatacagtcagtaatggagtcacaaataaaagctagattccctaacgccctgaccagtgctccatccattaaagtagtcatggctgatttaagaaccctagaatgaaaactagtcagtttcacctgacccaagcaataatttgcgttaccaaatagcttgcaacacatatgggagggtcatatcggttaggtccttacaaagaaataggtccatgtatatggagacacacacaaacacgcacgtgtgtacacacacacacacacacaaataaaaaccggaagaatatacacatcccctgaatttgccccaattatcttataacctgtgatgagagataaaagagattagacacatttactgaaactaacagcaccaaggtatggtacattcttgcattattaatttggttttcaattatgttaaataattaccaataaaaaattacgacctagaagccctgcattttataattcttatttgcatctgttaccattgaaaacttaatttttttgtgcccttttcaaacctatagaagcaacaagggcagagacgcaatacctgcattttcatttcaactacttaattaactgaaaagaataaaatactacatagggagacatgaaccaagttacagattaaagatacaaaatctacatacagcatttgcttgtgacactcttgacaatgccaattttaaaatccagctgctggcattcactaatgcatctctgtgtcctgacactgcaaaaagttcacccagaacctcatgtgaatgatgtaaaaaatttaagaaataattcaactgccccggcccaatatttaaattcttatatgctttacctgttgtaatagtaaatacacagaaaaaataaaatgggaatgaaatatttaaaataattccaaactattaggaagcatacaaaataattatttctacaataactgcttattaaagtgtaaatcaatctacagaatataaacactaagtaaatttttccattaaatgaaagcttccaaaattgacaactgtttctgaattaagaaagtaaatctcccccaaatatgtcagcacagttatccccattgctatccatggggaattggttcctcaacccgtgatgtcaaaatgtgccgctgctcaagtttcttataaaagatggcatagtatttacttgtaaactacacacatcctcccgtatactttaaatcatctccagattacttgtaatacctaatagtatgaaatgctgtataaatatttatactatattgttttacctatattacttattatcgtagtgttattttttttcccctttttaaacttttattctaggtttttatttaagttgtgaaggtttgttatataggtaaacttgtgtaacgggggtgtgttgtacagattatttcaccacccaggtattgagcctagtacctaatagttactttttctgctcctctccctcctcccatcctccacactcaagtagactctggtgtctgttgttcccttctttgtgttcatgaattctcatcatttagctctcacttataagtgagaacatgcggtatttggttttctgttcatgcgttagtttactaaggataatggcctccagctccatcatgtgcccacaaaaaaacatgatctcattcttttttgtagttgcatagtattccatggtatatatgtaacacattttttttatccgatctgtcattgatatttcccaattatttttgatctgcagttggctgaatcctcaagtgtagaacccaagaatatgaaggaccaactgtatcataaaaagggcatgaaggctgattatgagtgcagaatgtgatgatcacatctaattttagttgtgaaagtgaagaaagccatcaacttgactattttaaagtctgctttatcacacaccttgattcaagaatataggtccattttaaaaataatttttacgttgaactacttacacagcatttctggaggctccataggaaagtaacagcttgactatatccacatgcccattcttggctgcatcgtgaagtggtgagtcattttgatacccggtggtgttcaccaatgccttatgctggagcaataattccactaccttcaggtgcccatgattgcaagcttcatgctaattaaattttttgaaaaagaagtgaaagaagtgataagaaagagcaatggatgatattataatatcacactttagaaaaataaatgtaaacgtcaggcagtaaatttattgttacctaaatactcaaaaacactataagttgctgacagagtgaaagttactattaataatctttcaatcaagatctgtgtaactcataaaaaaagaaaggctattctcatttgagccttgggtcaagcacttttctgttttttagaagaaaatgtagttttaaaccaacggtagctccttaaatgttctacaataaatgtaacacattaagaaaaaagtctacatatttaataacaagatgatacataaaatctgtaccagtacatacacatatcatgcaacaaagtaagtatccgtgaaggaatgcttttaagataagctatttgctgaacctacaaattgctgtatggctgctgttattgataagagaaataacacgagtaggaatacaaaaagagcttgctgaatgacagaaacggcaacaatggagtgttcaaagatgccttacatccaaatctttccttatgtctaatgaactataaacaatgctgtattctaataaatctctggcattctatactttttaagtacatcaatttcaattcataataagtgatatcacactcaacatctgtaggtctatttttaggagaaaggaatccaaactaggcactaaaccctctaaatcactaaccaatctttactacaacttgccttagtggctttgaagaaaaaaataaaattaacctttctttgaaaaggttagccagccagtagagtccaaccagcaaagcgactgatctagactaaactctcccagctttcttgcacctagcctactgagagtctcctaatttctgggctgaatttctagttacaggatgaaggcatccacttcatttgctgacacttctgtggctgcattcaaatctcatgtttgtcctaatgtaattggcctacataccaattgtttccaagtatttgtgtcattctgtttccagattatgcttcacacttttttagtaataataagcaaagacctttaaaaatgtttaatgtaagcaaagatttctactgccttatatatctacaattggatagggtataagtgaggctaagatagaccctcagtgagaattacttccttgtgatcactttcctatactcagttcctccgacctctttttgttccaagaaatttggttccagtgacatgcagtgctacagaatggagcctgatgtcagctgtagctgttacctctagacattagctaaattctgcagtacagtacaaatggattcctaaatctaaaggtagtctgtcaaaaggtaaccaatttcttgcctgtcacaaatgaaaagctagaaggaaagtaatcatgttctcatacttgatgaaaacataagttcttcagactaaaaagagtatatgtggcagaggatgatatatagacaactacataactataaactataagaactgtaaaacacagaaagaatgagaataaaaaccagacaactaccaatggtgtccatccagcatggtctttaacatttggatcacttccattttgtaaaaggtattcaacagaaggtatgtcgccctagaaaaatgaacaaaacggaaattaaaaagcattaaggaaagaaaggaaaatattgagcttttttaaatgctgccttcttcaatataaagtaaaacttaaatcgttttctcttaaggctactgttcatgagttaataaattattaggccgggtgtggtggctcacgcctgtaatcccaacactttgagaggccaaggtgggtggatcacctgaggtcaggagtttgagaccagcctggtcaacatggtgaaaccccgtctctactaaaaatacaaaactagtcgggcatggtggtgccagcctgtaatcccagctacttgggaggctgaggcaggagaatcacttgagcccaggaggcagaggttgcagtgagccaagatcatgtcactgcactccagcctgggccacagagcaagactccgtctcaaaaaaacaaaacaaaaaagaaattgtctgcgtataaattattctgagatatcaagaagtacagtcatgcttgaatatagactacaaaatctattagaaagccatattcaaaattcatttcaggtaccaaataaaggacactggccaaagatcatgtgctcacaatgaagttttaaaagccataatttcacttgtgaaaaaaacaatttttgagcatttgtaaatggcttctgagtattgtttaaaacaaccaaaactgtttagcccagaagactactcagtgaaaccaaagttaaaaaacagccaaaaactgccattttattggcagttactccatcctaatacatttagtttatattcaccttatttgttcaacattttctaggaagcaacagttgctctgtttaaaatggcaaaaaaagagatcagtacaaacctattcaaatcagcccacagaattagcattaaattttttatccccctgctccccgcccagttcaagactaaaatcaccacccattatcaactaattcaactatacgaaatagagcttctgtaatgtagccttacaagtcttttctaacaagtggttttcaatttctctatttctctattccagtactctggagagctatgcaacaatgttataacagtagcaacagtagcacactgatgcaatggagaaggcagatgaggaatagtaagaaatacaataactttactttagaaatcacaacctctttttaaatcagatgagcaagatccggggaataagtgaattaaaatgaggcacaaggcaaggaaaatactctgaaggcagacaatattaattcgactttcatattaagacaccgtcaattattaaatagcattaaaattgaagaccccttccagttttgaactttctgtgtcttgtgtgtcatgatccaactaaatcctactataaatgagtagacttttaaggtcactttaaagctgtcttgaagtaagacaaaaaaaatagcttccctctgctgccagcctccagcgaaggtagactgtggcaaaggagttctggggaactggtctcaggtagtctgccctcccactcttcttttttattttcctagaagtgagagataataatcctccagctatctaataccagggtctcttaaatttggcccttcatgtaatgtggaaagatctgacatctatcatttatatttaattacatattacgttttaagtatccgttaactcttaaagcctttttaaaaatctctagctgtaatataaaggatactgtccctttgtaaaacaatgtcaggctttaggaagaaggaggcatttatgcagcgggatgaaggtaaaaattttcttgaaattacattattatcaccactcactgcaaatataactaatcagttcttttaggataacagggcagggtacagtacctaagtccatgacgataaagcaaaaatatctagcagagcatactctcaaaaaagaccaaataaaaagctatagacagaagttacatgcataacattgtgttcaatgagtttcgtgagtgcttctttagtgaataaatctctccccacccaacccctctcccaatacttttttctgaaatttttttcctctgttggtttgataatgtagaaatcactaattctcctaaatataatatttgatttttttttctttttaaaaaattttgctggccagacgtggtggctcacacctgtaatcccagcactttgggaggctgaggcaggcaaatcatgaggtcaggagtttgagatcagcctagccaacatggtgaaatcccgtctctcctaaaaacacaaaaattagccaggcatggtggtacacgcctgtaatcctagctactcaggaggctgagacaggagaactgcttgaacccaggaggcggaggttgcagtgagttgagatcacaccactgcactccagcctgggcgacagagcgagactctacctcagaaaaaaaaaaaatgctttttatatctaattgtctctgtttctgtgctctgggctgtttctcaaatcttcagttttctaaaaaagtaaattctcatgcaacatacatttttatattcctaaattaacaaaatgaccttaaatgctcaatgggtctaaaaggattgtaggtttcaaattaattaccccagtttcaggaaaaaaaaaaaaaaaaaaagcaacattttcccagatttcttaacagtgcaaattctacttctagagcaagttatcatgtatttagcaactggagtgcaatggcatgatcatagctcactgtaacttcaagctcctgggcccaagcaattctcctgcctcagcctcagcagtatgctactgctaggcatacatcaccatgcccagctaattttttttattgttttgtagagatgggggtctcactatgttgcccaaactaatggactcaagcaatctcctgccttagcttccaaaattattgggattacaggtgtgagcccctgcaacttttgctttatattcataacggttacaaatgaatgcaggaatatctgccaagatacaaatttttttttccaaaacaatcctgtaacaagtgagcagataaactgccagaaccacacacattccctatctttaacatgaaagtactcacacacaaaaaccttctcaaagatttccccattctaattctacatggtaatgcaaaaaaaaaatattaaagaagcttaaaaaataatataaacacaattgtgaaatggaagagtctcaagggaatagtcaaacagaaacggagtgacaatttaaagaatacaagtagactctcttttaaggttgttagacagttgctatttttctttcatgtcacctcttcatattatcaaagtgtcttctgttaacattctccccacccctgaactgtatagctgattagcaaacggcttgctttttataaccaatctgctttctcctctctagtacttgaaagttttgtcatattttcatctttctacttcatgtaaatgtaatgtcatgcgcataaataaaattatgataattagatagagtctacagtaactggaatagcttgaactgatatgaagtagccaggaaataaattaagttttgattctggcttctttaaattactttcaagtactcacttttgggctcctcacaacttgaaagaataattgaacttttcttaaaccacagcaaacataatttatctaaggaaagtatttgccaaggcttattaaaaattttaaatgaatttggtattttcaagtaatacactgaaggctgaaaataagagtgtgtgtgtgtcccactgaatcttttattcctaatctttcaatcaaaggaaagatccttcacacatttgtacatactgcagatccacacatattccaacaatataaattaactttccaaaaacacacacataaaaacaaaacttttccttattataaatgttagctcttctaaaataccattaataaacatattcataaaaacaatacagaacgttacaattaagtataagacaaatgacttgcctagcatggttaagcctttccatgtaaatgaaccgaccaggaaccaaagacttcccttcttggcaattagatgccattaaaacaaacaaacaaaaatgaaccaactggaatgaagctctaaaatatgttaaatatttctgtagcttcttagaatttactgaataaaatacaggcatatctcggagatactgtcagttcagttccaggtcactgcgataaagcaaatattgcaataaaacaagtcacacgaatcttctggtttcccagcacatataaaagttatatgtgcactatactgtagtctactaagtgtgcaatagcattatgttttttaaaaaaaatgaacagaccttaattgaaaataactttattgctaaaaaatggtgacaattgttttgctggtggatggtcttgccttgatgctgctggctgctgactgagcaagcaggtagttgctgaaggtttgggtggttgtgacagtttcttaaatcaggacaatgaagtatgccacatccactgacatttcatgaaagatttatctgtagcatgtgacgctgtttggtagcattttatctgcgtagaacttctcccaagattggagccaatcctctcaaaccctgctgctgttttatcaactaagatgatataattttctaaatcctttgttgtcatttcaacagtgttcacaacatcttcaccagaagtagattccatctgcagaaaccactttctttctcatctataacaaacaacgcctcatccattgaagtttgatcatgaggctgcagcaattcagttacgtcttcaggctccacttctaattctagttatcttgctatttctactacatctatagttactttctccacttaagttctgaacctctcaaagtcatccatgaaaactgtaatcaactcttttccaaactactgttaatgttaacatttggacatcctcccatgaatcatcaatgatattaatggcatctagaatggtgagtcatttccagaatcatctgtggaatacccatctacaacagctatagccttacaaaatgcttaagtaacaagacttgaaagtaaagttactccttgatccatgggctacagaattgatgttttgttgggagacatgaaaacagcattaatgtccttatcttcatcagaacacttgggtgactaggtggcactgtcaattagtaatattttgaatatctttcctgaacagtaggtctcaacagcaggcttaaaatatttagcaaaccatgctgtcaagatgtgctcccacccaggctttgttgttctaaatggtaaatgagcattggcttccacttcaagtcaccagctgcattagcccctaacaagaaagcctgtcctttgaagccaggcattgacttctcctttctagctatgaaagacacagatggcatattcttccaacaaaaggctgtttcaacttcactgaaatctgttgtttagtgtgccactctcataattatcttggctagatcttctggataacctgctgcagtttctccatcagcacctgctgtttcaacttgcattgttatattatggagacagcttttttccttcaacttcatgaaccaacctctgctagcttccaacttttcttctgcagcttcctcacctctctcagtcttcacagaattgaagagatttaggatcttgctctggagtagggttttgcttaaggaaatgtggttggtttgatcatctatccagaccattccaactctcctcatatcggcagtaaggcggttatgctttcttctcatctcatttgtgtattcaacagggtagctcttttaaattacttaaagaattttttctttgcattcacaaattggctgtttggcaagagacctagcttttggcctatctcaactttcaacatgccttcctcactcatcatttctagcttcttatataaagtaagagatgagtgactcttccttccacttgaaaactcagaggacattgtagggttgttagtttacctaaattcaatattcttgtgtcccaggaaacagggattcaaagggagagagatgggagaattatcagtaagcagaatagtcagaaaagacatttatcaattaagtttgccatgttacatggccagggtttgtggtgccccaaagcaattacaatagttacatcaaagatcactgatcacaaatcaccgtaacagatacaacaatagtgaaaatatctgaaatattgtgagaattaccaaaatgtgacacagagacacactgagcataggctgttggaaaaacagcactgacagacttgctcaatgcaggattgccaaaaaacacaaaaacaaaactctctgcgaagcataaaaaagtgaagtgcaattaaatgaggtatgcctgtaatttaacagataattctgataacctggtcaatggcacaataagttactggtattacaaaagcagacttatacatatgtggtgagtgacagaggagaaaaatagatactgactccaggaggtgttttagaaattaaactcttgaaaatatcacatatgccaaggctgcttttgtttcctttgctaccttctcatgaagctactatgaaggatatataatttcacacacaatataacatgactgtcttcaagtataataaactacaaagttaaactctaaatgagactcctcacaagggatcttctctctctccaggggatcttcatcacctttgttatgttctaagcataccatgccttgtaagttgcattcaaaacattatctattatgtctacatcactaataaatcatggcatgccagcttcaagccattcttctattccacagtaagtcattgctgtggcataaattatgagtagtcattgccattttaagaatttgtgctagagaacttggtagaagggtgtgggggaagaaaaggggaaggtcaggatggcacaaattctcaagcaaagctgacataatagaaaataaaaaattttctctatatccttagtattttgttttctattgggttggtgcaaaagtaattgtggtaataaatcagaagaataaacaatgagtatcttagtttctacttacgcacaaagctttctcataaactctcccattcatgacacagtgttctcaatagcagtttaacatagctgatgcagacattcaaataggaacatgagttatgaagatattcaaataggaagaggggtataaaaaagacttactgataggagagcagagaaatgataattttgatttcggtcagattactctggctgttacatagagaactgactgcaggaaatacaaagggaaattaggaagctacttcagtggtgtggtcaaaaaattacgacctccaaaaatgtccacacacgaataatccccagaacctgtgactatgttaccttacgtggtgaaagggacactgcagtgtaattaagtggacacaccttgagatggggagattattccgcatttctcaagtagcccaatttaatcgtatgaattcttaaaagcagagggtctttctggctatgtcagaaagataagatgtgagaaggactcaatctgctgctgctggatgagatgaagaagaggaccacgaactaaaggaatgtgagagtctctagaacctggaaacaaccctcagctgaaaaccagcaagaaatctggatctcagtcttaccacaagaattatgaagtccctgccaaccatccaagcaaaaatgaaatgggtctttcctggaacctcctgaaaacagctgacaacatgattttagtgtgatgagacccatactagacttcaggtgtacagaactgtaagaaaattaatttgcattgctttgaatcactaactttgtggaagtttgttttggcaccaatagaaaattaatgcaagtggtaggggcaagaaaagagaagtagctgccagtagggtggtagctatggaaaggttatggccaatgatgatgcccagaggtagtttggggcaaggtattatacgatgtttattaataatgtttccaagctcagaaatcaatcagtaaagccctacctgcagtgggggaaggtaactagtgcaggagaacaaactcctgctgggttctctgccctcggtgcatacaccaaggatgctcagcgcaaacatgtgctcaaactatagaaactgcaagtttaccaacatgcttaagaaacaatacaacgcaagtctaaacaactttaggccacttgaaatccttttctgaagtaggtgggtacaaaacataaataatcaccaccaaaaaagatgcattatcttttgacagcacaaaacctggtccttccccttatttgctttggctgccttaaaggtcaccaaaactaaattcactccagttgtagtaactctttcctctttaccaactccttgttccattttatagtagctttaactttagagccacttcaaatccttttctgaagcaggtgggtgcaaaatataaataagatagcagaattgcaatatgtgtacacatagatttattcattcttggctgcaaatgagaaaattaggataggaatgaaatgaaaactgtttctaaaaagattggccaggtatggtggctcatgcctgtaatcccaagactttgggaggccgaggacatatcacctgaggtgaggagttcgagaccagcctggccaacatggtgaaactccgtctctactaaaaatataaaaagtagcctggcatgatggcaggtgcctgtaatcccagctactcgggaagctgaagcagaaggattgcttgaacccaggaggcggaggttgcagtgagctgagattgtgccactgcactccagcctgggtgacagggcaagactctgtcccccgcccctccccccacccccaaaaaagaaaaaaatatataaatatatttatataagcaaatctgattttaaggatatatttattaaaataaagctaaggcgagaggcatacattcaactcataaaaaaatttaaaaggacactattaattggtgattttaaaaacaataaaaattaacttttaaaaaatgtaccataacataatctgacaactggtgacaataattgcatttaataattaagttcaaggaaataaaaatggatttaataattccggcaaaactctaagcaaactgacaaaactcatatgaagtaatcttgaacgtattaatagagaaaattcaccaagacaggagcatgccatcattttatcctgacttaatattctattacagtttcttcacatgcctagaccaagagtaggcaaactatagcctatgggccagtcacccaattttgtacgtaagttttattagtttgcatattgcctgtggctacttttgcactaagaaggcagagctgaaccgctatgatagagatttcatggcctgcaaagctgaaaacatttactctaactgcacctttaagaaagaacttacaaaactctggcctagaccctagggatcctcattaataaagataaattattcttatggttagaagaaaaagtcgccaccaatataagtaaatgcttgcctgatagtccaaaaatttcccagaaagcaaaatatataaattactatgtattagccagcaaaatgaacaaaaataatcattacactagctacttatgtctataactttgtttacaatagcttatatgtacatataatatacatatatataacagagatgacaaaaaatgtctaattttgttaagtcaggctttgcaaaaatcaaactaaaacacaaccagagccaagtgcaaaaattcaacatgtccaaaggatatgtggtcatgttgtaaggtccctgcctcactggtatcagaaatagagtacagtcatccctcagtatctgtgggggattggttccagaatcccagcagataccaaaatccagattcctcatataaaatgatgtatttgcaaataacctacagagatcctccagtatactttaaatcatctctaaattacttataacacctaatacaatataaatgctatgtagatagttgttatacgatattttttaatttgcatttttttattgcgtattgttattggcttttctcccaaatatttttgattcgcagttggttgaacccataaacatagaatgcacagatacacagagctgactgtattcctcattaatctggaagaaaagcaaggaaaacaaaccagcagcagctgggataagctcagtttatgctattccctttctccacacagaaatacaggaatctttggaccacactcaatgtctactccatgttcttctcaaatgttttatgttgcccaccagcctcatgtttgtggacctccaagtggttcctcccaggtgtcccaaagttctctacccatccagaagaccaaaggatttcctgggtgaattgactacgtacagtcgctgagactgcataaaagctatcctaatttagtactaaggtctaccatatcatactttcctaacatttgcatgaaatcacagagcaaagcttataaagctatggtgcctactgctctatttcacatgtagtgtttgtgtcagtttcaaagattaaccactgccaagtgttcagaaaacaggccaggttccataaaacgctgccacatctcaggtgttgaggcaataattaaagagaatgaacgtcaatgaacaggtcagtaaaaggaacagctgattgtagggtaaaaagcagctcctttgtggtgaactggaggagccatttctgatagtcaaatgtcccggtcattggagaaatgtacagaccacatctttcaaccttccaaattttggttgaatttggatggtaaatatgggcttttttactaagtaaacattgttgcctgtaataacttagcaattgtctacattcataaagcatgaagacaggtaaacaaaatgataaaaactgaaggtaaaatagacaaaagcaaaagcacttggcaaaataaaagccgaaatattcaaatattggttttctcctacaagatcatgcgcccagactcaggggccactgctccaactgaagtagagatgctctccctatgaatctggcttctctggttcagaggaagtatcatgtctgtgaaaggttaattatcctagtaatcctatgccatttttcaaaaactgcaaagaaattgctttatagttggcctcattctgagatggtatttcagagtaagcatcctaccttaatagaagcaatatggagcaaagtctctcctctatgatttcttttcacagccatattgggcaacagcttcattgctgagggactagacatcactcgcctgtaacttgaactacttaatgtagaaggtggtgtacctggtgaaagactaatgaattcatcggacatgttactgtttttcctccctgatgtaccaccaactttacgtttgcatgaaggtggtgaagaacattcaggcaatggtatattttctgagggcaccgtttgcttaacaaaatctccactggtgctcagaatgctggttctacatctcttagaaatgggactggaaagtctattgtgatggccacgttttccattattttctaatggcaaagatttcttagatgtaagataatttttgcagaccttctcaggagtcactacttcattcctgctcttagtgtctggagactctatttgctcagccaatggtaaagagacttcagttaaacttccaaaacattcagattctgtcaaggagccacttgctagtaagtctatttcaccatttatctgaggactggagataacagatggttggctacagaaggataccagcttttgcttagattcctctttggagtcaaattcaccatcttctttttctgcctctaaattccatttttggttgatttcagctaaagttttctttttttgcttttttccagatcttgcagaagcctttttagccctctcagaaacatctgcaggaggacttggggaaacaaattcatatgagtcttgctgagcacttgcatctttttttattgcaggctgggtttgcactgaagctttactcacaacatatctgactttcttacttcgagggctaaaccacattttaattgaattcttcttgtttcctgcatcattaaacaaacttttcctaggtttatcttctttcaaatctgacagaaaaaaagaaaaagaaatctgttacatgaaatttattgctcccacatggagctcccgaagaattttgtttacagttcccctaaagtgtatcatcttttaattatgtacttctttctcagctcctagagtgtgaactctttgatagcagatattcactcattcaatacttactgaatccgactttgtgccatatcctagagactgaagatatagcagagaacaaaacatgaaacttatattccaaatatagtacccaaaaaaacccataaaatacaaatctaacagaatgtataagttctgtttgctaagaattacaaaatacttattaaagaattctacacaaatggagagatataccatgttcatgaactataacaatattgttaagatgccaattgttccaaacagatttacagatataacaaatcccaatgtaatttccagtaggcttgtttgtaaaactcgacaagcaattataaaatttacacggaaaaagaaaggtacaatttgaaaggcaaaagacttagaacaaccaacataatactgaagaaccaagttggaggactcatactatatgacttcaaaacgtatctctgacaaaatgaataaaggggattaaagacaatagtcatgaccctttaggtatcatctaatattaacgtcaagctgtataaccaaagattagtaagaataaatgaacaataactacatattcaaacataatctcttaagcaaaataaactacatacacattatatgttttcacttacatcaaatataaaacagtcaaaactgatttaatgtgttaagtcagaatagtagttggttacccctacagggaaaagtagtgactgaaagggagcacaagaggggcttccagagtattgtttttgttctgggtgagttcagtttgtgcaaattcattaaactatatggttagaaaatatatattttttctacatatatatatataaaatactttttaaaaatttgaaaaatatagatttataatcaagaattaaaacacaaagattccattgagggtagacagaatatacaaagattcagcagagtttttaaaaagaaaaaaaattgtctctatgtacacaaagtgccagattttgtgagagatactcttctttacactcacctgctactttaattaaggtcatcaaggaaggcatcaaggagaagttgatttttgagctgagatgtaaatgatgtaaaggaaacagtcctgtggatctcacatccaatgcagaaaagggatataatgttttatattgtagaattaccactctgactgccatgtggaggaggaactttggaaagaaaagagtagaaacaatagccaattatgtggctatcatccaagaggaaatatattggctctgacaagtgttacagtaatagaaatggtaaaaagcattctaaaagatcacaagttacctagaccaagaggcaagagcaagatgataaaatgttcaaaagcccaatagcagagagcatacaaagttgttcctccatattatcaggggactggttcgagaactcccttggataccaaaatacccacacactcaattcctgtactcactcctggagaagcagagtgtagaaaaagtcagccctctgtatacttgggttttgcattccatgaatactgtattttccatctgcatttgaccaaaaaaaatctgtatataagtggacccatgcagctcaagcctatgttattcaaggggcaactgtagtaagtttaaggaattaaaggatggccagtatacctcacttacagagaccacggaagaaagtgatttttaaagaaaatgtggcacatatacaccatggaatactatgcagccataaaaaagaatgacttcatgtcctttgcagggacatggataatgctggaagccatcattctcagcaaactaacacaggaacagaaaaccaaaaaccacatcttctcacttataagtggaagttaaacaatgggaagacatggacacagggaggagaacatcacacaccagggcctgtcagggggttgggggcaaggggagtgagagcattaggacaaatacctaatgcatgtgggtcttaaaacctagaagacgggttgataggtgcggcaaaccattgtgacatagatatatagaccaatggaacagaacaaagccctcagaaataatgccacacatctacaaccatctgatttttgacaaacctaacaaaacaagcaatggggaaaggattccctatttaataaatgatgttgggaaaactggctagccatatgcagaaaactgaaactggaccccttccttacaccttatataaaaattaactcaacatggattaaagacttaaacataagacctaaaaccataaaaatgctagaagaaaatctaggcaataccattcaggacatgggcatgggcaaagacttcaagactaaaacaatgtcctgaagtcttttactgcaatggcagtaaaagccaaaattgacaaatgggatctaattaaactaaagaccttctgcacagcaaaagaaactatcatcagagtgaagaggcaacctacagaatgggagaaaaatttttgcaatctatacatctgacaaaggactaatatccagaatctacaaagaacttaaacaaatttacaagaaaaaatcaaccccatcaaaaagtgggcgaaggatataaacagatacttctcaaaagaagacatttatgtggccaacaaacacgaaaaaaaagctcatcatcatcattagacaaatgcaaatcaaaaccacaatgagatatcatctcacgccagttagaatggcgatcattaaaaagtcatggaaacaacagatgctggagaggatgtggagaaatagaaacacatttacactgttggtgggggtgtaaattagttcaaccattgtggaagacagtgtggcaattcctcaaggatctaggaccagaaataccatttgacccagcaatctcattactgggtatatacccaaaggattataaatcattctactataaagacacatgcacatgtatgtttattgtagcactgttcacaatagcaaagacttggaaccaacccaaatgcccatcaatgacagactggataaagaaaatgtggcacatatacaccatggaatactatacacccataaaaagaatgagttcatgtactttgcagggacatggatgaagctggaaaccatcattctcagcaaactaacacaggaacagaaaacccaacactgcatgttctcactcataagtgggaggtgaacaatgagaacacatggacagagggaggggaacatcacacaccggggcctgtccgatggagcggggtcaggggagggatagcattaggagaaatacctaatgtacatgacaggttgatgggtgcagcaaaccaccacggcatgtgtaaacctatgtaacaaacctgcatgttctgcacatgtatcccagaaattatagttaaaaaaaaaaaaaagaaagaaagccatttgttctttccatagaagccttttcttccctctacctcttccccttaatttaggtttataaactcccatttttacctgtttggagagtcacatttttctgtgaactcacaagtatattcataaataaaaatctattttttctcttgctaattgttttacagtttaattcacaggcctccatacaatgaacctaagagtgtagaggaaaagtttttcttcattgacaaatcatacaagtcatccacttttctgattttgacgatcaactaccttcaagttgtcttatgttgtttttgtctttgggatattcattttcttcaagaaaaaaaaattgccttaaaattctctcccaccccatgacaacataggtaaaatcaacccagctcagcccagcacagtggtgagcacatgaatagacagtactcagtaagtactagtgaataaattatttgatatctcttaaatctttccaaatgtttacgtaagagatgttagaattaattttaagagctagaagaaaacttgaaaataatttagtctaattctttcattttaacaatgaaggactaaagttaaaacaaaaagaaggaaggagtcccctaactcccaatctggcactctatctctccacacaaactggattagcaaaaggtaatttcaggcccagaaaaaaaaagaaagaaagaaagaaaaagaagaacattagaaacggaggaaagttggaaaaataacaataatctgataagattaaaaacagtaattaacaaatgatttcatgctgcctgacaaacattctcctaattaacacagacaatctcctctgaccaaccaggcttcttacaatatgttttgttattcctattttaaaaagaaagagaagagagagagagacagagaaaaagagagaaaaagaaactacccaaattttgttttcctccttaagtcactcttcattcaaatcgaaaagaactctgcataaaactttacctacattacagaaccaaagaaaacttttaatggaatggagttctaaacctaaggtactttaagaagaaaaccagtggccactagtcttattcctaagggatataacatctaccatataggaaataaacatctgatgttacaaggtgttcaataacattttcaaatggtgattattactgagaacttttaatacttaagagatacaacattattttcattttcttacgttttggggaataaatttcttttcaacattctcatgtctttattagcaaaagaaaagtacatcatctattattttttatttccttttagtcattttttatccacatagaacagcttgttttattgttttaccagcttaaaattattaatacaccagaagattgttaatgatcatctcaattctttcaagttcaaaattgcttcttctgcctattctttcacctcatatttcttgagtacaaaagtcctatcttcaaaaatatatttacctggtaaaagaaccttaaacaggtaagaagaaatgggaaacaggctttgaaaaataaaataattagtacttaactctagaaatttcagacatggtccctctctagcaaaagagtaaagattttctactccaaagtgtaccatcacttcctgcagatgaaatggaagcactacactgaaaagacagtaaaatgataaacctactgaaggcaggagtatgtatatgaataagggcagattctcctacataaacttttaaatatcatagctgaacatgacctggtccacaaagtgttattaagacaggatcttggaaagtatcagaatgacgtatccattcacatagagactttatgtctagattcaacaaggtattttctttgcagtggtaagtagatttcaaaaccaagtcacttctgatataatctcaagtctataggaaaggtcaaaatgaaatgttaccaggattacttttcaagaaagactcaggattacaaagtcataaaggttaatcctctgatagtctgtaataacttgtatttgatttttttttaattattttaaacacagatgacattttcaattaaaaccatgttcaaaccctgaggttctcaatttttgaaaaactttaaaaatgtagaattgagcttttaaaggaaaattaaggcttatatatagcagcaacatactcaactgactaaaaaacctcaatataaaaagaagaaatttcatactcaggtgtacatatttcctaccttataaatgagtaaatgaagataatatactcaatgtaattgatatgaacacaattttactattcatctggtaataataactttactcaaaagattttaattatgtatcttgcataactaagcaaggagcacaacaaagatgactgtatattctgaattttattagatattctgaatatctaagataatattctaagataaaactgtaaaaagcaaaacactattgctggaacataaatcacattattaacagctaccaacaatttttatgggtgaatgcttctcagcatgataaatcaacatattcatttcatgaagaaaaatactggtccttcctctgcacagaaaattccttaatgataatatttaaaagaattccattctctgaatttcagagtacatcacaaaatattgagtaacagagatgcatgtgttactaaggagctgcttggccaagttttttcttacaatttaataatcaactatagaaaaaagaggcaattagaaaatgtgatttagctatcattaatctacatcaaaggattataatcatgtacactgtgtgcctttcaagttattctctattataggtttcacaacagaagttgagaaatctctttgacgaaccagtcccttattaaaaatcaaaggaaagtcctttgctaccatctgtgcaacattaacgccttcactgaagaatgattattttgtaagctaggaagcatttagtactatttaagaaaaacaacagcaacacagctattcaaacattcatcttcctctattataaaaaagtcatagcatatatgaaacactatgtaatcgttacagaaagacgagcatctctctctaaagcagaaaatagaaaaggaaattgtaatactataaaagcataatcaaagtattttttttttaatgtcaccaacaccgacatgtttcacagaacctgaccagcacctgcaaggtctgacttaatatgatagggttgaagagaaaataaaaacttttaaatttaactccattagtaaaaagaagatcatgttataaaggataaggtaaaattatccataaatggttgtcagcaaaatttgacaatctcctctttaaagtacactgaaccaagaaaaatctgttcaagtatttagaagctcattttagaaagtattactacaaattaggcttctttatctccagtataccatacactatgtccatgatttgacaagttcttcctaattgcccaccttaattacagtaattatatatattatagtaaatgcaagtaacaaggttcatttgaaagataaattgtgaactacagggtttttaaaagagaaaatgtgagagatgttcaccattccacttaattcatcatcttctacacatgaccatttaacagaatcatacaattttggagagacagcttaggaatcacttaatctaatacccttatcctaatgagatcattttccaatctccttactattataaagaagaccaactgtcatttgtccccaactatcagttcctggtatatagtttaccttctaaccttttagttctagaagtacttactagataatcaattaccacaaaggtactgcgtaaaatacactgaatagacaaactataaagaaacaaagggaaatgttccagaaaaaaatctcaaatgcccttcaaggctagtttgttttgggaagaatttgggatgaaaagttgggggtctatacaacttatattaaagtagaaaaagctctacaccatggaatttagagatctggacagaaggttataattcagtatgtttatactctaaatttattgtcatttcctatcaaagtagcaaagaaagatactaccattataattttttaagaaggtctatgaatgcatagatgttatcattatgaaatgaaattatttaaaccaaattctaagaatgtattttaaaattattttaattaggtcaggcacaattagctcatgcctgtaaatcccagcactttgggaggtcgaggtgggagaatcatttaagccaggagttcaggaccagcctgggcaacacagcaagaccctatcaccctatctcttctaaaaaaaaaaaaaattaattggcagggtatgtggtggtgagtgcctgtagtcgtagctacttgggaggctgaagtgggaggatctcttgaacccaggagttcaaggcttcagtgagccatgatggccccaatgcactccatcctgggcaacagagcaagacactgtctgtctcaaaataaataaataaataattttaattaagtttagtctctagcatataaattagcactgccaatttttatccaactcaattcaacaaacataatgaatacctacacttcgaaccaaaaagttgtgtaaaatagaaaaacagtaagaaatttacaacacaactgccctgtgtagcctgggtcctcagtttccttacctacagaataacgggattaaagatgaccttcgtgttcctaaatttctgattatgtgttatctaaacagggaacttcaactcagtttaatataagtaacgttgagggcgcagtgcttaagtctggtaaggactaaaataattattcctaattataataaggaaaacaaacataaaatggcctttgggaaattaatcagtagaattatctctccaatctccaactctacttagatgagaaagaccgcattcttaaaggcctcagaaacttgttctaaactcaattttcctaaatatctttaatgatgaaatatgaagaaagcatttcatattccatagtcctcaaaatataaatgattcaaacatcactagctagaataaaatttctggaaaggagtctatcttactcttttttgcacccctatggtatgccataactgacaacggtaaatccatcaagggttaccctgctctccatttatcatcattaaaaatgttatattgttataaattgtgttcctcccccaccaaaattcacatgttgaggtcctaaccccccagtaacttagaatgtgactttacttggaaataaggtcattgcagatgtaactagctaaaatgaagcgatactggagtagggtggactcccaacgcaatatgactcctgtcctttaaaaagggggagatttgacacaaacaaggagaaaaccatgttaacataatgatggccatctacaagacaaggagactggcctaaaacaggttctgtctcacagacctcaacaaagaaccaaccttgcatacactttcatctcagacttccagtgtctggaattgtgagacaataaatatctgttgtttaagccactcagtttgtgatactttgttacagcagttctagcaaatgaatacattactatacagcaactggtgaagaaccaaatcaaaatatcatcatagccacaaatcccaaagtagcactccaaatttcagtgcaaagccaataatcctaacagaccacacactcctaagaatctaacaaaagtcactttcacacaaacatgaacagttttcatactgcacaattaactcaagaagctcactgatcccttacccacttcaactctgaacactgccaaaggtgcatgggcccttgattaagaacccctgcactgaccctcggtatctatgtggggagagaaaggtagatcacacaccaatctcttttaactagaaaataaacattgtcagtactgtctttaaataagaagagttcagatgaactaatgacagaatttttcttcagtgtgttcttaaaaaggtttacaactacaatatcatttttaaaaaacggcaacttttaaaaatgtgtgtgtatagttacatctgaaagtaagaaaaacttctgcactacagcacattttatcataaaagaatggagttgaatacaatgacgcagataactagctgaaggaaaattttaataggtataaagtgatttaagttctaattcttaaaaatatggacctgtggtaagactcaaagtttttgccacatttatttattttgtataatcaacttcatctttagctgacaataagacatcatggcaggattctaagaacaaaagatttaaaaatagaaatctaacaattttatatgagcattatcaatcatccatggcatcctgccagtcaagaacacgttcttctacaaacacacactaaaatagcatgatctggtcaataaaaagacaactctaatatccaattatgaagatacaaaacattttactttctttccacagttaattagttctcagcagaaagcacaatggaaagatacacagttaatacacagagtctaaggacaatttaaaaaacgttaacccccacttaaatagaaaagaaaatgaatattagatttctgctctttcaaaatgtgctcatctaattaattcagtctagaaaagtgatccatggaaaaatgtcgtattctatcttgggaaagtgtatttaagtgagttaagtgctattaaggccaaaatcactattccatatatattctgcagaagttatcataaatgtaaaaagcaggcaatgtaaagcagcaaaaaagttcctggatttacagtcagaaatgggctttatttctccagcttctagtactaactacacatgcggctgtaggcaaggttatttcacctctctggaccttgatttctcaactataaaataagggggttagactttaattatctctatggttcccgtcatttctcaaaatgatcttccaaaaaaccaccgggtgtgtcacatgcatgtaccagggaggctgaggtggggggaatcccttgagtgcaggagttcaagtccggcttggacaacatagagagactcaatggctatttaaaaaaaaaaaaaaaaaacctacagattttaaaatctgaaatacgtattccagaactccagatagatgttttatatactttatgaatatgaattcatcagtttttaactgatgaatttaactaagagagatagggatagttcttacctgacagctcattgtcatgtagcaaatttcgaagcttactacaaagttgaatcatgctgtccagttgtctatttatcttcaagtcttgtatccaggccggggtgtaacacactggacatccagttccaatgcagtcacttacacaattactttaaaataattaaaaaaaaaaaaaaaagcaacccattcagcagaatttaattccaaaaactaaacagtttgaacagaaataaatggagcagaggttattctaacatacaatggtcaattgtaatatccttgttgaatactgttttaaagagtaaaatacatacatcaaatctaaggttgctcatgtaatttgctatgaagagactttacttagcctgattattagtctgcataattttccctacaaataaatctgtagcttctaaaggttacagagatgtaacagaaagatagaatgcctaatgcatagtagtcgtgcatcctaactttttctatcttaacattgcatgaaaatacccaaaactactgcagacactgggaaagaccttctgttttgttttgggactagtatctcaaggctttaaagtagcttttgggaaaagatctttgactttttcagacaattttaaaacctgtagactcaattacctgggttatctaaggactaaagtttcagagttagaagagtttttctaattttggggtttatagaccttttgcaaatctgatgaaaatctatacatactcatgtaaaaagagggattcacgatcccccccacaagcccatctgtgaattccagaataagaattctataaatctcctccttcattggcctcaccagatgggttccagtaggactgagtaagtaatgtaacagttgaaaagccacatcttccccaagcaccacaggacattccttgtcacaggacccaatcctctgtaggcagagaggattcttactcaatatgaactatcctcaaacaaaacctatgccatttctaattcttgtatccttggcttctagcatgatttctgacagaatgtaactcaaaaaaaattgtaaaatgaatctgtaacccataccagagctggaagagacttttgggaccatctaattcaaaaaatgtcactggggtcaataaatgtcaactttctttagcaaaggatcttctgtacatttgtttgctagtagttaagaactctaacttggaaccccaacacaaaaaaatatgtaaaactgattactcatgcaatttaaatcatttgtgcaatacttaattatcagtaaaatacaatctgaaatcaactcatcaagaactaccacctcatttttggatgaagaaaatgagatccagttatttaagttacttgtccagcactgcactagtactcagatcagactagtattttatatttctataacattttataaactattcccaaattattttatatacattaatttggaattctgaaaaaaatgtcatttttcggtggacctgtatagctcagtgagtatttctcaaatgacccgtgtgtgatgtcataaaatcatgctgagtaacagataaattcaaagtactagataaaccaatgaaatttcatgtaacagagtataaaaatttattgatatagtttcagattccacactgtgatgaacctaaagaaaacagcacttgttggccaggcatggtgattcattcctgtaatctcagcactttgggaggccgagacaagagaatcgcttgagcccaggagttcaagaccatcatgggcaacatggcaaaaccttgtctctacaaaaaactacaaaaattagccaggcgtggtggggtgcacctgtagtctcagctactcagaaagtgagattggatgatcacccaagccaagaagttgaggctgtagtgagccatgatcgcgccactgcactccagcctgggtgacagagtgagactcttgtcttcacaaaaaaataaaaataaaaaagcacttgtcaagttttggtgtagtattaaagaagaatagccacaattatctaaaaaagctactgaaaatacttcaatacttcttccaactacaattatgtataaagccagattttcttcaatcaaaaaagtatcacaatagactgaatatataagttgagaatgtagctgttttccattcagcaagacagagatttgcaaaaatgtacaacagtgccactctatttttttctttgatttgttaaaattgttatttttccttacaaagtgttatttgtgtttgtattaatgggtttattatttttaaattaatttttttaaaaagtctcagttttgtacggtaaatgcatgaacacacaaaagctctttatggttctcaattctgaagaatgctcaaaatgtttgagcacccctgccacatgtcttaaattgtatcttagagagtagatgaattacctttatcagttgaactgagctatgtcaaatcattttaaaacctcattgctgagcagttttaactcaaaatctgcatgaataaaaacagctaccataatttttggcatcatataatcaaaacaaatcaaaactgcactgaatgaattctttcctacgttcatgtcatatacacataatcattttctcttttaagatgttctcgtgtctcaaacctttgattggttgttttaagtcacagagtcctttagaatctgattaaacgtatggatcccccaccccaccacacacacaaaccaactttgcataaaatgtcatggagttcattatgctctagcagctttgtgactgacctattgtatacagtgagcaaacccatcatctgtcagctgaaacaaaatacatctgcttgctacagagtggggacagggagtgggcatcatttcgtaagcagatccatgggaggcgttttggaggcagtgacatttcagctgatatataactggtaaaaagtaagcctcacagaaatctggcataagtacatttcacgtggaagaaatagcaagtgccaaagtcctggggcgggagtgaatttggtgtattgaatgagctaaaaggagaagtgctggaacagtgtgagccagaggtaaatgacgtccaagaggaagacaggttctaggtcccatacagggttttgcagaccagagggcagagcttggattttattttaactgcaataggaacccactaaagagtttaagcagggtaatgatatggatattatcgtgatttttcaaagatcactgtcaagaatgtagaaaatgaggaaggggtgatgatgccaaaaagggaagaccagctatgaacctatcacaatagtatgagcagagataatacaatgatggcttggaacaaactataaactgtagaaaattcagaaaaaaggtggaaaaattcaagattcaggacacattttgaggcagaactgacagaacttagcgatgtgggataagcaacctagcagtaactggtaccatttactgtgatgaagattacccaggcaggaaaaggctgaagaggaggatgatcaagaggtcagctctgaacacaccaactttaaaatgccttttctttcatcatccaaacagacgtatctggtaggcaacaggttccatctcctaccccccatcctcctgctggatatccctcgtataacagatctgtttttccaggaacaaaattgggacccaaaacatagctgcctcccagacaaccttagcccttgaagtaatacacaaggttattttcatatatgctcaaatttccgaatgtatttgttcatgtcagacagtaacatactcataactggaaataattaaaagattaattcaaaggagactatattttccctgtctcataggcaattaaactaagacacttaatctctcaactgatttctcctgaacaagaaataagagataaaaatctaatcttctgacctgtaagccagggccatcacatggatataatttcacaataactgttatgcactgaattgtgtcccccaaaaagatgtttgagtcttcacccctcagttactgtgaatgtgacctaatttggaaaaagaggctctagacgatcaagttaagatgagaacattagggtgagcccttaatataagtggtattcgtatgaaaagaggaaatttgacacagagagaagcaagcactcaaggaagaatgccaggtgtacatgaaagcaaagaccagagtgatacatctccaagtcaaggaacagcaaagattgctaggggaaaggcaaggagcagattctccctcacagcccacagaaggaaccaaccctgtcatcatcttgatcttagactcctagcctacagaactagagagacaatacatttctgttgttctaagccacccagtttttggttctttgttatggcagccttaggaaactaatataataactgtaagacctatactttcacaattttgagtctagattcaaaatttaactggaaaatttaaaaacatctatttgaattatataaaaggcattaatttttttcctccaatttggcaaagctgtctactaagctttgtaacttggacaagtcatcctctttgagctttggttttcttatttgtaaattaagacacagttttaaagatcaaactaagataatgtacaataggttactttgcagactttgaaagttacacaaacatcaagtaccattattatcaacaagattacatgattgttatctagtaaaaaatacagttgtactatatacatcaaaccgtaattacttacctacagaagatgtgctcacatcctcctaaacacacaggctctctcagaatgttagtactgtttgaagaaattaaaacaatcaagatttgagtcattgttagataaacatctcacacccaatatttcatccaaggcccaacactaccatatttctcactttctcaaagcagaaggtattaaggatgcattcatttgaaaggctgttactccctggttaaatattgtaccataacatacctgatgattttaaatagtaaccaccaaactgggtacaagttgtaatacattttaaaatgtattttctagaaagttggagaaaggaacaattttgttcaagtatctctaaacctcttaaggcaaaaccaactactggctgcttctttcaactactaaggtgtatcttccccttatgattcaaagtgtagaccatatacctcaaaatgtgtcccacacgtagaatgaccatataacgtatcatccaaatgagaaaacttctgagagtgaagaggagtgataattgaataggatgctgggacaacaggaataaaccaggactgccccagacaaaccaggatatctagtcattttgaccgtaagaatccaaggtttcccaattaaaaaaaacatgtgtttcttactactgtaaagtagccatcaatttttcacagatatattgtgaaaaatgcagccattctttcagttcacagaaagttaattgttctttaagcaaatgtaaacagaaatcatcagattagcagtgtgtctgcagatagaatgaagttccctgcagtgagtgagcaaagagacacagaaacaaaatatttctaatactgtccatcaaaatacctgctacatttgttaatcctaacaaagtaatgatactaataaatacacaccaagacattatactcaatggatgtaatgtacccagagaagtaaagccttttaaatgatgagcactttttctgcttggtttattatactaactctaaaacctttagatatttacaccattattattaaattacctctgtacacataccacgtatcaataaaaacaattcttcacatttcttgaaagattgaaagtatcacactgcacatcttaatagatatgaacattcaagtgaaattgagattttcagaaagattgcgaaaaacagtacacacccacaatgttattctcaagatactgaaaatggtgctcactgacgttacaaaacctattactttttaaaaactcaccatgtctgatttttgtatcacagtatgtaaaacgtacagataaaaatatgacttgtgactctgccaataaacatgatctcttttaacattcatactgtgtctataatttttgttatttgacctagcaaacctaacctccttttccccatcaagtgtactgaattctatttcgtggcaagctcctcctatcataatatccttcctttacctcttttattacatcgccctggccaaacctccaccttcaggttgctctctaccttgaaagaagtccattcagtttcctagcaccttggattccctatccagcccaggccagagttaactatttccaagccaccttcaccactacctaattgtgctgacctcttagacactcatggatgccaatctataatgctagataggccccagagtctacttcttccctgcccactcaggctgcgaataaccactattaaaaaaagaaaaaaaaaaaaaaaaaaggaaagaaagatgaataaacttctctctataaattcatttggtagcaaccgggtactgaggctcatgcctgtaatcctagcactttgggaggccgaggtgagaggatcacttgaggccaggagcttgactggcctgggcaacatggtgaaaccctgtctctactaaaaatacaaaaattagccaggtgtggtggtgcatgtctgtaatgccaacaacttgggaggctgaggcacaagaatcacttgaacctggaaggtggaggttgcactgagccaagattgagccactgcactccagactgggtgacagagcgagaccctgtatcaaaaataaataaataaaattttaaaaatataaaaattagccaggcatggtagtgcacgcctgtaatcccaggaactggggaggctgaggcacaagaatcacttgaacccaggaggcacaggttgaggtgagccgagattacacccctgcactccagcctgagtgacagagccagactctgtctcaaaaatattaaaataaaataaaataaagacataaaatttatttggtagcctcttcatgtttgtatctctaccaaagtaatgtattcaatattctataaataaacaaacaaatgaatagatggctattcaaaacaatctctatgcttcctcatctcattaactttactggaacttaatggtgtaagttttttaacacctaaatacatttttatctcttcaccagtcatcttacccttcctagagtctaagaggaaaattcgatctcctttagtcactcttcctaaaatgtgctactctacctatagttcccatatcttttctgcctcccaaagcactagatattcataatacttgcctttcttctctcatttgcatctacacatgaacaggtaatctctcctttgacacagaaaaaacacagttttgatcatacctcccattctaccttctgctccatctcttccctttcttgaacagataaaagttcttaaatgagtgctccataccagctactcccatctcctcaccttcctagctttaactccctccactctgctgaaactgttctccaaagcatttttggtccccttctctctgaccactctgggaaacagcactgacctcatcttctttcctgaaacctttccttccaccgcattttaatatttttatacacattgatctgcctatttcagcatttccttagctgcttttcctacctctccatgtaggcatacccccaggatgcagtccgtagccttccggctttctctggcaatacttgactcaacgccttgattctgtttctcaactttaaatttccttcctaagatgactgaactctttagctatagttcttaaccttcactctagcaataaggtgctatcacatattagtaatgatttaacatgtgggaataattgatcagttgtactaattattctaattagtgagttagaatatatatttgtgttgctgttaacggataaggaaagataatggaaatgtgaatgagaagtatgtgcacttgtgtgtattgggggagggaacaagaaggaagtgtgtgagccaagctgagagagaagggagtgccaaattcagtggcacatgcctgcaatcccagctactcaggaggctgaggcaggaggaaagcttgagcccaagagttcagggctatagtgtgccatgatcgtgcctgtgaatagccactgcgctccagcctggacaacacaacaagaacatgtatctttagaaaaacttttttaaaaaattattacaactaggagatacctatcaagaatataaatgcatccaactttaactcagctattccactgccaggaatttgtccttcagcaacactagatacttgcaaaaatgaaactttcaaacatcaaagatatctagacaagattctaaaaccttccagagatttaagaaataataaaattaaatgtcatactttttttaaaaaaaggaatcaggatagcataagacttctcaagggtaataagagatgctacagaactgtggaacgaggccttcaaaataattcttgacaattattttgtactttgaattctacatccactaacttccactgtcaaagttaacagtagtaagaaaattcatctttgagaatagttaggaagttaataacatctaaaatggaaaaaaaaataaatagcaatataaacatatttggaaatgtagaggtacatgcttgtaaaactaaaaaaaagacaaaagatgtttctgatgcatagaactcaggggtgatgaaggatgaagcaaagaatgttttcattaatagtctgtcctattgactctgtcaactacgttcatgtataactttatttaaaaacattttaaatgtaaaggcacatgacatcagtatcactccagcactgcttgttacagcaaaagaccacaaacaacctaaatgtttccaataaggaaatggttaaatgaatcatgcaacaactacatggtgtttagtatctgcttatctgaggcagtacaatgcttatatgaacatagaacctcttgaaggatacacaagaaactgataattataagttactgaagaagattcacacttatctgtcgttcatttaacaaatactgaatggccatatactgtgttattttaattcttttcacacactgtttaccattaaaaaaaaatttactattaaaaagttcttcacaatctgtaacacctaagccatgcaaccttttctctcattgctcctcaacaaaaactctgctgtggtcaggccagtgtctcttacaactattattagcctatgtccatctcttggatttcagcctccagccatcacttctgcaaaattcatgccatgtaacatctaaagaacaaagttgactgtgttccactcttttctaagggtcttataatctggccaattaattacataaaccaaattaatatgacttaaaagatgtacaaaatgctctaaagttacaaagaagagagcatctagttggggttctgggattcaatgttgaaaaccaaatatttggcgggggggggggttgtttttgttttttttaaaacaagatcttgctctgtcgcccaggctggagtacagtggcatgatcacagctcactgagctttgaactcctgagctgaagaaatcctcccatctcagcctcccacatagctgagactacaggtgcacaccaccatacctggctaattttttgtagaggtggggttttgccatgttgcccaggcttgaaaactaaatattttgtacagatgatccctgactcacaatggttcgactcacaattttttagctttattatcctgcaaatgtaatacacattcaatagaaatcacactttgaattttgatcttttcccaggctagcaatatgcagtacaatgctgggccacagcaggaagtcattctgtttttcacttttagtatggtattcaataaattacatgagctattaaacactttattataaaataggctttgtgttagatgatttaacccaactgggctaatgttagtgttctgggcatgtttaaggtaggctgggctatgctatgatgtttggtagggtatgtatattaaatatatttttgacatacaatattttaaacttactatgggttgatccagacataaccccatctcaagttcaggagcatctgtattttaacttcctgattttctatttctcttgtcttgaaattagactccagccctaagacaagagatcttaactttcattttttctgagctccccaacccaccattacctacctagcatggtgctagattaactgcaggatttcaataagttcttagtgaatgaaccaaatggaagcctatatacaaaaatgcatttgtattaacaattccattttatccttaccctattttctgtttgatatacatatatattagatagaaaaaatccaaacaaataagagaagacatttgcatggtaacaggatttctgtaccttgaaaattcagctactctactttttccccatctacagtcatacttctgtaactttacatgtagttgatttagaaagatcagtgtggggaaaagcaagagagatcagattgttactgtgtctgtatagaaagaagtagacataggagactccattttattctgtactaagaaaaattcttctgccttgagattctgttaatctatgaccctacccccaacccggtgctctctgaaacatgtgctgtgtcaaactcagggttaaatggattaagggttgtgcaagatgtgctttgttaaacagatgcttgaaggcagcttgctccttaagagtcatcaccactccctaatctcaagtacccagggacacaaacactgcggaaggacccctgcctaggaaagccaggtattgtccaaggtttctccccatgtgatagtctgaaatatggccttgtgggaagggaaagacctgaccgtcccccagcccgacacccgtaaagggtctgtgctgaggaggattagtataagaggaaggcaagcctcttgcagttgagacaagaggaaggcatctgtctcctgcccgtccctgggcaatggaatgtctcagtataaaacccgattgtaggttccatctactgagatagggaaaaaccgccttagggctggaggtgggacgtgcgggcagcaatactgctttgtaaagcattgagatgtttctgtgtatgcatatctaaaagcacagtacttaatcctttaccttgtctatgttgcaaagacctttgttcacgtgtttgtctgctgaccctctccccactattgtcttgtgaccctgacacatccccctctcggagaaacacccatgaatgatcaataaatactaagggaactcagaggctggcgggatcctccatatgctgaacgctggttccctgggtccccttatttctttctctatactttgtatctgtgtctttttcttttccaagtctctcgttccaccttacgagaaacacccacaggtgtggaggggcaacccaccccttcagatcagtgctgtcagaggataacttagggaagaattaagtagtgagaacaattttttttaaagttcttactgatacaaaattttcttcgaaaagaaaaaaaggaaggtaaatccatctgagatgataataccaaggcagatctatttcttaatagaatggctcccctgtatctccatgaaatatcaactgctatttaatattaggcaagacagctcccaaagtgctcttacattttaaagaatcctcaaggtaattttaacgtgtggaccaacatgttgaacatctaaatgtgcaggctcaccaagccaattaaacaatttttcttgtgtttatctttagaagaataaagtgtttaacaagtaaagtatatggataatgacatggaacctataggggattcttagcaattcatgtaaattaactagatcttctggtattaccacttgcaaaggcccttcaaatgtgatcctaccttaacctaagttctttcatacatcaatttaacatacactaagaaactatgtgtctggcattgtggctacaaacgtgaacctagttttactaaatatataactgaaggagacagacatcactcaaaatattccataaataaataaatctcacaaataaattctaacttggaagatacgatacaagctgaacaccaatgatttgtgccttttctgtatgtatgttaaacttcatccagtggacacaaataactatgaaatctgcaaactggagagaactttacaaatcaacgagtccattttcctcattttatagatgaggaaccagagtccaggaaagctatacaaattgctctctttaggaagttaactatataaaccaactgagtattctgttgttaggctactatcactgatttgaccctgtcttaactctctgttcacctgacccagtccccctttaccctacaattctttatagctagttatttgcaaataacacccatcaccccagctccctgcaacctggctccattttaaaaatctattcgcatctcggcctggtgtggtggctcacgcctgtaatcctagcactttaggaggccaagaagtgcggatcacaaggtcaggagttcgagaccagcctgagcaacatggtgaaaccccgtgtctactaaaaatacaaaaattagccgggtttggtggcgctcacctgtaatcccagctactcaggaggctgaggcaggagaatcacttgaacctggcaggcggaggttgcagtgagccgagatcacaccaccgcactccagcctgggtgacagagggagactccgtctcagaaaaaagaaaatctattcatatttcaatttaaaagcccatgaagcttccttccactggccctacccaagtactcttctcagcactatgtcgacctgcacgacaatttaccctgaacttgtatttattttatcccttataattaagcatacactccttaaaggcagaagtagaaaatgcatcaccttatcaccccttacacagtgtctcagtgatttctcgttattctaatgaataaccagtgccagggagaaatcattccatttggggatcactgctctgtgagaatgcctctgaacattcaaaactcatgaagaaaggcaaaagctgaacccggagtcagagaacctatcctttatttcacaaatattcatatagtatttagtacataacagacacagctcaaggcatcttatgaatatccactcattttgtgcagatgaagaaaaggaagcataaaaagataaaataacctaaataatggagccaggatttgaacccagggaatctaactccagattccacacatttaacatctacactatgctgcctcaaagtatgagagaatacaaaattaagcttgatcatctcctaaacaagaactcagaaaaaaaaaaatacctatcataaaggttaaaagattactttctaacttttcataaaaagttgattaaaaaggcccacgttacaattgtcatagatgtctaatcccactctcaccctcaaaaatatgccaagaggtacctattaattcacaaaacagtgttatatgacacctggggcttctacactgcagctcctattaccatttcctgcttcctttaggaacacattattactgtgctttctgccagcctctcaaataatatggtcttcctgtctcatttttccaaatccttaaatagcttctttctggttgtgaggcttggtcctaatataaatgtcacatctggcctcttgaacactttcatcggcttcaccttgaagccagattcatgttaaaggtcaagaaaggatgcccggttatgtaccaatccaccctcaccagcaagtaatgcttgctgcaaaacagatccatgtgcaacacaaggcagatgtcagctgcaagctgaatgtgagggtaatcggggtaatcactagcccactgggtagaactctgaaactctgtaaaaggacatactgacacaatttcaaataatatgacactgctttgaatggagggtagcaaatggaagaagcagaccattctgagttgctccttgccggcaatgtcaggaggctaccagggcaaaggcagaggtaggaacaatgcttttcctccttgagtaaggtgcagctggccatgcttttttcactatagatagtgccaaagttgcagagacacctacagaggaaagcaaaatcatttctaaacattaaagcccatgtaaagaccaggcatggtggctcacgcctgtaatcccagcactttgggaggctgaagtgggcggatcacttgaggtcaggagttggagaccagcctggccaacatgatgaaaccccgtctctagtaaaaatacaaaaattagccgggcatggtggcatgcacctgtagttccagctactcaggaggctgaggcaagagaattgcttgaacccgggggaaggaggttgcagtgagctgaaatcatgccactgcactccagcttgggtgacagagtgaaactttgcctagggaaaaaaaaaaaaaaaaggcaccccatgtgatataaaattgtataccaaaaaggatttttaaacttgagacattaagtttatcaagactttatcgacagtttagcaactattgcctgtgggccaaaccaagccagcagtctgtttctgtacagcccttaaggaaagaatggtttttacatttttaagagatgtaaaaataaataagaacaaaaactatttgcgggcagaaaggcctaaaatattaattacctggccctttaccgaaaaaatttgcagacccctacatgaaaacatgcagtctaagagttaagattcagttcatctatagaggttcggattaaaaaaaaaaaaatcaatagcattcaatagcattctgtagtcaaatgggtgagccatgctaaaagtctgggcctggttactgatgtctgtttacactccgttgcctcttactgtctactcacttcagttagaaactggaaaaatatttggtaggggataaaaagtgaaaccggctttgttatttttcaggacaacatatattcatatatattatctattttgtctctcccaaatcatgtagcaagcaaacaccacattcttttagattaagacacacattatttatcatttattctatcacaaccaccaaactcaatactttacatacatgtaaaatttcattttgtttcttccataaaagctccctaagagatggaatttattgtctgctttgttcactaacaaatccccaatacccagaatagggtctggcactttatgggtgctcaataaatttatgattattaatgaatcctcacaagaaaataagctaatcattagtattactcatatccggaaaatgagagatgaataacttggcctactcaatagtgtcaaagctagaacctgaactcaggcattctgaccacagtctaagtgaagcccgatgcttccacataggtatgtgccaagggaatgtctaactttcgttggactatcaaggtgtgaactataatgcttctgttattgcaactagcagtgccagttttaaatttcctattctcagatgacccatgtgctacaggaaaacaaacacacaactcaaatgtcttcatgtactcacttatctgagtgtcacttttctaagaagtgcaatgtcattttgtcacagatattaaaagttttcgtcaaagaaaatataagtgcaaaactctgacagttaagtccttttcatttttaaagaaaaagtttggccgggcaccgtggctcacgcctgtaatcccagcactttgggaggcagaggcgggcggatcacgaggtcaggagacggagaccatcctggctaacacggtgaaaccccatctgtactaaaaatacaaaaaattagccgggcatgatggcgggcgcctgcagtcccagctacttgggaggctgaagcaggagaatggcgtgaacccgggaggcggagcttgcagtgagacaagatcgtgccactgcactccagcctgggcgacagagcgagactccgtctcaaaaaaggaaagaaaagaaaaagttgtgttacttatactttatgcaactaggtaacttaagttctgcaagttagaaatcaaaggggaaaaaagtccaaaaaggatataaacttttgacagctacaaataacaaaaaaactgccagtgatcttcatacagaaatacttagctgtacacacagcaagtgctcaataaaaatgcttttcagaagaaatgaaaatgagacaaacctttcttgggttttacaaaccttcttggtttgtatactagaaagagctacacgaaaaaaagcaagaagtaacactcatgaaaatgtctttggacggaatgaaaaccctgagaggactcccataatgtgacagcatgaaggaaaacaataaacagcatcactaagagcggggacaccagacatacagtcttttgagcaaactaagaaaatgagaaattccgtgccatcttcaatctacaactatggtagatatccgatgctccatcccatctcactcgaaaaagctggcacggagaaaatgtcaaaaaggccagtttaacttagagtggcagctgcttctaatttagagggtctccggggcggcccgccagcccaattcgccacagctcccggaaagcagcggggtaatccagggccgggtaaaaaatgcagaagcctcagccccaccccagcccgattcaaactctggaggcgcgaccgggatgaacatttttttagccacacctccagacggttcttcagcccgctgaagttcaaaaactaccgtttcagttggattcagggcaaggggaggccggtaagtcgcccaaaaataaagtgaatgagaagcagaagttgttaatactatatcccccggcaggtgctaaccgcacgccgacccgactgcagcgcgggaacggaaggaggaaacggaagatttgaaaagattctgccgcccccagaaactgtgcgacccgtgccctcgcagccacccccaagaagctccgtctttaccaacgcgagcagcgcagcagcttctccaggcggtcgagcgcggcgcgactgtgggcccaggcaccgcgaccatccggttccatggcgggcgcggaacgaggctcgttcccggagcggatcctcggctgccggttcctcggctgccgattatccggcatcgtcccgccttcggatgaaaggctcctcgcagagcgggaagcaaggaagcctcgggaaaccacagggaagctgcaggccagcgactcgaaaccggccaagctcttcccgcgtctgggacggcgggccgccagagg

SEQ ID NO: 1508 - DNA, 212448 bp, Homo sapiens
cggaccctgcgcgcccccgtcccggctcccggccggctcgggggagaaggcgcccgaggggaggcgccggacagatcgcgtttcggaggcggcgcaggtgtgtcaggggtgggggtccgctggcatctctcgtgccggcgctgggggggtctcccgtggaggaagggctgaaggtgctccgggaggggtccactcgttatggaaaggaagcggggcgcggtcagggtccctcgtccgcagtgggggtggtccgggcccctcagcctgcacccgggaggagacgcccccttttcacgccccgcccccggtggccgaggccggattcggacagctcggggtcagtcgacggagcacaccgggcgcccgaatccgccgggtcccactcacgcccgccggccgccggtaggttggccctcccgcttccagcctccgccaccccatccctcgctgctctctgaggaggattccagacccccccgtagatctccgccctctctcgggtggggctccgaggtctagctggtctgggggtcagtcccggcctctgtctcccaccgcgcccctcgctcccctggacaccgcctggtgtgtggggctcagacccccccagtccactgcccctgtgtggctcctcctctcaggagaggattctagatcccagcccggggggggttccgaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtacccccgccccagacggccagcagggtggagcgcagggtgggcgtttgggctgctgggcgggaaggcgggcggggaaggggtgggaggccggcggcggagggcaggtgtgcgtcggcagggctgggtggcccggcagagagggcgccccaggttcagcccctcctcgaagggcgccggcgtccagtcccgctcgtgggagccgcggagcagccccagggccggcgagcggctgccctgccaggcgcgtgcgcgagggcgcgctcccgcgggaacgcgccgtgcgcggggagatttgcgcgtgcgcgtggcgatggtaactggtgggccccccgggctcgctctaggcggaggctcccgggacgcccacgtggcttcgaattccagctccaccatcactgtgatgcgtcactctggactaggcatttaactacgtgcctcagtttccctttctcaataatacggagattatcgataccctctatactgggttgttgcaagactggaatgagatgatacaagtaatttaacaccatagatttttaaatttaacaccatatgcatatttgatgcataataagcactcaaaagttattgtcgttgatgccattactgttagttaatcctcagtttaattacatatggtgcattttcatttctctgcattttcattgaagtaaaaattctgcgttttctaattttggagaataatcttaattaaaatatgaatatttgtactgcacagtccaactcctacgaagctctgccttgcagcagattggaagagagaaactgatcaactgccgatgaagttggcttttcagtatattgatggagagagaagcttaggaagctctttggggaaacttttggtgacaagaaaataaaaagtttatcccagagtttttcttttgtaaatctttgtgttttctctttcacctgcagatgttgcagttgggtttgtcttaatttcagtctctttgtgagggaccaccatttggctttcataatttaacgtggttacagagcctatgtataccctggctttccattttatggccttaagtgctgcagtggatttacctttagtaatggcagaacgtagtgtataatcattccttgcaagctcctgaatattgtgagcaaatcaatggagacaaatagttattactggatgggtgtgagtactggctatggcaactcattaaaatctctttcagggtatgtttgtacccacttcactgcagcacaagactatgatgatgaatatatgtttcccagattgttatctgttgcatgtagacttacggatccttttcttcaaagaaacggctatagatatttattgattcctcatggttatataggtcctccaacctatctgctgataagtacactgtacacttcgtgggcctagctgtaggtctaagaggagttgattttgcacatactatacttattgcatttaagttaattcatctcattacatgaattggttttaaataaatttttaaaatcatttgattattaaaatataggcatttcttggtgaacttgaggcaagtaaagcctgacagatgtcaccatcacaaagatccttagtgacctttacaaaatagagctcacccagaaaaacatttgctagatagaaacctgattttatagttgcttctgaaatctttgaagataggaggttatttgccccaaaattgctttgttgaaataatttagcctgattcgcttttatagaaaaataagggtaacgatcaagactgatttaagattcttgtatttttaaccgataaaagaaaattaagtaatagttggggaactactggtgtcagatttgaaggaatgattgtcaggaaatactgagagtattacttcaggtagcagtgtttggctttgcaagacaaccctctcatcctcactgtgaatatgtcatctttaaaaggtaccttgaggaattagtgtgacagcttctctgaaattcatgtgatcatttacatattgtttcccaggagctttggcattaaatgtttcatttattggaaattattttgccctttaatttatgacagccaacagtgcaatagagtctaatgtattttagaaacaataaaattagcttttcaccattttctattttccctaaaaatctagcagcaatgcacttggaatgcttaagttagtccagagacaaatggtaagagtaggaaaacatgacagattgggaggtgttgagttctgaatttggggacctaattgaaatgcaaaggtataatcaagagaatgaacttgtctctgtactgaggttgttttcagtgatgtactatattatctgattcagtcaacgttccttgttattttttcaaaccaagattgagaatactatattttcaattatgaacattttgattacagtttcattctgactaattcagtcggaagagaatgcaattattatggtcatttacatacaatatgctaagttaacacagctaatgagtgaaagcataatattctttctgtttgttcctggaaaaatattgtgctaagcattctttcaaagaaagattacattattcgctatcattttatgtctatctacaagtagaattggcattgagccttttctctgctattaaagtgaaatctcttatattttggtgatcacatgcctttcctctcaccccttgggggagactggaaacaattctcaatttaattagatatgctgctttcttttttctgtacatctttatctgaggaaagattgtattttctaatttgggaggctgcttaacaccttaaacattactaattactgcagtttattttatgtgtgtcgcaatagtgtagttagttaattatagctttctcattagcaccacgtagagaataatgaattaacacatccctttgatcaaaaaggatttaagtttatcttctgagaataaaagtgttattgtgttactgaaagtcactataattttcccaagaaacaaattggttggaattctgtatcactgggttaggaagctcaatgaatgagttggattgatcacaaagtagagtagagctgtggttgcttggcaacctgacattattctgccatttctggtatatttatccagtaaactagaaaattctgtttcgttaacgaatgttttaagtcagtgcacaaatagaccataactaattgagattttatgtgttgtgggtaaaaaatgatcctgcttaccttctcattgtgtttagatcataaaaatacaaagggacatattccgttttcaattttaaggcattttcctgaaatgttgacttcactttcacataatttattcctagtgaagaatacaacttgtgtatctctttggaagttaaattattagaagtgtgtgtgagtgtatatgtgtatgtgtgtgtgcgtgtgtgtgatgcttatatacataatttcaataagaatcacaactagagtttgaggtgagatgaattctcaaaattcatagtttgctaattgaactgacagtttggtacatttagggtgggtataaatatctgaatcaaatgatgctggcagatgatgataagaatgataaatgcattgaacttggtcaatatataattatattttatgctttgaccagggtttcttctcctggtagtcttataacattctcccttctaatgtttgtttgcatcttatttcccctatagttgtggaggtaggagctctgttgcccatcttctgattcacctcttcctaactccagggactacaattgtgccattttcctatacaacctatgaattttagtgtgcatcacaatttccttttcagactgtaaactccttgagggtatacatttccttttatgcatctcataaactcttaaagtgtctggcacagcaggaagcgaactgttgtggtggttacatgcactggctataaaagtcaggctgccagggttcaaaatctaagtctgtcagcttgcaggtgtgtggcattggcttagtcatgttgacctctctaagactagtttcttctttagaaacggggaaatagccatacttagctcacatgtcacatgtgttcttgtggacattgtatggggcaatctatgcagacagattagtagcacggttttttattgtagtgataattatccttctatatcatgttcagtatgtgaatgaacaaagatagagggacagagcgtatgtgtgtgtgtatccctgtgtatgtgaataactgtgagccatgatcaatggtggtgtcaaatggcaaactgttgattcctacattaattatatgcacatataccaataatgattgcttcacatatttaaaaggttttcgcaatagttgttcttaggcttggctgaaattagaatcgtctggagagttctgtaaagctaccaacccaaatcaattcaattacagtctctgtggatggtgactagaaatctggatttttgaaaacttctagtgcgattctaacacgccctaatgtaccaatattggttaagaaccatcaccttagatttgcgtacgccgtccacaagattgtgttgggctaaggcattggttcacagtcaccctggtgtcatgaaatgtggctgaaagagaaaaaatgctctggcaaacttctgaggtttttcttactaatcttcttggtttaaatagcactttattctctgaagatctcaaatgtgcttttcatttactgtgtataatttcgtttttcaaccaaatgtctctgtgaagatggtaggaaagaagtaattatcctgatttgcagatgaatgtgaatggagtgagctacactgaaattaagtgatttgactagattcatacatttagaacaggcccagataacaagattcctgtgactttggggttttgaatatttctctgttttgcctgcagacttccaatgaggtagggagagttattgtttttggactaaagtactgtgtcagaaaaagctttaaaaatgagactttcatcctttttttggttataattgtgcagtgtaaagaaaaacagatttttattttctttctaagaagaggcaccatagtctatataggagccaaaccaatgtcccttggactttgaacaccgcttgtataaatatttcatttggcccaaagaatgtttaagacaaatttcagccaacatttaaatactggagatttcatgtaaaattcatatttctggcttatcttaaaaggattgatgttctcacagtattggacctgaatgcccaggtggcagaatgccacaggttagaacccagtggtttgtccccttgatgttcttgaaagacatatcttcgctgggtaaaacatggcttcctctcaccttcactttgttcctttcttttatatagatcctactccaaagaggtaattaagggaccttaaagacgggcccacatctctttggatgggattaggggaagcccacaagggctgctgaagcacatctggagctgttactgccccttgtcctgaagggataatgggaaggtgaagttcctggaaggaggtgggagcagtagctctggaagagggctgtcacgtgggacctatggcttttggtagaggaacataactactgtcaaatcacaagacagtgctctgcttctaccccaagatttccagttgcttcttcagcaaggcagtaagacggcaagggagcctattgtagtggtttgtggaggtcagttctcccagagcagagcaggatggaggaaggcagaaaagggatctgaatctgggaagtacgtgaggaatacctagcacatcttgaaggctttacatttgtggaacgtgagtagtggggaaggggaaagctagaattgacaaaaacagtacaaaatagggaatcattaagtttgtattcaggagaatcttcaccactttttctttgtcattcctttcttctttctttcattgcccgaagtgggcatgctcatattcagtggtgtgtttcagttgggactcttaaacttcaaaacaaatttgtccatttcattgcattatctatgctttctaagatgagagctgacatagcagagagaataatgtaaaagatgtattccagcttctatggtaatggttggcatttttagcagaggttcctccctaacaaaagcttttgctgtaagtggtgattctcctgggagggattgtagttatgatgcctgggaaagcggagatacactcaaatgtcagtctggcagctgaaactcatgtaacctggatgcctggatctttggaggaagtatccttcttctttgttatagttgtatcagaacaaggacgatgaaggaatagaccagaatgcactggttgcatcttaatgtgaggaatttttatttccagggactaagagatgtatttcccagagtaatagaatgtaagtggataaaaggaatgtggggattttgatgatctgttgcggttagagttgttggaagttcggttttttattgcattgaaaaccttgctaaaaactgtaaagtgacagaatattagcttattatgggatgccttacatattggttatgttcaaaagaaataacacgtctcatgtgcaaaaggttcagggggaagataaatactgaccttttccaagactgatactggatgctgcatttccatcctttcagaagattgcctctgaagatttctattttaaaaaaaaatcataatgtcttgcattatttgtgtgctttatgctttttagaaaatttttccatgtcatctcatctgacttttacaataacatagtgaacaaaaagaaacaggttgttagcccattttatagatgaaaaaaactaatgcaaggtcaagtagttagctttaccactattccaccacactgcctacagtagtgaaaattagaattaaatcatcttagatatcctaatttgtaacccagttcatagcccactctattgctttcaggttttctttttcctttttctttctttctttctttttttttttttttggagatagggtctggctctgttgcccaggctggagcgctggagtacagtggtatggtcatcgctcactgcaacctcgaactcctgggctcaagttattctctcacctcagcctcccaaagtgctgggactacagacgggcaccatcatgtctggctaatttttaaaatcttttttgtaaaggtgaggtttcactatgttgtccaggctggtttcaaactcctggccttaggtgattctcccacctgcccctctcaaagtactgggattacaggcatgagccaccttacacagcccagatttccttttttggaagaaaagagcaacattgtataactgatagtgaattgttttttaaggaaatctagagtcaccgtataaactgagagctgtctaggggaaaaattgaaaatgttaccagttatattttgagagttgaacgtagtcctggccaaagatagggagatagacttttccaaagcatcctgaattctataatacatgttcttatgtttgtgtgtgtctgtgtgtgtgtgtgtgtgcgcgcgcacgtgtatgtgtgggtcctatgaggcattgtgaccagtcattataaaaagcttttattgatcgccactttgtgctagagacaggaatgaaactgtgccaggcagatacttaaatagccaccattgatcatttatcaagtgtttattatgtgttttgcaatctccacatcagtgatttgaggaaagtactattataacacccaatgtaagctgggcgatgcagacacagaagggtccttgtccaatgtcacacaatatgtcttgcagtaccagagtcagaattcaaactcagaagtgtctgatttccagccccagcagtgccccctcgattagcaggattctccagctatggtcttcactatggactaacactctttcctgttgtccatccaaacttacctgttctgtgtcccattatccatttgtggaaaagtagacataaaggaatcctactgaggtattagatgataatgcatacctattccaggaatggtggcattaaatatgaggttttaaaacctgccagaggtggtggtgcaagcctgtaatcccagcactttgggaggctgagacgggtggatcacttgaggtcaggagtttgaggccagcctggccaacatggtgaaacttcgtctctactaaaaatacaaaaattagctgggcatgatggcatgcctgtaatcccagctactcaggaggctgaggcaggagaatcacttgaacccaggaggcggaggttgcagtgagcctagatcgcaccactgcactccagcctgggtgacagagcgagactgtcttaaaaaaaaatcttaatgcaactttgggaggctgaggctggaggatcacttgaggccaggagttcaagaccagcaacacagcaagactccatgtctacaaaaaatatataaataaataaaaataaaaattagccaggtgtggtcgggcatgcctatagccccagctacttgggaggctgaggtgggaggatcatttgagcccaggagttggaggttacagggaggagacatttgtgttctctccaaaatcaagtcatataagcgtctaatggtctgactcttcctgtaccagaccctgggcatcattatatgtacaaatgaaacttcactctcattatcattgtttatttcttggcagaaatgtttctgatactctatgatatgaatacgcatggatttccctcacttctgggtattatatgtaaccaattgcatttcgcggttggcatttccacaaaggtgtgagtatctgctattccagattaaaatagaaatcgttggcaatggcagatgccatatctcagcattgctgttcttgaaaacggcttgaaaatgacaccgatcataatgatggcactgtctttattagcagccgtcaataaagataaggctttagaagaaaaaaaggcaactctatttcaggcacagccaatatatttgggagttttaagagatttttgagttttttgtttgggatatttacaagcaaatgttcatgtatttttaagatatgcataatataaatagcattctcagatgctgagtggctccaaaaggctcctttttgtgtactagaaagtggcaagaataagtttgtttcctgctttggctagacaggagatcccacttccttggattatacacaatggcttttctataaagcttttgtttgacccatacctgcttctctggaatacacagcttggcttctcaagaagtaagtttatttctgtgttgtaaattcaaggatttttctaacttgttctgtaaaatgcatctgatgacatagtggagaattcatgcatttgattaaaatttaaagatgtaaagaatgcttaaggcatcatacaatggcaaaaaactgaaaacactgcccacaagggtaaacatataggcaataacaattttaacatctatcacctatatctgcatgaataataggctatattgcgttatttgttattgttcactaatttgagacatatactattttccataaagaagatctgagtgaatggataaagatagccaaaacaagcctgtttaaatttgaccttgaccccattttcttcgtgacctctagcaattctcagaggagcaaacttcaaagggtttcaacagtctgctcttcccatgcatacaagtttctgcttgtaattgatttgggctgaatagattttgaacacaattgatttgcttgaaataacattaaaggaccaagcactgagcaattcaggtgcaactcatgcacacttctgagtcaagttcaaataaattggatttgaccttaaccactgtcccctcaaaaaaagggctggcagtcatcagaatgaatgccatccaatcaagtataaaaactggtatgagtggtttggatcagaaattgatctccatacacaagaccttcttttgaaaacttgtaatgagcttctgttttcctgttttaccagctgtaaactgaggaaagaaacattgactgctgcctcccagtggcagttggaggattaatgagctaatatttataaagtgctttgaagataaaggtgccagctattattattactaataaaccattttttctgcagtgtaattttggacagcaggccttaaaaacccattactgtatttaacagtaaaacaatctgccacagcctagtatttactgcctcaattaagcatgcattccacttcctttgcccctccaaattcagaactggtgaggagagacagaaaggagtgtgtcatcatttcccaagttcattgaaatattaggtttgggttgtttgattgtctcggcagaaagctagactatatcctcagtgggagactagttgagctacacttttgtttctgtgccttatgaagggagtggaaggcttggttctaggcctttattcaaccagatttacattgtggtttattatctttgaagattgcattccagtatccgttttggttatttgaatatggtaccattaatgaaactggtttatttgggtggttttatgtgtgtacctgcgtgagggtggggttcacaactaactcctaaaaccgaagtggaaaatggaggtaattctgcagctatcccatgtccaaaagtattaaaaaataaaactggagaccttgaattatacaggatagtttcttagttagtaattactgttatcattatatgatattaaatcctttcaatctgatttattttgatctatatagatgtcctaaaatatcagatggtacagggtagtgtaaatatttctcacgtattgccaaaacaatgcttattttcctctgatgctatttcagtactgcaaataaaagtaaaaaaatataaagttaataaatgactataatgagatgtctcagctttcaacagctacttcaggtattcaaatgctaggccaatatctaaaagttgaacaaaagaagcctcaaagcaacctagatctctttcttggcaaaaattcactaaaatgtaaacacttgattatggaaagatcttcctaattcagtgactatttgctcttaatttagaaccattctaatatgcataattatattatttcagcagatgacaaagtataaactgcaagttggagcagatgagggaaattttgcaaattcattctaagacaaaataagttacatttaatatatttcttccgcaagagagagggatagaaagactagaaaaagacaactcagaaatgactatatgggtgatcttgagtcattaagaaattattttaaaataaaaaataaattgacataccacctataggagttcagatcatttatctgaaaatcttatggaaccaatccttcctagtggtctagttgttcaataatgttaaatacaaattcttaacagaaccctaatcttttttttgtcattattatacttcaagttttagggtacatgtgcacaacgtgcaggtttgttacatatgtatacatgtgccatgttggtgtgctgcacccattaactcgtcgtttacattaagtacatctcctaatgttagctcccctccgctgccaccccacgacaggccccgtgtgtgatgttccccaccctgtgtccaagtgttctcattgaacagaacccaaatcttttaaacggtttcttttacaagcaatgcactaataatgatccaaggtaggtgccgttgtttacagataggattttgtattgcccattccaagtttgccacagagtatactttttattactatcacttagggagactgtttggtaaataccatcaccattccattgacttttgaagttgagctcatgctattttcatcatttgttttgtttaattgtgtatggggaattcaccatatggcttaaaactgtttaagacctcaatagatatgtgttttgcatatgagattcttggggtatctgtagggatatacacaagctgtttgttattaggaagaaaagtacctgaaagcttgtgtgtagctaaggggagaaatgatgaaaaatattctgaatgtagcaaagtaacaatttgtgtaaaatgtgaaggcacatttttccacttacctatcactgaatgacaaactaactcatacctttaaacagtaacttcaaacaacagacattttatgaaatctcatgaattgtaggtgaggaatttaggcagggctccgctgggtgatttcttctgccccatttggtgacaactgaggtaatatggtggtatctcagagagtggctggggtgggctggtggccccaggatggcttccctcacatgacccatgcaatggcaaggagggctgagctcagctgggcccctctttctgtccaagtagtcacagggcctctctcctggtccttccagaaatgtcactggacttttcacacagtgactcagggctttaaaaatctaacttggaaacttaaaggctagtcctcagaccgttcagattcaaaggaaactctcatccaacttctagcagacaaggtagcaagaaatacaaattaagaaagacatgctaattaacagaattattaaacccattgtgatacaccattcactcaccatgtgactgcttacaaagagggaaaaaatatggagccctctgttccaagggaacactcctttccccctcccgacacttcctagagatcttagacccacatgactgtgagaaagaagagtgatgtgagagtgaactttggcaaggctgaagtgccctggttttgtctggagcgagaataaaagtgagaggaaggaggcgtccagttggctgagaatactgttggctaagattctttagcagggtgggcttttcggatgcttttctcctctgatctatttaggtttatccttactcttttccatttatctgggaagtgacttgggtttaagagaaccaggagtatcttagcagagtcaaaagggccacggtgaaccccaaatgtcaggaaacaaggaactgactagattactcaaggcttcactcttgaggagggagagaaaagagctcctgcatttccttctatttattgattacagccacaaatggaaaaggaagcaggctttctgccctgaaataatgatgatacatcgggctgcagagctcctatacctataactctcaaaagcaaatggaaaggagactagcgtgtggctagtaccattattctcacatcttcctgcagtgttatgagagcacagagtaggatgcagggtgaggatagacagcagtagagctttcttgagctgcttattcctctccaaattctctctgaaagtggatgaagaactgctgccatgtctggtgtgggttcaatttgtgctctcattgcttctacttctctgtttctccagatcctaccatcacgttcttccttctgtggcttagccatttttctctccacgcttaggaaccatacatactatcattcttctacctctgaagcattatcccatccttctgacaaacatgagtagatgttttcccctcacagtcttgccaaaaagcacttataaagtattgcaccgtagttttcatatttcaaaaacacttcaacaggcaaaatgcgatatacacaaccccaaaatgctgtgctatgatgaatttagttctgtattggtaatactataaattgcttttgaatgaaagatacaatgtctatatattatttaatttgatacttgcagtaactagctatttaagcaagataggtatcagtcctctttagcgaagttcagtggaaccaatggaacaaacgtgtgggagtggaactggaactcggatgtctgattttgtcttaagttattttaatgacaagtcatttagccaccgataaaaagttacttattcagaaaattcaatcttctggacaagttttatttttacatgacataacctaaaatgttatatatgttaaattctgccgttttagatttcaggaaaacaaatgcagagtggtagaggctggtggtgagaatgagctgagaagggtggtaataaactgaggtttctacaacgagtttgcattaaaaaaaacttgttgggggttctggaacccaatcaattctcagatgtttccatagtctatttttatatagcataatacatttttattatgatcaggcaataaagcaagactgttcaccagtcttgctttagccatttaccatttcctatactctatgtatgtcctttgtctgcttttacactaccataaagcctgcttcaactttcccctcaatacactgagatttatttcttcactcaccattctggaaaattccttgttcagccttctaatcactagacacctgcaacctttccttcactggatttctgcctcgaacagtcactcttctccactaagatctacatgtcaccgctaaaatcccctttcttgcttgtcactttgaccatgatgtcacttacttcctgaaaatttcccctggctccctactgctttgcaggccaagtaactgtcacatttcgtttccactttcagctggagtcagccttcattattcccctctccgtccctgtatccttagagaccctctcctttgactcaacagctcactgctcttgtcttctcaaagctcctgtcttttcacacacagttcctgctgtcttttcttcttaaaacaaccagccattcgacagtctccaattctctgagaagacattcccctaaactcaccatcttcaatacttgtgtcatatctttgtgccaaattctaattcacttaagattttaactggcttactaacaaaatatactaacttaaaatgaaggttttatttattaccttaaatgaaacaccagtgtcaacggcaaacaatgaaaagtaagagcaaacgttactatgatgaaagcaacttgaagtcattgcattttaggtagatatttgtgcctgccccagactctgggcttgaaccctgctctgtcttataaaatagggagattagaaaagttaaattgttattaatgttctattaacacctacttgagactttcaactttttatagtaagaagaattgaaaaataattcacagagaattgattcccatgatgcgttcacctatgtcctgctcagaacacatctaggatcatttcagcgctgatagactgttcaaggagatgcagcctaactcaagaaaaattcatcatgctcctcctctttccttctccagttttgttcccacatatgaacattaaatgaaaatttatgaagttcctgctgagtgaaaatcactgctggataggtgaattccaagatgaaatagatagactttctggcctgaagttgcttactgttaccactgaatatatgcccataaaatattaaaatagacctaaatgccttttctgaggtctggaactctcaaagtgttgtgagcctccaatctaattaaagaactcactcaagtataatgcaaaatagaggatgaaaaatgccatacgaatgtatagataatgttttatgggagattagaatagagaaagattatttccagcttgtgcactgttaaaagtcattaggaaagaggtagaatttggaaagcaaagaagagattgcattgcaaagaagacattcaattgcaatgattatttctctgaagcaaaataagtgttcaagcccaatttaatgagcaattaatttttagcaatattttccacatgttcataatctagtaccatttgaaaaaactttctgatgtgaaaaaaatgtgatttaaatacctgtctcaagttctgaaaggcttcctcacatattataaaacaggagccctccctaatttgagtcaggttagagaaagccaaacataggtggaatatggatacctttactacaactacatttggggagtcaacctaatgcttgcttaatcgcttcacagaaagattgaggaaggcagtgatatccagtatcatcatagggctctttggtgccaataatctattgaggtgcttttcgattgtgagacgaccaagaaattagctgatcccagcagaaaaacagagctccttccttacttttcagctgcgttaatttcttctctacgtttcagagtactgctaattccatccactgatcccttctagggcctggttttcagtcctaggcactcaggtaaggctattctctagacacaatatgcatgtgaaacaaaaaaagagaaaagtaataatgacttcaaatattaggatctgactatgaaatatcagatcttttaactcttgtattcatgtaaccttcctacatttttcaagtgaaaatatttcctacattttttaagagacatcagtgttacgtgctacgttatcaatattattttcttattggccatggaaatgcttaaataattgacttgacttgttaaatctattttatacattgcattttaattacatttataattttaagaaacttcactttttagaaagatatagacatgaatacccttggtattaattagtagtagatgtccttacttctgatagcccttacataatgtatccctctctatgagtgctgtagatttttcacttatatctacaaatacagaagatataacttattaaaagttcaataggaataagtcctcatgttatgagagagtataaagcaatagttagagtgatgtgaaatattataactctgtcttctggaattattccttgaaaagattaattatgtatgcctaatgagataacagtgacaaggtataatttagagattataaagctgagaattgaaatgcctagcatgtgcacgtgcacacacacacacacacacacacacacgtaactgctcttttgcaaatcttcatcacatcaattgtgttgaatccattctcttaggctatacattctcatgctagcaaaatgaaaacttgaaagtaatatgttgaagagatactatgttgaagagattcccatgttgattgcagcattatttacaatagccaagatatagaatcaacctaagtgtccatcaacagatgaataaagaaaatgtggtgtatatatacacaattgaatagtactcagccataataagaatgaaatcctgtcattgtggtaacatggatgaatctagaggacaatatgctaagtgaaataagcaaggcacagaaagactaatatcccacgttctcactcatttgtggagtctgaaaaagctgatgtcacaaaagtacagagttattagtgactccggaatgtatcaaggaggggaggataggaagagattggtcaatgacataaaattacaattagacaggagaaataagttctggtgttctatagcatagttgggtgactatagtaaacagtattatagtttgtatttccaaataactagaagagaggatcctgagttctcaccacaaagaaataatgtttcaggagacggatatgcgaaagccaatgtacacatgtatccaatcattatgatgtactccatagatgtgtgtacttattgtgtatcaattaaaaacacaattcaaaaattgtcatgggtttgctctttttttttgcattacaaagtgacatctatttcttgactacatgctaggtgattaattataaaatggctctgtgcattgaagcatctctttcaagagctttacaacctgacttttgggaaagatacattgtatcttttgaatgattcaatagtgaaatttatttctgagtttaccattttgtgatttctgaattttttcactttcagcatttccactagtgttttatttactggttccacaaatcagtcagtttcatcaaatttgccaactgcaagcctaaaccattggaaattggcataatgaatgttctgagtgagaatatatatgttattaggaatattttaaatataagaaaatgtgatacaaacctggctgccaaaatatggcaaaaatgtaaacaaaaattgatgtgtaaaaaataccactgtatttaaaagggataaaactaatcagatagtattttaaagctgatgtcttgatggcacaattttaaattgaagtgctatgggggatattgtcttactggtatttgcagtttgggctcaaaaaaccagaaactatatctttaagggtgtttaacagaataattctaaatattatagttttctctttcctttttgttgtcctgtgattttaactttgacattcttatgtgacaattgaaaaagtctcttcacttttgtgtattctttctaatgtgatcaggagaattaaaatgaacattttctttcataaagctgagagttaattctgaaacgttgtaccagaatacttttatgaatgaaagactagcctttgaaccctaggagagtcaactctacaccaaccctgtctattaaaaaaagtctgtgcttacagatgtcttgtgtgagatgtggctttaccaaaagtatctgaacttcaaatttctcctatcactgccaactacccatgggtattggcaatatatttggtagacttatttcttctgtaggcatatgatgccatggccaaagtgaactctacatttttaagagaggctgctaaatatggccaatcacaacagaaaactagcatttctccaatttggcagtggtttctggatggcacacccagacttacttccttaagcaatgctgatatatggaaatgccatgatagaggctcagaagctaacactgaattcagcagtgcagaaaaactccaaatcatgtggttcttctttgtcaatattttcactaaggcagcataagatattaaatcacctggaattagttatgtgccatttcagcaaccttttgtgctcagtctgctacaagctgcttgtgctgattagcagtttaaaagtctgcaggggaaggaaattttcagtagcttgattttcccccaccctttggtcctgtgtgcattggggaagaaattaccttctgtgcaattcctgaataatttggtttgattattaatagattcatgctgaaaaaagaacaataacagaaaaaaaattacccatggggttgcagctgtgctcccagatacaaaacagggaaagaaaacaggtctctccaagcaaagggtatatgtgtatacgtgtgtgtgcatgtgtagctctgattctaagaagccattggttcatttattcatgcatcaaatatttattgagctgcgaacaaatcccaggcactgtgaggaagacagatttcctgccctcccagagttgccattactaagaatgttagccaataaataaatctttacgggaaagaaacaaaggactgtgatagaaaaaaatgggaggagaaacttactttagaaaggattatctgagaaggtgcctttcacgctgagccagaaagggaagaaggcaaacaggaaaagagccagaagagcagagttcccagcagaggggaagcaagtggagaggcggtgtggaggaatcaatttggccccatctggaatggacagaaggctagaacctgcagtgcagtgagtgtgggagaaaccagctggcacaaggtgagcttagggcagatcacataaggccttgtaggtcatggacaacaatatggatttaagtgcagtataggaacttcaaaggaattccaacagttaagctagttgatgtaatttgtgtctatatgtatatatatttatatatacaaacaaaacaaaccttggctgttgcatgcagagtagattgcaatggagaggaggaccagttggtattccgcaagggagataagaacagcttaggcttgaatgaggatgtgataaaggggattttatgagcaaggctgttttattattttatttattgtacttctattaagatgatatgggtgctttgggggctgttgtaaattataacccacagcccctgcacaggaaacctccacaggaaacaatcaaagaataagtggttgtgagatgacaaggtttacgatacgtgttttcaggcttcttaatagcagagtgattgggtgatttccaaaagacctcagggctgggatgggtgaaattttgtgagcttctggattggatgagggtgtgctcttgcagaaagaattcctgaatactttctgcactgacagaacctgcttattaattcttacagcagttatgttttagaagatgaaagaccctttccattcaattattgatcataagcatgatgtgtgttgattaaaatggcatgataatggtatcaaatggagtttggatatctttttccttaatatacttttgtgtatcatatttaagtttcctcaagtcagtagagaagatgttacccacatcctcttttccaaagaaggaatcatttgatcattgaaaggtttactgaatagaaaataaattatgttgactttagcacaaattcctgccctaagttttagcccatatattgatgatgtcaagtgctgctaaatgtgttcttcttctataaaaattaaagtttaagctttggatgctaactttcaaatctatgtgaaatgatatgatttattgtgatataaagaatgacataaagaacaaaataatacttttttaaatttatgaggaaaaagacaacagaaaggaaaaatgggcaaagaaagagaacacgtttcatgcaaatcaaaaccacaatgagataccatttcgcaccggtcagaatggttataattgaaaagtcaaaaagtaggccgggcgcactggctcacacctgtaatcccagcactttgggaggccaagacgggcggatcacgaggtcaggagatcgagaccgtcctggctaacacggtgaaaccccgtcagtaaataaaaaatacaaaaaaattagctgggcatggtggcgggcacctgtagtcccagctactccagaggctgaggcaggagaatggcatgaacccgggaggtggagcttgcagtgagccgagatcatgccactgcactccagcctgggcgacagagtgagactctgtcaaaaaaaaaaaggtcaaaaaataaaagatgcaggtgaggttgtgtggagaaaaaggaagagaaagtacactgttagcgggggtgtaaattaggtcaaccgttgtagaagacagtgtggtgactcctcaaagacctgaagacagaaataccattcaatcctgcaatcccattactatatatattcccaaaggaatataaatttttacattatgttaaaaagacacattcatatgtatgttcattgcagcactattcacaatagcaaagacataaaatcaacctaaatgcccatcaatgacatcaataacagactggataaaggaaatgtagtacatatgcaccatggactattatgcagccattaaaaaagaatgagatcatgtcctttgcatggacatggatggagctggaggctattatccttagcaaactaatgcaggacctaatgcaggaaaaccaaatactgcatgttctcacttataagtggaagctaagtgatgagaaaacatgaacacttagaggagaacaacacacactggggcctacttgaaggtggagggtgggaggagggagaggatcagaaaaattaactaatgggaactaggcttaatgaaatagtctgtacaacaaacccacatgacacaggtttacctgtgtaacaaactggcacatgtacccctgaacttaaaatgaaagttttttaaaaaagagaacacatttcagaaaaaaactcaaatggccaaaatacatactaagatagacaacctcatgaatagtcaggggaatgcacattgaaatcacagtgaaacaattgttcatctacatcattgaataatacttagtatctaaaagggatggactactgatatatgcaacaaaataaatgactcttaaaagcattatgctaggtgaaagaaagttacatactgtgggatttcatttatacgatattttggaaaaggtgaaattgaagggatagcaatagaatcattgtttttaaagactggggagggtggttgacgactgacatgatgggaatactgtgtgctgattgtggtggtattaataccccatctacctttgtcaatattcattgaattgtacctttacaaatttggttattgtgatgtatgtaaattaaaccttcaatgatctgattttaaacattacagtgaagtcaggagtggtggtatgcacctgtagttccagctactcaggaggctgaggtggaaggatctcttgagcctggaaattcgaggctgtagcatgggtgtccaaccttttgactaccctgggccacattggaagaagaagaattgtcttgagccacacataaaatacactaacactaacgatagctgatgagttgttttttttttaaaaaaaggtccatgcataatttttgtgatatctgtcatgccaccacagatatcaaagaagtcctcacattcaaaggattttacacctatgcatgtagaatgctataattgcacctgtgagtagccactgcactccagcttgggcaacatagtgagatcccatcacaaaaaagactcacaatgagaaaatgttatcatttattagactacaacaatgaaaatatgtagtacagaatcttgtgaaggtgttaggaaatgagaacgctcatgctctgttggtgtgagtggacagtggcataacctccttttagaggaggaatttcacatcagctagtaaagttgaacatgttttaacccacaccttcgaaagtctgataaacatttacaatcaattgtctctgaagcctactacctggaggcctcatctggatagaaccttggtctccacaaccatccttatcttaaccaagacactcccttctatcgattccaggtctttagataaactccttggactagttgccaattagaaaatctttgaatccacctatgacctgaaatcccacactcacccactttgagttgtctcacctttccagaatgaaccaatgtacatgtttcatgcatttattgatgtcttatttctccttaaaatggataaaaccaagctgtagcccgaccaccttgggcacgtgttctcaggatctcctgaagctgtgtcatgggccatggtcactcgtgtggctcggaataaatctcatcaaatattttacagaatttgactcttttcattgacactaatcatcattgtaaaattaagactatagtaatcagtgcattttgagccctcagttgttcaagtactatcacagaagatcgatatcaacttttgtttcagctccagattaaaaggtgagcctattagagtgtttatgtgtagcagaccctacacttattcaaagaatcatttgcttagatctaagagaaatctcatcccttttacttttaatatcatggtccttgtgaaagaccagacaaaaagtcaacccagttagttccttaaaagaggaaaagtagagggaattcgcatgagcaacacctcagtacttaacagtcattcaaggacttatgcatcaacagtacttggcatttcatgtaatccttccaatgttcttatcagttctgtgtgttcttaccattgaaatatagatgtgcacaccattgaaaagtttaaatcattaatttagtattaagttaacaagaacatagatgctacacctaaacttatccaagatattaatccattgtgccttagtactttattgactcaatttataaaaatattgtatgtgttcagtaaaaatataactacatttaagacataagtttgattttatgacttaggtttctgtaagaagcagcatacttttaactcaggcttatgaatataatatcacttcatctccttacaaagtaattagaataaaggcagcatatattttgtatgaactaaaaagaagtacaaaatattggtccccaaaattaaaatgtaagttcttaactacacatttctatgctatattacttgtattagtttcccattatggtaataaccaagttcctcaaatttagtggcttaaaccaacatacctttttctgttagagatctgaagtttagaagtcctaaaatcaaggtggcagcagggctgtacctttctagaagctctaggggagaatctgtttacttgccttttttttagcttctagaggccacttgcactctagctcacggtcctgttggagctcaggggaagctgccctcttgcccttggatggtttgctgaaaaatgaagccacaataaggcatgttaataagaagaaagcataaaatttatttacccatatgcatgtggagaatcacagagtgattacctaattacccaatcaaacccaaacacttatataacctcctttcagaagagcgggggtagatgggaaatataggtaattcctttgacggacattacatgattactagggaaaagtaaatggatccttgggaaaacgaatagatggacttgtaaatgatttggaagttgaatgaacttcagagacaggcactattttgtagaaaggctgtgccagttctgaatacattctttcactcctgtcttgaaatagataatgagataacagggaagggaaggaaaaacaattttttttttggtggatccatcctatttttatgaagatggggaaaagtctcttctaacgcatattgatttctaagggattttaattcaaagtattcattacttccagggaatcatattttggggtgaaattctctgtgtttttttagtgccatccttcatttttatagccagcagtatagcatcttccaattttcctttctttctgggctctgtcctcaaaacatcttttcagattctgaccctccagcttctcttgtgtaaagacacttgttatacattggcccacccacataatccaggacaatatctccctctcaaaatcctgaatcaccttacatttgcaaagtcctatttccaatgtaaggtaatattctcaggtcctagcaactaggacacgaacatctttggggttattattttaatcagttgctccaccctttaaactcttttctggttgatatatccataaaattaagtgacattcgggtgaagtgtcatcacccatcactatccctatctgatataaaacaatgatacttaagtgaagtgttataggaatacaaatttgcactatgaagttaatattagaagataaacatcctctaaatattatcttatggaggtaagatgacttttgtgtgaggactataccatcttttattcttggagtaatttactattcagaatgtggtcagttttggcacgttgtcagaactgcaactgtgtaaggaataaagaataagacctatctcagaaggttgttgcaattattaaataaattattattttggcatatagacttgctatgtatttactgcagttgttaatattagatccatgtgaactatcaaaaattgtattataattgtccaacaggttcttcttgcccactgcatggatagggcaaattcactgagacagcggtattacagtagagaaagagtttaataattgcaggcccagtgaagcagaaggactggatttattattactcagatcagcatctctgaaagctcagaggctaaggtttttccaggatagtttggtaggcagggggctagggaatgggaaatgctgataggttggggcagggatgaaatcataggggtcaaagctgtcttcttacatgaagtcacttcttgggtgggagctccaggactggttgaattagttccttggtatgagtcacagatcctggtggagtcagctggcctgcccaaatgcaagagtctgaaaaatacctcaaagactaatcttaggttttcacaataatgatgttacctataggagcaattgggaaggttacaaatcttgtaacctctggcacaatggctggttattgtttaactgtacctacatcctaatagagttcaggcccctcccataatcctagtcttgtggccttttattacttttacaaaggtggttttggtccctgaacaaggagggagtagtttggggaagggctatttttatccttgttttaaagttaaactataaactaaatttctcccaaagatagcttggcctatgtcgaggaatgaccaaggacagcttggagttgagaagcaagatggagtcagctatgtcagatttctctttgatatagtttgaatatatatctccgccaaatctaatgttgaaatgtaatccccagtgttcgagattaggcctggtaggagaggtgtttgggtcatgggaacagatcccgtatggcctggtgctgtcctcgtgatatagagtgagtactcatgagatctggttgtttaaaagtaggtggctcctccccaactaagtctctctctagcttctccttccaccatatggtgtgcctgctccaactttgccttctaccacgagtaaaaactccctaatgctcacccagaagccaagcagatgccagtgccatgcttgtacagcttgaagaagcatgagccagtgaaaactcttttctttacaaattacccggtctcaggtatttctttatagcaatgcaagaatggcctaatacatttattgtcataattttgcaaacgtagcttccctgttggctacatcaaattgagggtttgctaggatagaaaagtggaaaatatcaattaaacaactcagagccgggtgcagtggctcacgcctgtaatcccagctactcaggaggctgaggcgtgcagatcacctaaggtcgagagttcaagaccagcctggccaacatggtgacaccccatctctactaaaaacagaaaaattagccaggtgtggtggctcacgcctgtaatcccagctactcaggaggccgggcgggagaacacttgaactcaggaggcagaggctgcagtaagccaagatctcgccactgcactccagcctgagtgacagagtgagactctatctcaaaaagaactcaaaaagattgtgttaggtacttacagactagaagattatgttaatgaatcttttattcattcaacatataattattgcccactgagtatgtaacacgttttctgttatgtttagaaataattatgagcaactcagaatgatctccaccctcagagagtgtacagtctacctcagtatgtagatgattaatagacaaacaataagtgttgaatgttgcacaaactgtcctttatttgatccttagagttatatagcatatttaaacattttgaagtttgaaaatgcatacaaattagagagacatccaataaggtaggacttgggttaatgtttactttcctcaagcacgagaatagtatgtgagaattaagaattaattgttaaaacacatctttatatttctttatgagacaactcttgaagcaaaagtgaaagctggctcaaacacagttcaattacacagacgtatacacacacttatagtcacacacacacacaaaaccaccactgtccaggaactaaacaataattgtactcttctagatatgtaaaatcaagcgaggaacagttaagaataggttatggccaagcgtggtggctcacgcctgtaatcccagcactttgggaggctgaggtgggcagatcacgaggtcaggagattgaggccatcctggctaactctgtgaaaacccgtctctactaaaaattcaaaaaattagccaggtgtggtggcaggcacctgtagtcccagctactcggggggctgaggcaggagaatcacttgaacctgggaggcggagcttgcagtgagccgagatagcaccagtgcacttcagcccgggagacagaatgagactctgtctaaaaaaaagagacacgttaatcttaactttttttgagagagtctcgttccgtcgcccaggagagagtgcggaggcacgatctcagctcactgcaacctccaccgtcaggttcaagtgattctcgtgcctcagcctcctgagtagctgggactacaggcatgcaccactatgcccagctaattttttatatttttagtagagacggggttttaccatgttggccacgctaatgttgagctcctggtgtcatgtgatccgcctgcttcggcctcccaaagtgcggatcccaaagtaggattacaggcatgagccaccatgccaggctgaaaattctgtattctattatatattatataatagaatattttatatatatatacttatatattatataatatataattatacacacatatatattttttaattttattattattattattttttctgagacggagttttgctctgtcgcccaggctggggtgcaatggcgtgatctggggtcactgcatcaccgcaacctccaactcccggattcaatcgattctcctgcttcagcctcccgagtggctgggattacaagcgcacaccacgcccagctaattcttgtatttttagtagagacagggtttcaccatgttggccagactgttcttgaactcctgacctcagcagatccacctgccttgacctcccaaagtgctgagattacaggcgtaagccaccgcgcccgacctgtagtacctatattttttatttttctccaatcttttaatcttttaatcattctccaaaatgttgcctttcttctcaatgcttagcagacaatttgataaacaaggatccttttctaagtagacttcatataggagagttttcaaaacagaataagaagggcatattattccttgtcaaaatattttcttgttgaaaatggaaagtttttgctaaaagctgaaatgcatggcagattaatttatgcctattacttcaggtaaataatttcaccaggagtcttcataggtaaaatgaatgtttatgcttgataaaaaagtagcagttgttgatttcaacaggtttaagaagcgtaaatgttgtccacctcttctttccatcccatgcacatcttacttttactctagtaactaccacccatgaatgtccatctattaaacccaagcagagagtagtttttaaaatattcctttcctgttttctgttgaactattttatagacaagctatataaaaaagaaacacaaggaacaaaaaatgatatcttattctagtgaaggaaatccaaagttggggtctagaatacaaatacacctgtgtgcaagctccagtgatgccagttcctagtactggagagcattgtgactctgagcaaaagagggaagacaaacatatgaacagaaaacctcgtcttttctcaaacatcctcaatgactgttacatgaaaatgaggactatcaggctcatatcattttcaaagacaataggtgatatgcatgtggagaacaaatacaaaaggcatgcatagaaatcaaaagtgattaaaaatagtctgaattctggagacaatagcatgtgtggacggacagatgctacagatttaatgctgacatatcagagatgaaatgtcagctttctttattaccagtagctctcagcttttcaggcaaatcgttctttgtactctacgttctttctccttatggagttccttcttgatgcctcttcctacttcttcacatctttctactccttgagatacctgcactcattgcttgcacttctgttagtgattttgttacagtattgtgctgtgtgtttccaggagtggagccaaagtgaaggaagcccagaaatgcctgtcaagggagactatgagatgataacagcactcgtctttttccttgtgcttcttgcagttaacacccacatctatctatccatctatttgtgtatctctgtgtctgtctgtctgactatcgatctatccatcacccattcatctactcatttattttggcatacagcttttcgatagaggcaaacactgcctaatggaattgatctacaacaagaccatagctggagtgaaagaaccaggactcagaagttaaaaccaaagttaatgttattggaatgtatagtcttaaaaacaatatgttttttaaggacaattttaattcaattaagtgtgcaatgaaaacacaggggaatgtttgaagaatcttttatcttttacccaggtgatgtgcttttcgacaggattacatttagtctaagaggtagaaaaacgtcaccaacgacaccttaaaggcttaccccaaccaccagaaaaatatttgtactatttccttcttaaactttgcacaactttttatgtagatattaagtgttcaaggggatccctgcacatggatgaagtcatgtttgcatacactcagtgtaaatatgtgtacacacacacacacacacacacacagcaggggaaatatttctcaaatgactacacttaggttactttccatctctatttattttcttctgtggaataatgcagactagaactaacataaattgaatgctcatgagaccacacatcttcacatggtatagagtgtgttatcgcagcaattttataatggctcattaacccctgtgagaggccagtaatatgggatagcaacggatttctatcaactccatgagggagataagtaaggtggcatcttatgtagatttctaaatcctctactttgaaatcagctcaatggcatattttaaactcaaaatagaatgtcttctggttcctaatggttgatttaatggtggatttgaccatatgtgtatcagatgtaaaaagtattgtccactaagtggagtaaaaaatgatcttttacagaaggaaaaaaaaactgatttaaatctttagattctcatgggatctcattaaggttctctttctttaatacattgtgcagcctaatagttatcagcagccctgcggtgtgcattgctgataggttagtttacacaggattaattgtgtaattttgcaagcaaccagcacagtgaacactgatttttgcattagccccatgtgttgtttccaaggggactctgctttctattttaaggtggtgttacatttcacttcttattaattataatttctgctagcatgttttatgcccaatatgatttattaaaaatccttcataatgtttttttcctaattgttatgtccttcggtaacttcattaattttgagcactgatgtgtaaaaaatggcaggagaaaatggcattcacagaaggttctctgaccagccagtttccccatgcccccgttgataagttgccacaaatcttttgctaaaatacagacacaaattcagttgcagccactccaggtatgcgaagtgaataatcagtgcaggcaacaacctgacaatactacattcctcaaaccaaaagaatgcgaatgttcaaagaagtgttggctaagcagaactcagtccattttccacaatacgtagcttagtattttccagaaatacttgtgtattcggaagaattagaggaaggaaacttttgtttgaattttccacataatagcttagttcaatactcagctactacattttatcgactcttggtgggattatgaaatgcctattgaggtttcagtggaatctttatagctggacttgatattcttttacatggttttgaaaaaacaaaacaaaacaaaatgttgactgtgcacagtttagaacttaatctttaaattctttttgccttgaacttgaaaatcaattatctgtctgtgccccaccacctcttccctcatctcagccttcacgagataaaatttctctccctccggagcacatggtctctcaaaggggaagagtcacatctccttgtctgtgcagctgttgcttcgttttgtttagggtggatcttctctccttatccccgtgagtttctatagtattataaaggcccaataaggttctgtacaaagtgggtacttaaaatgtgtcctgagtgacaaactggcccccactggaagaactctttaaaacactctgttaccagagcttcaaaaagggcttgtttctgaaggatcaaaggatctcttgtataataaattctgagcattcagtacataatgaagagaagaaaacatgtcttttaagctcctatatgatgcctggattatgtgaagagatgaaggaagtggtgactctttctggcttttgtgtcattcacattaaacaggaatagatgaaagcaaaggcttaacactgacaaaatcccaagtaggcaggctctgcatccacagcctgttcacacattcataacaaaccaccagctgatgacttgaaaaaaatatgattttctttctagtgaaagactgactttgttttgtgttttgtgccttttttaaacatctaccttcagaaagtataaaccttttttttttttgacagagtgattgggttacaatattgttacagaaggactagaattagaatcacaatacttgggtgccacacttgacctttgtcacttgttatgtatgacactaaggaagtaatttagtctgtaaattaattttatttttcatcatttataaataaacctagtaaaatgaacatgaatagttgtttcaagggtttaatttaaaaatcatttttgtattgtggtaaaatgtagactcttatattcttataggcagattgcaataaaactctactaagcaattacactagattttatttctctaaattaaggctgaacaatctcttttttcagttccactttgtctgagtagtttgaatggcccagatcagagatgatttttgagactgttgttattgtgtttgatagattgtgctcatgaaggcacgtgcatatttatggagaaagaatccttagctttccccagatgctcacatgtgtttgtgatcctaatggggttaagaacccttaacctgataatctcaaccaattttcctttcacattaagtgggagtcctactattttagtattaagtaccagaagggtgaattttatatgttactttatatttactatcggttttgtctaacaggaattttgtgcagtaaaatatctacctttcaaattccctgggaggagaaagacaatgcatactggagatatgaacacttttccacaatacttataaaaaataaaaataattaccttggtgatttcccataattaaggcagatttttttccttcctccttcctctcctctcttttttacgttaacaccaccaccctcatcattaccactgccacttttctctcttccccttgaacagagtagataattgcatatgtacaatttcctagagaactgaagcaggcttagcccatagttgaactaagtttcaaagtttgcaaagtaagactggattaactatattttctgctaagtgttggttttaataaaaaaagaagtttatattcattgaaattttcagttgggagtacatgttttaaaaccttatttcttccttttttttttttttttttttgagatggagtctcattctgtcacccaggctggagtgcagtggcacaatcctggtttattgcaacttctgcctcctggttcaagcaattctcctgcctcagcctcctgagtagctgggattacaggtgcctgccaccatgcctggctaatttttgtatttttagtagagacggggtttcaccatgttggctaggctggtctcaaactcctgacctctggtgatccaccctccttggcctctcaaagtgctgggattacaggcatgaactaccacacccagcctagaccttatttcttaatctctgaatgtgtttggtgtgacactcaactatactttcagcttacctagcccaatataaattttattttaatgaatggtttccaacattttgactctcctcatgttaaaaaatctctggatttccttatatttgatttctgtacttatcagtatttggcaggaagacaagtcatggcaacaactgatggctgacgagacgttatgcttggaattcgtatattcatctccttaactgagaaggttttggtgtctaccattactgacctcactgtgaggaggcaccggagaatcatgatctcattctgtgtattggcatgtcattacacattattaatttggtcttttgagtgacacaactgtttttgtatatcggtgtgtttgtgcactgtccctggagctctttgtactaagttatttttatttcattttcattaacaatattttgggaattgtcattgaatttgtaccttttctaccttgcactttacaataattagcatattattatagtaaattagaagtttaataattaaggtaacatttagatcctgtcaataactatagcctactttattttttgaacgttttactatgcccctttgtaacagttttaggttttttaaagagtcattagagtcacttatttatgctctgctgattagctatttattttcacagttttacaagttagatgttcgtacttagatattttttacagatcgaagtttctatttgctcatgagtagctataaaataataattatcattaggttagatattttctgtgttacagtttgccatttatatattctcattgccaccctgtgagtgaaatgaatcagaggttgttagctccagttaaaaaaaaaatgaagaaagagaccttcagagaggttggctaaatggcttgctagtaagtgcctgagatggtgctgttctgttcatttaactttacattttagtctagaattttctctgttactccacttccttttctactcaaagacctttttataaaagaaaccagggagcacttaaaatttgttctctaagtttagagctggactcaaaccattactggcaaaatcaatctggtcctttctttcctccttttttttttttctttctctcataatgaatcaagacatccagcatccttgaaaccttaaaggtatctgaggatacaaagataccaaactggagttatcttcctgacacataaatctgatcttgtcatttcttactacaaatccacgatggtcttttacaagataaagtttaattatctgagcatgacacctagggctcttcacattctgtgcgatccaacttttcagcctcgtctctttttattatctattgcttgcccttatacacctcatcttcagcctccaaaatttcatgtatcttcttgactgtgccctgctcttttaggtttctgagttgcctctcttgcttttctataccagcccccaaccccaacaggaatgccattctttcatttgtagcttgctaaactgggtcacttacctaaccaaataactatgtggctttggagaaaatactgtttttatttcttagcttgtttattttgatgtaaaaaaatgtaacgcatgatcattaaaaatatatctattacattaagtcatcttcaatttctgcttaccactttcttcccataaacaatggtagcaagttgatgtttttctttctaatgttatttctcatgtagacattgatacatagtatttttcataagagcaaaattaagctcacattctataaaaaattttgtagtgctttatttcacctaatattatacaaagtctcagcattcaatattctttaaaaacacaactttttaaaattataaacttttctaatacataactatattctacatatttaattatttctctattattgggcacttaggttgtcacccaaattttattgttataaattacactcagtaaagatttttccattggtagttggtgatatattaatatgtttaatccaaacttagttagatttctagatctgggcatactggccaaatgaacataaaaatctatgttagaatatttaaagaagtcaaaatgctcataatattatgtagagataaatagcatatcatttttacgtatgtaatgtattcatacacatatctgtatgtgtgtatatgagtgtagctatagcactgggtgaatattaatatatcaattgaggaaggaaatacactaaaatattattttacagatgatgtccattttattaggtatatgtgtgtgtgtgtatatatatatatatgtatatatgtatgtatgtatacatatatatttgtattttaccaaatatctagagtgagaatttgttacttttagaataaaacaaaactcccacaattatccaccttaaccaattgctgtctcctacaaatcctttccaaccagacttcatgggtagaaagcgagtttctgctggtgaaagggtgaaactacttgaaaattatttattgtctcccaaggttcactgcagcatgagacgttacgtagttatcaagactaaaatacaaagacagccctgaaaatagctggggagtgtgaaaattagtaatatttaaagtactgaaaattagtgatatttaaaggaaaacagaaagtttagctcttggtttgctttgggagaggacgggactctgaagcccccatgctggtgaggcacggatcttggagggtggtcagaggttgaaagccacttgagcaaatactcagtccaaagcagcaggtgcaatggctcaagcaggaaacagagtaatatcctgagattggctatgtttagacaagttcctattttggggacacagggctccccattcatgggtgtgccttgagtgcagtgccagacacagaatagtcaagtaatatgttcttggatgaataaacaaagaccctttgtacaatgctctgggacagaaatgcttcataatagtgatgttaacatcttttcacacctaaataagcctaaaagacttccaggcagttttcacatgtatttcagtgtgacttaatgatttataattctttttttattactattattattattattatttgtaattatactttaagttttagggtacatgtgcacattgtgcaggttagttacatatgtatacatgtgccatgctggtgcgctcacccactaactcgtcatctagcattaggtatatctcccaatgctatccctcccccctctttctaaacattattaaaaatatttgtgtcactaatcttgcggccataaagaacaagagtttgctttaaaggtgtactgatgctgcgataacacctatggcaatatttaaggttatcaaaattataaagctccatcctggagaaatggtcatgtgacattaggcaatatgtaacttcttcatgccttagtttggtcattgttaaatgaaggacattaaaaaaaaagcaaaaccgtatctacctcatgggttgtaaggataaaatgagttaataaaatgtaaagcacttaagagagtgcctggcctgtagttagccctgtataaatgtatcccattatcattaccaaagaagcttgacattggtattaacttgcccacaattaactggtgtgatcaggcattagttcaaggtggtatctgaggttactatcagatacattttggactatataggaaaacatagtgcttctctataaattgtttgcagaattactaccacaaattttaatggccttctacttccaggggaggccatctctatttgcattagaaagtaatataaagtcagaactgggtcctatttgagatctaaaagattatctatttgacttattcttaacttacaacattgacatttttgcttattgctttcaagactgtttcaaacatgatttctttcggtatactatctttgacagtagtgagaaaacaagagatgcctctgccgtcatactccaaggtgggaaacagaggactagcacctccagaagagggcctctggcttctgggaggtggggcttttaagtttcatgatttggtattggtgctgggatctgagttttcaggtttgactatgcaacatgcttgaaacatggcctcaaggattgtttggctgcctcagcattcatggtgggaagaccagcgtctgaatgataagagatttggaccttgtgtggcagcatttggtctcaggccctgctccgcctgcttgatattctactgtgatgaattggctatagctggtttcccaggagctttgtcatatccacattcgactgcagaaaaaaaacaggagttaactaactttcccaaagtgacacagctagtaagtggcagagcttattcattcactcaagaaaatatttagtgatgacctgttttgtgctacatgctggagctggatgaaaaccccaaagtgtctgagtgttactgatatcatcaatcagccccaggtccttctaggtcagccttctatagggaagggaagtgttcttgagaatgtgtcttggttctccatgatgttcttggacagtagcaatgaaatgcatatcctcatttctatgaataaactatgcctgcactggccaaaaatgtgtctctccgtttttggaagctatttatttctttaacatatatgatctattatagtaatataattctattgtgtacgatttgccctcaatttatttctggaggatttcctgtcttccaagttgtaacaggccaaggttgtagaaaacattatactgacattttctgtggcccttaacattttatttcagtctatctattctttgtattcatctttccacactaaagatttctaatgtttctaatcttcctctgtgtgaatcccatggccccagcctcttaaataatgtagtgcctttctctgtacctccttcagtcccattattagagagtttttaaaaaataatcatagacttttagggcaaaaaaaaaaaccttgtaaatagcattcagttgaaattctcatgtcgtggataaggattctgaggccccagttagttaggaaacacgtcattaatagggagtgttactgacatagcaaggaatcaaactcgttaggacctctgacttgccttggaatgttctttgctgatatctctctattacgctgttggcttctaatatggtttggctctgtgttctcacctaaatcttatctcaaattgtaatccccatgtgttgggggaaggacctggtgggaggtgattggattatgggggtggtttcccccatgctgttctcatgatagtgagtgaggtctcacaagatctgatggtttaaaagtgtgtggaagttccccactcactctgtctctctgctgccaccatgcaagatgtcccttgcttccccttcaccttctgccatgattgtaagtctcctgaggcttcccaagccatgcagaactgtgagtcaattaaacctcttttctttataaattacccagtctcaggaagttctttgtagcactgtgaaaacaggctaaaatacagcctcctttagacagttgaatatagcttaaaaatagtaaaagactgaggtataatcagtatggagtccttttctcaaagtattttagatgagtgatgcaataagaaagagggtctactgtagataaaggcacaggccttgaggttacacacattaggttcgtatcttggtgttgacatttattgtcattgtaactttgtaaatcatacctaacttaattgaattcgtttaatcttatgtaaaattaaagttagtggtacccacattaaaggtacttgtattacgtgagattatactaaattattaaatatgacatctgacatataatctgtcttcaactgatattagaaaaaaatcacatatgatgtttagtggagagtcaatatctgtgatttagtaaagaaatggtaaaactcgtgatcagaaataggggctatttctatttagaatgctctttcagaagtattcttagaaaaagttgaacatcttcacattgcctatataaggttttgctgataaataattcccaaaagccaacattaacaaagtatcgtattttttctagttcttactttattgtacatcattttatgttagacatattgaagaatttctgtctgtgtgttcatttttgcagtactagtagcttataacctagggaatattatgtgcctcatgtatcattttcctttttaaaagatacagtcattcaaatttgtattgagtattttggcacacattttgagggtctgggcctccatgatttgaatcaagaactgattcctttcgggtaaatgttagctgatgaccaaaaaagaggtattttcaatcccagtttcttaagaatattgacctaaatattgactaaaagctgaggtgctcacagccttttctagcaatttaaaaaatcactcaaaacctccagtgtttaaagatcaattgagatcagatacattttttaaaggaaaaaaaataaaaaaaatagccagttttgatctcaaatgcatacacatctatgtagaataggcattttttgtcaacatatgtgtattaagcaaccaatatttggcaatctgacagcaattgtgcttgagtactaggaaggcaaaaattaataagatcatttttccccgacctggacttaaggaactcaaaatcttgcataaaacattgtaaagaaacccttttctggccaggtacagtggctcacgcctataatcccagcactttgggaggccgaggtgggtggatcacctgaggtcaggagttcgagaccagcctagctaacatggtgaaaccccgtctctactaaaaatacaaaaaaaaaaaaaatagctggatgtggtggcgggtgtctgtaatcccagctactcaggaggctgaggcaggagaattgcttgaacccaggaagcagaggttgcagtgagccaaaatcgcgccattgcactccagcctgggtgacaagagcaagacttctaaaacaacaaacaaacaaaacaaaacaaaaaatcttttttttttgtcttgtgagaataaggcatgtagctgctcacacatgtagcttatatagcagctgtcaaggttcatatgctaccacgtggggtactgtgtgatttcctcctgatggctgagttgagtggggactgtcaagtagggggaacccggagactgatctcaagtgtccctcccggcttcactggacatcatcaatcagaacagtgatgtggctgctgctaccgcagctgccccttgcttatcacagagcaccggctagatctcagcctagtgctaagcaatttttgcatgttagtaccattcctccaagccattctgcaaaacagatactattatcccttatttaccaatgagacaactagagttctaaaaggctacttgattagcttacgatcgcacaacaagtaagtgcacacttgctccgttttcagtctgtctgtcccttttttctctgctgcagcatctcttttgacagacactgtggtggtaatgtgctccctcctgctccatgaagctatgacattcatacttgtgactgtaaggtgaaggaactatgaatactactattaattgatatgtgtagctttaatgcattcattctttaattcatctaaacagtatatatataaaatatatatattttaaaattattttttcataggcttttgggaaacgggtggtatttggttgcgtaagttcttttatgctgatttgtgagattttggtgcactcattacccaagcagtatacaatgaacccaatttgtagtcttttatccctcaccccactcccaccctttcccccaagtccccaaagtcattcttatgcctttgcatcctcatagcttagctcccacttaagagtgagaacataggatttttggttttccattcctcagttacttcacttagaataatcgtctccagctccatccagggtgctgtgaatgcggttaatttcctcctttcatggctgagtagtattccatcatatatatttaccacaatttctttatccacttgttgattgatggacatttgggctggttccacatttttgcgattgcgaattgtgctgctataaacatgcatgtgcaagtaccttttctgtgtaatgacttcttttcctctgggtagatacccagtagtgggattgctgaatcaaatggtagagctacttttagttctgtaaggaatctccgtactgttttccatagtggttgtgctagttgacattctcaccagcagtgtagaagtgctccctttccattgcatccacaccaacatccactattttttaaatttttttcattatggccattcttgcaggagtcaggtggtacagagatgtagttttgatttgcatttccctgatcattagtgatgttgagcattttttttcttatgtttgttggccatatgtatatcttcttttgagaattgtctattcatgtccttagcccactttatgatgggattttttgtttttttcttgctaatttgtttgagttccttgtagattctggatgtcagtcctttgttggatgtatagattgtgaagattttctcccactctgtgggttgtctatttattctgctgactgttcattttgctgagcagaagctctttaattaagtcccacctatttatctttgtttttgttgcatttgcttttgaattcttggtcttgaagcctttgcctaagccaatgtctagaagagtttttctgacgttatcttctagaatttttataggtatcgggtcttatatttaagtccatgatccctcttgagttgatttttgtataaggtaggagatgaggatccagtttcattctcctacatgtggcttgcgaattatcgcagcatcatttgttaaatagggtgttctttcccccactttatgtttttgtttgctttgtagaagatcagttggctgtaagtatttgggtttatttctgggttctctattctgttccattggtctatgtgcctagttttatacaagtaccatgctgttttggtgattatggccttatccaaagagtatatattatgttttattatggtgccaggcagtgacattggtacaactaatatatgcccttatggaactcaagatttcttatgttaaatacagaataaaggaagtaggaatatttatagctgttaggcctttagttaattttgtctagatggagtttcaaattacttatgatttgttgtcagttcagtgcataaggagaaatttatcttataaatagcttagaaaggagtcatgtcataaaatgacatgtctcaaaatgtcttgtgaagccaagttttcttccagcatggcaagcaatcaccatttctcttgctgagcatctaatgaagtcataggtttgatgtagagggtatgttgtgtgaaaagtactactttgaaatattagataacttcagagtcacaacatgctcatattcagaaaacaagtgaccctgacttccgctgatccgcagctctcatattacaccagccatgggtaggttgtttgctgagtgtaccctcataacccagtttttactgtatcttgctcttcagcaagtgctgtttctccttccagtatacttctctctggtttttttttttactttgcctcaagtcagtagagtttaatttaactagtttttttgtgcatatactatattttctttcagtcatactttttaaatcttagttacaaagcacacaaccaataaggacccaaatgttgtttcgccttaaattactttctttttaatattttctttttaatattcctctccattcttgttttacatttggtgggtatatttatttgtatctcttaagtaaaagaaactaagggactttgaaaaaaaaacaacttttcactaataacagagaataagtaagacgttagtatctatgtcaatggtggtgagggaaagggtaaatgctttctagagtaaataaattcaaaggattgtatgtcatgttaatataacaaaaacaaaattagaaagacgttttcttagattatagtagtgtattgtgtatatacccttatctaatagtgtttgagtctatccctccactatatgtatatcctaaattgtacagagacactagtatgctaaaatttatcataagaaaagattaaaaggagagaaatgtttaaaaatgagatgaaaaaccataagtacatgtgtgtgtatgtatatatatatgtgtgtgtatatatttccatatttcttgtttcattctaaaggatggtctgtgcatctctttccagagatcatgcacctacaacatgaaggaatgaaagaaaacctaataatacagagactggctgagcgcggtggctcacgcctgtaatcccagcactttgggaggctgaggggggcagatcacgaggtcaggagatcgagaccatcctggctaacacggtgaaaccccgtctctactaaaaatacaaaaaattatcccggcgtggtggtgggcgcctgtagtcccagctacctgggaggctgaggcaggagaatggcttgaaccagggaggcagagcttgcagtgagccgagattgtgccactgcactccagcctgggtaacagagtgggactccatctcaaaataaataaataaaataaaataaaataaaataatacagagataattcttcatttacaataaacactaagaacacatgcacacaaacacacacacacacacagagagagagagagattagattagtagcaaggaacttacatacatgattaatgtgaatgccttctgaaccaaagctgaaggaagcagatgagagctctgtgggcgtaggctgctgctgtgagcatacaaataagtttgatcatagctacagtctccatgcctaatgtcaaacaactgtcttgaaaatcctaagtgagagtggggtgggtaattcagcacaagtactgatctctgttgtcatgaatgtccttgacagtggtaagaagtggggacccattgggaagagccacctgaggtggcttcatgacatgatggattttgaagagatgtcttagacagatctaatgttagaacaataaaagtggtaccatggctgtaggagatcctgaatgcatgacattctttatcactgggataaagaacattctagattaagtcatgtaacattcacctcagcaaatggaacagcagggtcagcaaatctcattttgagtcaacaaatgcaaacattgcattatttcttttccccactgagagactgtcgtaacacacataggatgctggacacagcaacatgggagccaggttctgtactcttctacttaggtaaacttctgtcagcccgcagaagtcagtgaacacaattatattaaaacaatgtgtaccatggacccattggtcagaagccatattaaatgcagtttcatgcatggttagtcatccataaacatttctgcttgtaataataatgcggtcagaagtaggccttgtggggctgaaaagaggttactaaacaaaagtattaaggacacagtctgtgcagtgtgtcacttggtcaactggaaagcagtgacgacttttcttatacttgccagggtggaattcttctcagtgtattggtgtgaggttctctccggaggcattgcaatctgtttctaactacttggcaacagcttttggaataaggccaaaaagattgtcaaataatacacagagtggaaatgagctgtttgaatttttcagccatccttccttttcttagggccaaagatgtagttttataaatctccttaattagtaatttctaccagaatgagttagaattattacatggaatttagctcttctgaatgatgttcagtcattaagttatgacagctggtatgcaaaaaaatgttgacttattccaatcgttctgatgcctaatagaaagtagagttttttaaaagcatgttcatgggatggcattcaaaaacaagcttaagcaatctttctgagattgggagccaatccttgagacacctgggaatgaacagtaaaaggattggatatattggttgaatcagtctcctcatttcacatgttgatgttttaagagataggcggcttggcaaaccatggtgagagatgacctcttgagttgaaggcttatgttcactctgtagttcagaggtctgatctttcaatgcttcctgacgaagctctcctcgttttggtccatatcgttttattttgaaagattagtcacagcatcagacagatgcaagtagctattgtgccagacaggtcaggagaaccgctatgtagaaatgcttacagttgtggtctgttgcaaaatacgtgaattcatgagagaagacacatcgataatgttttcaatgagaagtgtaattacgtggctgctttttgcatgcctgccctctctcctccttttgttccttgacagaaattcgcaggaccccttttttagcaacagagcaatactatagcttaggtatttgagtggaaattttgaggggtgtggggagaaagaaaaattaaatccatttttttaaacagaaaatgtaagaattaatttaaaagtgactcaaatgataattgtttccaaaattacaactttctaatctatccctaggtgctgtaaactgcaaaccataatcctgtcttaatactgcaaacaaatcatagtggaactaaggggaacttaatttactggtaagagtattttccttaatcagttgttttatgcatttttgattgtatttaattattgcagtacatagggcaggagtcacaaaagataaggataaggagacgttgcagaacttttgtcttcactacggtcttagcgtagatatggaccagatatatcatatagtgaaggttttttttgttttttgagttccattaaattgctggtttatttttgaaagagcaaaacccttaccttaaagttatttttcttgttggctgacctgttggcatatttgaaagtggcatatttataatatttatcaaaatgtcatttttaatagaaaaaaatagtttcaccactgagatttgagaaggttgacttctaaggaggcttgaagtttcagtgagaaaacctgtattttcagggggttaacagagctcacgcttcatagtctgaacgacttacagcttcagtcactgttccttgaatttgaatccgtttgaaatctgacctgaatccttgattggagttttttcaaattctttgtgcaacaccaagctgaattataactaatttcaaagagtttggaacaataagaaaagttcacattggaaggagggccaaacacacagtgatgtagttctaggtaagctgtttagctattttgatgacccattttgtaaatcataaaactggaataatagttgtaactgcctacaggtgcagcctaaattagattattacgataatgaatattagcactgggtttggtccatagcattgtgtttggttcagtaagtgccaataattagtatcacgactagtttttaaagacaaaataattggaggaaaaacaaaaacgagtaatttttttctcaatgatgaaagaatggttttcttactttctcaggagcacattatgtcaccaagagaatatgcactccagaagaaataagatattacttggtgcatgaagaatttttttctatgcatttgttgcaaatgggaccttaatacaaatataaaataatgaagaccatgtggaaagagatagaaaatcttggctttatgggttactgttagcatacctggttcctggtaacccccagcggccttctaaatgaatgcaggccataccaagaataagtctatgaagaaactctctgtgctttgaaaaacatttgatctcttctctcatccactggagtggttttgccctccactatttttagatcttcacttgggaactttctccaagaggggttctccatacagactttctaaccacagggcatctgaaagtctcttgtaacattaaaaatggtttgaagtatattctaatatccttagagaaaactcttcccaaaacctgattaatcaattcctttgatgatgattgtgtgggatacatttattccattaaaacacttttatgatttcactttaaatgaatttctagttcataagaaacataggtaaatcttctgagatagtaatgaacaaaatacaatacccagggtattaaattttaaaaaagagattatcatactactatgagaaactgtaattgtggttgtgtcatgatgatgtattaataattatttctcttgacattatgaaaatggatggtaacccgcaaaacacccttcttgctcgtagccctgcattctttcctgtattttattgaattatgtttatttcttgtgttcctcttggtgattgatgaaatcattatttaattctacaaaataagttcccttaccgtcagttttcattgtgctagggaaatcagccatcaggttccaggaagggtttgtggaatcgtagtcataaaacacccatacccacacccacacacaaacacgcatttacctaatcttcatttttcttttcagaatctcttgtttggaaatttcctcccagaatacccaacctctcaagaattttaaaacgatggagtaaaataatcttcaagctctgattagattacaacatatgaatgctaattttgtttttacaggtttcaacacccaaatttatctgaacttagggcacaataagcagtttaactgttagaaatcttatgagattgagtttgtgcctatcagatgaatacatatttgtatataacatttcaattattgctacatttatgtataatttatccaaaagcgatgttatccatgcatcttaacagaaggcttaagtagttgaatgacagggactacatttttgctgcagaagatcatgataaaacatgtgctgtgtggtcaccttgggtaatgtgccgagactgcttgatggtacttatctctacacactgcatctcatactgatttatggatttggatgacttattttatgtcaaagacataaagagagtagagaagagagaatagtattttcatttcagtcttaaaaaagttctatcctatgagatgttaacagctgccttctcttggtggtctgtgaagtttttataaagatattgattattttccaatgacacacaaatctactgctagagaccattcaaatgcttagttacaccagggcttggctcctgtaccctgaggaggacacgattaaccaaatcctcctttttaaatgttctcaggacaatgagctgcacatacggcacaaatgcaatttgcttgaccaatcttgcctctgtctccttctatctccgtttacatgcttcatgctcagttgaaattaattctctacacattggtctcatgaacacatctttgagagcagagttcaagttaaatttttattttcatcattacctctgagaacacaatctggggcatattagacgctttgtaagtgtagaggtggggagaaagaagaagaaagagaggaacagaaggagggaaagattttcctgatagatcactttctggacactttctgtgctgagaagttctgagattgcctctctggatcctgctatcttggcagtcttgctaagagtttccatttacacttaaacatggttactgatgcgtcttaatgttgccttaactatcaggtttctgatagccccacatagccaagtgggaccctggtcaagaagttcacctctgttaaataaatatgcatagattttcaacatctcttcacatgcattcagaggtgatgaaagattccactggatgctagaacattgtgcataaataatcgaagttgtatgctcttcagcaatgatgctaccccatatcctttttttttctttcccatgatatgaggatatgagtgcagcagaactagctccatgcccttgtcccagaattaatcattcctatccatatttgatgtctttaccttttaaatatttatgggctgttatgttcctttcttgttgttcacccactctggggacattcagaagcctcacatttcttccttagccaaacaccccattcccttcatcctctctcagctgttctttggattacctccaaattgcatacataattttggtattgaggtgccaaaaatgcatttgtttcaactggagttttattgaagttgcttttactcaaatcaagtacacaaataaatttgatttccaaggcatgaaaattcagttaggtctccgaagggaagctgaggtatacttatatttcattataatgctacaggtagattttaagtcactaggaaaatgacatctcaaaatcaaaagattatagaatgagcactatatgaagaattacattttaaagcataggtctgtgatcattttgtaggtttttgttgttactgtcagtctattggtttttattaataattttattgaggtataactgatacacaaacgacatatttaatgtgtacaatttgatgagtttggacatatccgaggactcatgagactgtcactgcaatcaaggtaataaatgtatttattacttccaaaagtttcctctgtccctctgtttttgtttgtaagattttaataggctcaagctcaatcttcatagcctttttttaagttaattttttctttctttccaaattcagaaggcagattcatttcatcaaaagaaaacagttcctcagttgctactgcattgcagagaaaagactgactataatcaccattaaattattaaagaataaaagatactgaaacccagcaaaacttgggtgatctctttcataagcagacacttttaatcttatattgacatttaaaaggactgttcaagtagcaacatgacagactgcacatataaaatgtccatgaaaatatgtagcacagctaaacaaataactcagagcaaaatccaatgaaaggagaaaattgtgtttcctcaagaaaatgctatttttgccctaaggcaattcttgctggagaaaaataccatgtaaaacattgacacaaatcacagacatctcttctaaacagtggattttattggactgcacacgcgtgcagagatttggcagatatttgaggtcttggaaaggaaacaaaccagcgaaatatatcactattatcaccaacacaactgcagagggcaaagagcagacacatctcagagcctagtgatgaagcagggcattaaaaactaaatcaaagcctctgatcaaaggctaatttagtctgtcataattgacttgcagtggaaggaagcctcatgcacaaagatcaaagattagtgacttcacatttaccacaacatccccaccctaaaggagggaaaaaaatcagaaagaagaaaggggaaaaaagaagaaacatgtcaaagctcactaagaaccctgtgcaatgtaatctacctttcttaaggatagcatgcattattagaaaaatgaaaatgaattttattatggcatgtttgagttctaccttcgaaagagtgagaaactggcactattggcttaagtaacttatttgcaaacaggcattattaggcagtgccttttgctgcagttgcttccctttatttgtagcccttcaaatgcatacattaagattctcttcacagttgcaaacagcaggtaaataattgtatatttgagagactattgcctattgaatttaagttggtcacagactttggtccatggtaacatactaattgttaacttcctgttaaccagttatatcaagccttatgtaatttttgttgtttcagtacatactgtgaatatagccagctccctaactctgtatgaatattatatggggaggaaaaaatcctgtttctctattcttctaaaatctgtacctggggactgtgaattaaactaacaaaagacagattaataggaaaaaaaagcatactttttttttttgagacatgtctcactctgtcacccaggttggaatgtagtggtgcaatcatagctcattgcagctttgatctcccaggctcaaatgattctcttgccttagcctcttgagcagctggcactacaggcatgcatcaccacacctggctaattttttatattcatagagatggggtcacactatgttgcccaggctggtcttgaactcctgagctcaagcaattctcctgcctcagcctcccaaattgctgggattacaagccacaaattttatttgatattagtaatttaatttttacatgcggagaggatgtcatagtaaagaagtgaaaatcaaaaaagcaattagaccaggtttgtatactattttaactaagggtgataaattgtgtagaagtgacaagacaaaggaaaagagatttaggcttctaggagcagttaattgtgagaagttaagtatatgggcaaacctagtggaagattagggttatttttagtaagatttgtctgtgcagatctatctcagtactgagtttctatctccagtgatagtggttgtcctcctggtacagcagtgggaacggggaagaccctcacaaaaggaagtgtatgtcctccttttaggcctatagtggggaggcaaagagctctttctgtgtttgctgcttgctgactgccttcagctcaaagtaaaccttattgccaaagtggcatattttggggtgtcatattctgatctctttcagttcctatttattatattctcctgtcattatgctttgtatattttatgacattttaaacctgtgccatgtgtaaaatgacagtgaaaaggaaggtaatcctcttatgaaatgtctttctagttgtctaattatagggtgccctattagtttgtaggaattaagcattttcaaaggcatttattcaacgattgtttttgtgtggctgttaagagccacagggttgaagatacagtcgcaaagagagacacagttcttatcctcatgaagcttataatcttataaaggcagatatgttattcaagttataatgcaaacaaatgtaaaattgctgctctaataagcgccagaatatggtgatttgacctgtggtggtcagagaaagcttctctgagcaacaaatgcctgatcagagttgagaagtaaactaaaccagaaagtaagactagaaggatccatttgattgggaactttattagaatgctttcatttttcttgagatagatgtggaatccatctgtgctggggaggtaaaaaattagtccacctctcaggcagaggacagacagtgctgtagataatgcactgagaatggattttagttccagaaaaatatgagttccagctttaactcagcaacttttcggttgaagatttggacaaactagtcaacctctctgaacctgaggctgctaatccgtaaagtgggctcataatccttatctcagataatcatctcaactactgtttgttatcagtgtcatcaacatagtgctgatttgcaatgtgatcttaggcaaaccattttatctctttgagtttcaatttcacacttctttaaaatgggggatgttggattaaatggtttcaagatttctttcagctctacatttccatgattttgcaagcaaatgtaaagctggaaatttctgtctagatatcatgggaagcctatatcctggaaagttagaaaaagtgttgtttttggaaagtagactttttaaaagaggcataattccacccgttagcgattttacttatatttctttaatccacacttagaagtttctattatcttagattcaattttatagcacatatttcttctactaaaaagcctttaaagtgtttcagtgggatgtttaatttcccattatggttggtttctcaaatcattccttttgtaattgtcacatttttacagtcctgtttaaaacaaattcagtttttcaactaaaaatatcaagctgagttggaaatcgaaatccaaggactgcaaaatcaaatgataataaaccaaccataaggttaaactttccaaccaccacaaacttagagaccaccagaaatttgtgttacttgtttcttataaaatatagaataatcttttgaagattcttgtggccaaagtaaaattttattacatttctaaatctagaaaagggaaaactatttttaacaccttgttacttatttaaacataaaaatatttagtttgattggagcctcttcttgactctattcatatttcacttaaattactattgttttagctatacaaagcctgcttctgattatatttatgttaaacatttaatctttctttgtagagccacagatttaagaaagcatccagatatatatatatatatatatatatatatatatatatatatttctattttggtattttaaaatctcactcatgttttgattaataaatattcttaagtgctttcatatttatctttatttttaccttaggaaacacatattgaatatattaaataggtataccaggtgctattgtccttacgttataggttagaaaactgggccattgatttattcaagttcgattgtatatttatcgagtgaaaattagatctcatatctcatatcttctaacttcttattttgcattgccttactgattttccaaggtaaggaagaacctacccaatcaaatgaaagagtgctgacatgaattaaatctggttaaatgtctgatggtctgattgtcctcaatgattatagcattcaatggtattttattttcatttacccttccatttgtttcttataatatttcccattttgttagcctatgtatagatacgcttttcattagtgaatgtccaattatcatgctttcattttgggtggaagactgattagcatggattaattaaggtaattaaataattatagttactgtaatgtaactatatagaaatgaacattagcatggcctaattatctagtatttaggaacatatgctttggagaggtgatttaagtgggcttgaatttgaccttccatacttactagtaatgtgtgcttttacaagttacttaatctttatgagccttaatttctcatcagtaaagaggagatagtagtccttacagagtttatttttaatagacacatttctataattgtactatattttacacatggtaaactctcaatattatgattaacaatgcttttattgccctagccatggctgtgatgtatctcgttatgaaccaattatgctcccttagcaccatagttatagaggatgggacagttaatgcgagttaggttgtttagagttcttctctgaggagttattgaattgatgctgaagtaacagagctggtatcagagaattataccagtacgtaagcaagaaagaaacaagaataagcaagaaagtctcagaggtgtttgggtttctggatccaggggtccctgtagctggttccctctctaccttttctgtagtttttgtatgcgggccaataaagttccataacttgttagtttagcttagtttgatttgggttcctgtgacccactaatgtaatccaataatacaacatcttaaagacacatttctttgtcttcaagttaacatgtattactcacaacagtatcttaatacttatttatttatatgtttattttgtttctcccaattactaaaatgtaagctctatttgaacaaaaacttgcagtactctttcttcagctgttggaaaacctctaccacctactaggttctcagtaaatattggacgaataaatggataaaaagagaaagaaagtgacacttttctaaaagtgctcctgaattaaaattgcatctgtatttcttcctgaatagactagaaaaggacacaaatttaacatttattgagaacttacactgagctagccatcatgttagatattatatacattttgaacttgatgatattatctccattttacgaatgcacaaatggagggacaaagagctaaagtcaaattggtggcctcctggttctctgctcagaccgacctttgagaaccagctgcttccccagctgctgggatgtgtccagtagctagcacttaacatgttagccctgctttagggattgcctcagtggaagagagtactcctttgtgcaatgtcatgtcccctttccagggaagcccacatctaatgcctataaaggcccaacaccatcagctcagctctggacaactcctgcttccgaacacccctttcccataaattgatctcacatccctcactaataaacaagactcttcttcccagggaaaccaacctgctatggtaattttcaaatatctctgcccaagctagtgacatggcctctctaaggaggtaaagtgggctgatacccactgaaactgggagaagtatagttccaaggtatgatctgagaaagggctaggtattttctagggtcttaaagataggttttttagctgggatacagggagcttgtgatgagatgattgtcagggcagcagacatcagactatgcagggccttataagccacgtatcttggtgcttttgtgctgctataatagaataccacagactggataccttgtggatagtagaaatttatgtctcacagttctggaggttggaaagtccaagatcaaggcatcagcatctggtgagggccttctcgatgcttccttcagagtggaggtagccatgcctcacatattggaaagtggaaaggcaagctagctaaatcctgcatgaagcctcttctaaggcctttctgagggccttaatcccattcatgagggaggagcccttctgacctaatcacctcttaaaggcccaccagttaatactatcacattgaccattaagtctcaacacttgaatttgggaagggatgcattcaaaccctaccatcatgcaaagaagccaaagttatatttcctattgtccctaccctttcctcagataccaggatttgcctatctccatctctagctacaattgttctgaattttggggcccgtttttgctgcatgaatttgtatttgaattcaagacttgaaagattaattttcctttcagaatgttattcatataccccttcattcttaacctgctcactggtttcctaccataattacagtctcaaacagtggttgcattctggcaaaacgatgttttgagttagagttgttatgcagttagtcagttgtttgtagttaaaaagtctctttcttattcactgaaatgactggagtcccagctgctaggattcaaaggcaacagggaagacttcctagagtttcatgtgatcataaaaacctttccagacgttttaagtgattatgatttctatgctgcattgacttacaattagagatcattcaagtaacttagaattcagtaacttctaggtcacagagaggctcagatacacactgttgacagccttttggtgtctttgtatgtgtgtgtgtgtgtatacatacatacacactaaactgtactgctgtatgtgtgggaaaaagtctaaatactaagcatttttattctattttgggcaagtatctgtgctcaatggatgcaagttggtatctaaaatctaaaaaatgcaaagataaatggatcatctgtgtacttcaagctttattttcttgcatagttttttcctagtatttcctgacaacctagaacagtagttctcgcctttgactgcctattgccattgcccgtagcatattttagatctaaggatccctggacagatactctaactcagtggatggagcccaggtagctgttttgtttgtcgtggtagttgctctttttaatgtctacccattgtcctgtaagacaactagggttgtgaaccatcggttttttacactatctaaaaggaaggtgtctgtggattgaggatatttcttaccttgcctacttccacactttcaactttctaaaattcctgggattcatgctcccattccccaaagaatagtgagttacctataattatctacagcatctatcaataatgcctttagttcctcactttgagttctgcttagagctaaacatattctaagcgaagtaaggaggtttcatgcttctgtgtatgcataagtgtgcctgacaaagagatgaaacatgaaagtgaaacaatactgataaatgaaatttaaaaatatagtatgactttgataggtagtctgtattctggcacttcatgaaatctccaaattattgtatattaccatagcatgcaatttttacttatagcatggtaaagcagagctcctccttttgagtgatgtacagctattgcaccactctaagtggtaacttaacacagaataaatatgaatagaattatctagagttgtacaactcagtacctttggtttggaccagagaaaaaggccttagagtagtggttttcaaccaggagtgatttcgcccttcaggagcatttggtaacatttggaaatatttttagctgttaacgctaatgagggagagacttgcacctggtcagtagaggccaaagatgctgctacatgttctgcaacactcaggacaactgaatgcccaaaaagaattatcttgccccaaatggaatcatgctgaggttgagaaactctggcttagagaattgtattagtcatcctggcccataaaattcccatgaaaatttgggaacgaggggaggattcatatgtatctttttggtattgtatttctggcgcctgggagcttgctcagcatgcagtagttgctaaatatgtttttggatgactgagtgatggcatgatttgaatcagacaacattattttaccagccttggaatctgggcaaaagtgggctgcttaggagcaaagacacgagtctgtgtatttctgtggttgcctttccatggaaattcccattcaaggggatacctaatatgtaaggattaaagatgcctcctccatggattttccatggtgtctcacattctctaattagttattccttaaagttttgtccacctgtgtatctttagtggtatggcttcatgtcacctcaaatatggaggcattagctttgtttagttcagtatataccagattatgggatggaaaatactgaagggatatcaaatgatcatacgtaatctaagatataattaaataataaacttacataaagcatttaaaaaaaatttagttctctttcccttaattctttcaatatttcaggtagagtcaaaggctggttttgtgctatcatgattttataactaatttttaacaccatctccttttcttcttttcttcttcttttttttttttttttgtgagacagagtctctctctgtagtccaggctggagtgcagtggcaccacctcggctcactgcaacctccgcctcccgggttcaagcaattcccctgcctcagcctcccaagtagctgggattacaggtgcctgccaccatgcctggctaattttgcatttttagtagagatggggtttcaccatgctgaccaggctggtctcaaattcctaacctcaggtgatctactgcctcggcctccctaagtgctgggattacaagtgtgagccactgtgcctggctctctttttcataaagagacagcaaacctcaaaatcagagattcagcttgccacaggtctatttaaaattgtttttatttcaattcatgtattttttatgtaaagtagtgttgatttcctgtttatagcagtggagaacatattaagatattttaatttaaatagaaaagtaagccaattacaaataagtgcaagtagcgtacagatatgaaaaaaatcataatcatgtcacttaaataggcgaagaaatcattgaatttatttgttttgttaacattgtctcatcttgaaggagaagatggaatctggagattgcagcttgaatggctccggaagaggcagcatgttcggtggattggatgtgtttgcataactgtgggaccacatgggaggtgacgcaggaaggctgaaagaggacagtctccaaaggagggagcaaaccttgaaaacacctgcagggcccttttaatggccaactgcatcaatttaaaacgttcacttgctcccccatggctgtctgtccaggcagaagcaacatgacctctggtttgaaaggcctctcagattaagagagaatattgtgtcttggggaaatcaatcatattattatgaatcatagaattatgagtcatgtgttataggttgtttcaggcaacaagacctcagatgtccttcacttcaaccactcttgggatactgaagggtattgccattgcaatctgtggccaacatctacttccacatctctccctcttggggctttcaagtccaagcttggagtcatgtttgtaggagcctcaaatctctctctcaagaattttcatttgttttccccagttctcccctgtggaaccatggaaattaaaatcgaaaccctgttctattactttcacatgtttgaagatagatttcatgtcttacttgagccatttttttcttcaagaaaacatttccagctccttcaacttttccgtccatgagataatgtcagtccctttttccatcttcggaccttgcctctgaataagctcagcttgtctgaatcagttttaaatagaagcatttacacttggatacaattttccaggtgttgcttcagtgggacaaacgaaagtgagacaattgcatctcttgttctagatatcatacttctttatccataccctaaggttactaactttttggcaatttcatcacattgttattaactaagtcccctttttttttttataaagaaggtactacaattatcacacacctttattttaaacgtatggcaacatctttttttttttttttttctgagacattctccctttgtcacccaggctggagtgcagtggcttgatcacggctcattgcagcctcgacttcctgggctcaggtggtcctcccacctcagcatcctgggtaactggcattacaggcacatgccaccatgcatgtcttttttttagagagagaatttcaccacatttcaggctggctttgaactcctgggctcaagtgatctgcccatttcagcctccaaaaatgctgggattacaggcttgagccacaatgcctggcctgcaaatgtctttctaataaaagtatgtgtatctgtagtgtgtgtgtgcacacgtgcgtgtgtgtgcttgtgtgtgtgcgtgcttgtgtgtgtgtgtgcatgcgtgtgtgtgtgtgtgatatagtgggggtggggcaggagataggaattgcagagaaatacgaacagttaaacataaagagaaactggaaatttgaaaatatatgaagtgtctgaccccaagttcaagctgagaagctaggcatcaattttatttttccttagcctgtttttaaaaaagtattttttcaaagtttggtccttgagccacttttcagcatcatcttatcagggaggcctttcctgtatgtcccattgcttgttatctcatccaccattccttgctatctgctttaccctgctttattatttttttcatagctcttattacttccaagcattttatatctttttatttatgtattacaaggcttcatgaaaggaggtactttgtttttttaccactgctatttgtcacaacgagtttattaaatgaacaattgaataataagtaaaaggctaacttgggatgtgattgcatattcagatttttgggtcccaagctgggcctacagaattagaatttctggtcatggggcccgtttaacttacttttctagtgtttcatctgtgttctaaaattttagcaagactgaaagtgcacacaatctcagtgcactaaacactgaaaataaagtgtaatgagtaaatttttgaaatatcagctgggcatggtggctcatgcttgcaatcccagcactctaggaggccgaggcaggcctatcactccagatcaggagttcaagaccagcctggccagcatgatgaaaccctgtctctactaaaaatacaaaattagctgggtgtggtggcgcggacctgtaatgccagttactcaggaggctgaggcaagagaatcacttgaacccaggaggtggaggttgcagtgagtcgagatggtgccactgcactccagactgggtgacagagtgaaactctgtctcaaataaataaataaataaatgtttgaaaaatcaaaaaatggccatcttcctttacattcttaaaggaaaacataagtctgtatcaaggcattagaatataattatgctgactgtatattttaagtcaactgcatattactggccaactggagatcactatctattaagacataaaatttgctataatgtaggtttattatttacagaggtaaaagggccttattcaaaccttgtttcgactatgatgatgtcatggttgaggattcactcccaggtcctaaataacattccgataccagcacgacagcagattcacacaggcacaggcacttgcagactgccatagcttaccaaacaagacccaggtagagcatttcaaaaagctaccaaattgacacagctggggtgtagtttgggaaatttgttcaaaatgctaatctttgaagttaaaggtggaaagaaaaagtctacataaaaaccttccttggaaggagaaactcttatttccctataaacttcattactaacaaaataagggaggagagcaataagaaacaaataagattaaggaagccaaatggtttttaaatgagattattttttctcagacttttccacaaggcgtcagcagctctgtaaccaccagattgtcagaaattagcctggttttttttggacagtttgagaagccattccgtcggccttatttattgtttattaaattgattctacttgattttttgcagacataaatgagattcttctgaatgatgacctaagctgttaaaccttataataacatcactagtcactacttctgcctctcagctagtcagaagggcacaccctatggctttacccttgatcattgcacaaaaagaagagccaagactgtgtaacccaagtgtaatcaaagttacataaaaattacttagtgaagccagcccctgatctgtttagcatcatgtttactaatttattttttttacctccaagtaaagtacttggtcttttttaaaaaagaaggaagaagagcaaaatagagggagggaagaagagagggaaggaagaaagaaggaaagaggagaagagaaaaataaaggaaggaaggagggagagagagccttctcaaattcagaaaataatattattttttctattatgaagcatcgtggaagaaaataaggccagttgctacttaaaagtaagcattgggctgaggttaagaaatcatattctatctttaaattttatattcactacctgtttggcctcaaaaagtcacaaactcattgagctaagatcttacttgtaaaatatatgaattagagctgaatgatattattgaaacattccagctttaaaaactatatggctctttgattattaatgtaactgtcagatttgaaacacaaagatagaatgagtatttagaaacataagccacagacttaacaaccagctctcaaaatcctctcctcagtatttataaagagaaataaattttgaataaaaagataataattgggaagtacaattgttactgattataattcaatcttcaatgttttactggaaagaaattgaacaatatatgttcttaataacttcctttagtcaataatcgagtttgggaatttttagcagcttgagtatatttaagcccagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcccagatctacacagtactcacagggcaggattcacacgtttaagcccagatctacacagtactcacagggcaggattcacacgtttaagcctagatctacacagtactcacagggcaggattcacacgtttaagcctagatctacacagtacttacagggcaggattcacacgtttaagcctagatctacacagtactcacagggcaggattcacacatttaaatgctaagggatgaggtatcaggagaggtataagacaacagggagtggtaaggcctggtacactgaaaaacaggattgttttaaagcaggaaagccttgctcaactctggaagaattttgctgtgtgccaaagcagaactagtcttgtcagactttctaagttttggaagaaaggacagaaatcagcatattaatgttaaaactcataatgtttaagacatgggagttcattcaagccttcaaagacatcactgtgcaaactaatcaaaacacacctgtgagtttggccccactagggtttctggagtttccttcctcccattcaactatcaggtgaactacaattaggtattaatccttaatgacagcttcctaatgaccttgtttagctatttcaagaggatccttccctaaagtattcagaatcgccttgaaacatgaagaccacttcaagtgctatgcaaagtgagggaaatttggagagtagattcttctgaagatttctctgctaaataagttgcactcaactgaaatccagatgtgccagcactgaagctccatcgcaggcaaggccgactcattgaccccaacttctgtccactcaagtgccccgagactgctggtgatttagcaagtgaactccttgccagttgtaagagctaattcaatctcatccccagggtggtataggtacattaagagttgcagctcttagagtagttaatccggaaaaagaaaaaaaaaagccaaagtgcttgctgaacatttaactgaaaaatttctcatttgtacctgatggttctgaattttgtcaactgtttctttgtatccttgtgacacgtttcttatttgtcatgttttcttttaagaaagaataatgtgagggaaatgaaatgttcatttgttactggaaacttacagtgatgagatgtggtgcataagacatcataaaatatccctcatttccatttgcatttgtcactgctccaaatcattcacgtatctctgtatctgcgtctgcatctagctttgatttattcacataattgatgtagagtgacttttcccaaagacatgaattatattaaatttttgatttgtgcatgtatttgcttttgcatatcttacttttagatttttatagctcttcgaactcagagaacattcaccacatctatattggcctagggaatgttgaaagaatgattttaattatgccacatatttttgcactgttcttatctacaaacaattgtataagctatgccttttgaatatattcatgtgctgtgccagatagtagtagtgcaaaatgctaatgttgattttaaaagaatgacctttccttgtgtgtttctttccagtgatctgcttatctaagacggatagtattgatggactgcactatcacagtcttagacttgcagaaatgccttggagttttttgtttgacatttctttgtcccttgggtactttgctctgactctgtcatttagactttactgtaaggataaccaattagtagttaaatgagttgaaggagtctttttatgtactctattcaaataacactaaactcactgtcacatgaataggagatatgaattatttctctacgcacttttaaagcaagcccacacagtaaatgatattgttcataacccctgcctttattgctttcttccctacacttagggacttattttaaagaagaatttatagatcctctattctgtattccagtagaaataataactcagtaggaataggagtatgtagttttttttaataaacatataacagaatggtagaattagttttgaaagccatactctgaaggaacaacaatgagaatacttgctgggaattcgcctctttaagaaatagcagaggactgccaaattaacaaaatgcccctggtctgtatcatttatacatggtacagatatatattgtggacctactgtgttccaaacccaaagattgaagaagtaaattctcacttcctgtctttgacatattcagaatttggaaatatttcggaagctagaagtcaatactcacaatctaactcttagaatgaatgatccttggtcttttaacaaaggacatctgactaataaaatagtcttagagttgtaggagaaatgtgtcattctggacaacaaagaccttctgtctctttcgcaatggactgtttgcgtaaaataccagcgtacttagtgaattagacatctacaacactgtgtaaacattcctttccagtcattgcttcctggtcagtcatagagaccactttgaagtgcctttattttgaacactaggaaagaactacaggagagccacagccctctgaagtagtaatttttgtaaatttgcgaataatgatgttacatcacgtcactgggacatcaaacctgtctaatgtgcactactactcccacactactactgctaaggcaacaaccatttactaggcttattggccgtgtgccaagtgctgtgtttatttcttattttcataggatatgttatttaattaacgggtagctaagagagagggttccagagacaaactgctaaggttcacattcttgcttccattatttgctagctgcatgaacttagccaaatttctcaacatttctgtgtctcaactaccttatctataaaatggaaatacttgcctgataggtttttatatgattaaatcagaagatagtggttaagtgcttagagtgcacagactaaatgttcaatttgctataacatttctataatatcactcaatgaatatttgctataatattttcatatctcttactgatcactgtaactcaaataattgtgctgtcttattattcttagtttgcaagtgaaaaactgaagttcacactaaccttttagtcaaaaaatgcactaaatttctgagctgaaattccaacactgtttgatctgattctgcagttccaatgggggatgatatgtaaagagaaggggtaggactgcacctgaaatgttactagaattctattcaatgatctgtgatcctcatattcattcaaaacctatgggtgggagatgtggggaatgggtgggagatgtcagaatttgtatttacagtgaagcagggagtttaataaggtggaatttcaaggtttttaaaactcgatggtttttgtaaggtgggagtggaatggagagtgaggtagtaaattgggataatcaacctcggagtctctgggatgggagagatttctcctcagtattcaaattctggaaaccttttgaacttccaccaaaaataacaagccgtctaataaacaaaccatcccatgcacagagaaagaaatggatggttggggctttgaagccagtggtggttcttagtctgtgtggctaacccactagggacagatggtattattgggggcagctctcagaagatttgtaaaatatggtgaggttagtagcatggccaattttgttgtacagtatcctcagttaagcatgtataccaggagaaggatccatctttcttgcactttgaaggatttggtaacttattcaggacttggtcctatagctgtggcagcaacaagagtagtcagctcagcttaagcctctgttcctaaaggaacttggtctaaacttgtaggtctaaagacctacaagtggctctgatggggacctgcagtgatgcaccagcgagcgacaaatggagacatttctttaacaaggaaagcgatacaatttctacatgggaaggatgcattggaagcaacctggttagaagggggctggggactcattttgaaggtctggctgcacaacaggcatcatgttcttacttagatttaagtttctttggaattaataaaaattatgagcaaactgactcctttcctgaggtacaagtttgctctgcggctgctctttctcttctgtgaaaacgtgaagctccagttttggtgctagcaacaacaggacagaggcttactttgcaatatgtctgatagtgattgtgtggttttcctgcatcaaagggttaaagttgaaataaaacttgcatttcattttgagcaaataaagcaagagcaaatggcattgtcctgagaaatgttagcacactgtagattcttaaatttattgtggttgaggatggatgctctccagattagcaaggcagcacttccaatgttcagtggagggcactttaagatgcaattatttacacttcatgttgtgatattacaacaatagttaataagagctggagagatttcctaattatctgagggtgcaggaaatcatttcaccctccccttacttgaaatactaggaatcaagtctgcaggaagctggctgatcacaaatcacgtgtcagcacctccataacatttacctgcataatttgtccttattattttttatgttgatgaatctatattgataaatcttgcatttatctgttttttgcagtatgtatttcctatttcacagtagtagggaccctacgctctatttactttgtgctctttcacagtacaccataggatttaaataaatgcctattgaaaaattcaacaaataagccatgtcatttttgttaagcagctttacttggaagcaagacttctgttcaaaattatgctaagatgaagagtctcaccatcatttccctggtgacctgtgggcacagaatttaatgagaatttgtttccttgccctcatagcaacttcctctgcataagatcctaattaaccaccataaggtgatttaggccttggggtggggtggaattattcattttcctctattttacatttatattttacttcataatactgcattcacttcctttgaaatgttagtattaagaagttttctagtagctgttctcttaaaattacgaggatttttgattttatgttattttattagtcaaaaactaaaaccaaaagcaaaatctgtaaaattccttttttgaggatgtaaaattgccttatacattatatctcattatctttaccgattttaaaattaacacctaattaaaccgtgtgtgtatttcaaacgtgaggctaggttctcattgatgctctccactaaattgttgcatgaagctcaagaaaaatgtgaaagattatacagtttttgggcaacaaatattctccctaagactcaagatgtgttttcttaagaaaatagatttaaaatgtgaactatttccaaaatataaagcaaattaagaagcattttcttgaaggagaaaatgtaacaattaccatagaaatgcatttgccttgatatcgtcatttttagcaatgagtttgatcagctttgtgttgatgatcaattctaaaatgattctttcctatgaaaaaccatgctttggtttcatttcacagctgctaatttatttacttcacatttgttgtcattatcgcattctctgtttattcttgcttcaaatgtgttttgccccgacacatgttcaatagatacaatcctttacataaaaatgaaagtagatttctaaaactctgtagtatatttacatcaaactgtgggtaaaataatttggaataataaagtgttttagatattatggcagtgatgaagaaaatgtattgaaaatgatgactaggccaggcacagtggctcactcctataatcccagcactttgggaggctgagatgggcagattatttgaggtcacgagtttgagagcagtctggctaacatggtgaaatcctgtctctactaaaaaatacaaaaattacccaggcacagtggtgggcacctgtaatcccagctacttgggaggccgaggcagcagaatcacttgaacctgggaggcagaggctgcagtgagctgagattgcgccactgcagtccagcctgggtgacagagcgggaccccatctaaaaaaaataaaataaagtaaaataaaataaaataaaataaaataatgactagcttatgctctcagtacacattttggattagatttcctacttcagttaatacaggtttcttctttccctcaatattattgcacatgccataaatatatcttgcaaaactgaataagaattaactttgaggcagctatacatcttatagtcttgttagcatacagaaaacaattaataaagaatcttcggaattatttagatttgagttcaaatcctgagttcaattattaggagttaggtttaagaaataattcactctacctctcttccagtattcgagaatacagggttaaaggcagagctcaatcagatggcaaaatattggctttgtttacacttccccagtaattatgaatgttaaagggtgttgagtgggattttgtattttgttgtagctgttgttgctctcaaattggtaactagagttcacagctgcatgcagagattagcctggtataccatttactaaagagagaagcaaaaaattatggtcagaatcctgtctcaggagcttcttaagagttgaaagaaaaaactcaatttccccaaccatcaaccagctgctcggcttgtgcacaaaaagttttggaggcaggaaggaggagagtagctctttgaaatgttctagcattgtggaatgtgcatcatttatgatcagatgggattccttctatagcgcttttctcatctcaagtcaagtgaagggctccaacttaatcatttgtacagactggtgcacgtgaaagaaggagacttgcaaatgttccctgtttagttaactgaatcagtaatgaacttccgaatctgtttctgtgccaatgttgggcagataggagaaaaatggagagagatggtagggagggtcagtggagcacctacattctcgcctttcagcccaggtggggtacatgaatgttctgtagataaaaaagactctctctctctatatatatatatgagatggagttctgctcttgtggcccaggctggagtgcaatggtatgatcttggctcagtgcaacctctgcctcctgggttcaagcgattctcctgcctcagcctcccaagtagctgggattacaggcatgcgccactatgcccagctaattttatctttttagtagagatggggtttcaaccatgttggtcacgctggtctcaaacttctgacctcaagtgatccatctgccctggcctcccaaagtgcacggattacaaggatgagccaccacactcagccaaaacagacccagtattaagcagctgggcttgagctgttgctggtacctcatctaagggggttggtaacaggctacagtgacaaaagcagcaagaggcagtgagatctccaggaagctggaggaaggtgggatgaaggtggaagtacctgagacctgtgcagaacctgacccagtagaggggccaggctagaagagatgtgataattccaaggtgctaaagaggaagggggaatcaaaaaagagacaacgctcttttattttcatttcagctccttccagccatagttctggccagaaatggggggaagggggaaatattttgaatcaaactgagttttagtgacagaaggtgacttgagatttatggaagaatcaaatgcataaaggcatgggaaaggagaatttggcaaaaaatagtgtggaaaactgtgtttgaagaaaaaaaatggaaatatttcaggccaatgagggtctttgataaaccagttacagctggattagagaactctatgaggcttcacatgttatttttcctgaatttaaaccctgggactcaatattatttctaaccaatcataggtagcgaggttgaaagggagactacagagacctgattggtgtttttaccacctggacctggaagcactgtcattgacagatcccaggtgtaggcagaaagggcaggggatccgggtgcaaaagaatgagccttgccttgtttttgaagtttccgttgaaccaagctgatgagacatctacctgttgttctagttactgttagtgcataaaaaattacccaaaatttggtggccaaaaacaataatttattttgctcacgatattgtggattaagaatatagagagggcagttcttgctaaaagttttaaatgcaattgcagtcaagttgttagctggggctgcagttatatgaaggttcacctgggctggctgctcaccacagctttcccacatggctcgtagtggacgtctgctgccaactgggagctcagctggagctgtggacttgagggtgcacacatgtgtgacctctccatcacagcagtctcagggtagttgaacttcaggcatgactgctggctttttcagaaccaagaggaagtagaaagctttgtttgatcacaccttagaataattggttacaagtatatcattaagaccagcctgaattcaaggagagaggtataagcctcatctctcaatgggaagttgtcaaagagtttgtggacatgttttaaatctatcaccctgtgaaaagccaaaaatactgctccaatcaaaaaaaaattcttatattttggccaaagttccatttcctaaggattgtggggagggggaaggaaagtttttgtgaactcgggcaagtcattttaactcgctgattttcagttttctcttaccaaaatgaaagcaaaaatgcctactttattgtgctattgtttaatggggtgaggttggtggctcatgcctgtagttccaggtactcaggaggctgaggcaggaggactgcttgagcccagcagttggagactgcagtgagctgtgattacaccactgcactccagcctgggcaatagagtgagaccctgtctcaaaaaaatcattgcacttttgtaaatttaaatgaaaagacagtgtctaatatatagtagctcttattatttactcatattacatgaggtatccaaagagaatttctcgcaagatataatgaagaagatttgtatattggaagctttcatttatggttggagaaaaactgctaaagatttgtaattttgaatgaacattggcataaatagaaagccagcgcgcagagcagagaaggctgatatttttatgctaagctgtagaaatcaggaaatgtgtgataaggttatctgaaaaatagattcagagaaaccacagagagaggaaggggaaatcaaagtgaacattgatgaatgtgggtaaggatattgtgtgttggggaagcatcttagttcttccatttaatacacatgtgatgtttgaagcactcttatgaaaagtcatctttcatgttaagtggagatcatgtatttgtaacatttccatttggtagtcatatctctagctattaaaaatcacattgtgataaaatactcttttgataggtgctgactgtaaaatcatatggtagacattttctgcaatgtagcatgatttaatagaattgggaaaataatgtttttatatttctattataaataacattcatatagataatcttaccagttgctatcaatacagggaattcttgtttcaattaattagttaaaattttcattgtttttgtgctttactgtaatattgctactgttatttgaaacacattacatttgtataagcacatgtagcaatgccaaaaatattggggtgcctactctgtgcaggggtttacattagttgttgcatatttccaattcataattttgtgttttttgtattcctgtcattatggtatactttgttgtttttgcatagattttatagtctttttccaggttttaggtttggtaatagaaatacttctatctcatcaatttcaagtctactttcagaaatatttcaggaaggcaaactgcattcttaacaagagactatgttttcgttctttggaaatgggaagataattaagacccatattctgtcctcaggtagctaatagagtacactagtgtattagcctattagccatggcattttcaattgcaagaaatctaaggcaaaagggaattttagatcttacaattagaaataccgtagagttgttcacattatgaaaaataagttacaggattagggaagagcttatgttcaaatagttcaaagcagcaatggacgtattttgtattgaaaattccaaagatgatcataaagatgactccttggcacttgctcccaaatggattcatccttttattcattcagtctttcatccatccagtacttactgaactcccatatttgccaggcatttggtgctagagatagagaggtgaataagaccaagttttgcccttatgagagcaacagtctaatctagggagatgacagacagcaaaatcaatgaagagataatgaagggccacctagggatcattcctattaagctggtataagttggtttaaactagataatgaaagaaggtctttctgaagcggtgcctttgaacctgagatttgactgacatctctgcgaagatctgggaaagtcttcaggtggagggtagagcaggtgtaagaccctaggaaagtgggagcttggtagtatttcacaaacagtgaggaggtgggagtaaattcagcactttatgaagttttgtgcattcttcagtgttgttggcatcagtgagtgtgcgatagctagaaacaggtcaataaattattcatgatcaaaatgaatttgctgtttctctggccacattattgcacccttgggaagtggttagtttgccccacctggaccaaaggagagttccttacccaagaacctgaatcaatatgttttagtttagctatgtttttccacaagctcttaagctctttaattccataaagacaattatcactcctagacttaatcatttttctcttagcctctgtgttaccttctttaatcttattcaagacttgtttcctccagtcccttattgttttgccattaagccttatcaatatttgcttggagctatatttaatatattcacgttctttttctattctctctcattttttctgtgcaaggccaaatgtaaatgtcacgaaattatcagaatcttgaattttgatgtcacatttatgttttctatcataatgacttcttttaaagaataagggtatatatctcttatgaatgcttcttatttttaagttataatgtttctgccttttaaattagaggtggtaggatggtaatatgcctatgttaaatttgcttttctactagatgtgtttcctaactgctccaatctactcttgcctatactgtaatgttccatgctgtaaccagataattctttctgaaatacaaatttgaccacgccataattctgcctaaaatgtgttgatgatttcacattctttttgggtaaagatcagctccttacatggcctacaaagcctcaatgaaatagactcagcagcagggaggctcctctctgaccaaatcccttctcacttcaccagtttccattcactgaccttttcctccttagtttctgttctccatgccagtctgaaaacagagaatttgcatgtactcatttgtcgtgttcactacatttttttccctccttgactaactaacctatacatcctcccaaatctcaattcaatgatcacttcatgacagtcaccatctctggatagattgttaaaagcagatctagacagagtaccacatgcaatttctggtcaccctaaaacattatacatgcacacacagtgcatacacacatataccccacacacattccaggtaatattcagaaatcttactattttaataggaatgtgtttgcctaagttgaaccatgctcaaaaaaagaacattccaaattattaagctgactaaagctgtctttaaacagcagaatacatatacccactgttcagattagctaaatggggaaataactgcttttcaaggttattaacccacaatattctaatctcagatgctgtactagaacagtctggcacagttactgtttggtttatttttttactctagtgagctgtaggctgacacgttaccaatagcttcttttcattgtaagcagcatacagtgtgatgctcaaagtgtaaacaggataatttttaccattttcaggagcatctaagtcatctacagttggataacttttttccacaatttgtgaaatacaggtgtatctgtcaaaactgatgcacaattttctctgtttcttttatctgtataatgacttacccaattcctagtgtgcaagaaatattattgatgtcttattgaatcctgttgctttctgtatatactactgtgatcttggtggcatcttcatttattattctggtggacgcatgtagcttactatcagtgtttttatgagacaagaagcaatatctctcttttctaactaagcatttagacagtaaattctctttgcatggatagcagtgtggtcctactcaccactgcaacttcgttgcctagcatggcaccagcacacagttgaaacttcattcttgaaacagcctgtgggttagggatattctacctatttactagtgatgaaactgccccttaaaggaatgggtgagtgattgcccaagtgtacacagctgctaagtggtaggggtcaggctcttagtcgcagtgtggctcattatctagcatttgctaacatgttatggaggcattttgctactttaaaataatttatttattcaaacttcatattcactggtcagatttcccttgtcagactgagaaaagaaaccactcatttgcaggacagtagcaaacatcttacttgcattccagttgtgtatgggttcttttaaacttcataatattcttttcttattcctcttgctatatattgatggcaaccgtaggcctaggtttaccacatctctatagaacaaagccatatcttatgaattgttttaggtgctatctggactgacacagttttgttacctatagcaaaatatttactgctttgttgcagagaaagctagcagatggttttcatgacatcataggcagggaagagtagacatgtagggtccacatgtttggccttttttccaagagtctaacttcatatattcatgagaattttgaatgaagaattcaataaacttgttattgttctataatgagaaatctttatttgctgaaaacaaagcctattactgtgttctaaagaatagatctcagtctgaaaagaatgctagtgcaaagataaacttacataaaaaaactagtataaaatttaaatattattagcaatcatgattaaggatattattaattgtatatatatactatgtgccaaacaattggctaagtagtttatattttaccttatttaatccttaaaacccttttaacatatgaaaaaacttagaacttgaatgtttaagaaggtaatttttgttctaaaaactaataattagaagagttggggttaaagatatgttgaactctaaagtcgaaattattattgtttatattattcttttaaaaattaagataaatattatatattcattgtcatgattacttttataatatatttttccgacctgtctaaaatgctgtgaaggtaaagatcattatgtctgtttaattcaccactatattaaaagtattatattgcaccaccaatcatattgtatatgatttgtgtccattgtagatactcaataaaatatatcaaatgaatcaacttgagctttgaaggttgggattgtcacaacattaagagtgttataacctttcttctcagacatttttgaggagttggagataggaaactgcagagtttagcctgtttggaagaaagctggtgttttatagtttgcagcatgattggaatccagtgactcaactgcctttgaccatgaggtttcaataagaggcaagaagaacttcagttccaaggaaaatctcctgattaaaagagtcgtacactgatctcaaaaagacttcaatggcagcatggcatggagttcaagagtatgggctctggggctgggcacggtggctcacacctgtaatcccagcactttgggaggccgaggggggcggatcacgaggtcaggagattgagaccgtcctggctaacagggtgaaatcccttctctactaaaaatacaaaaaattagctgggcatgctggccggcacctgtagtcccagctactcaggaggctgaggcaggagaatagcgtgaacctggaagtcggaggttgcagagagccgagatcatgccactgcactccagcctgggtgaaagaggaagactccgtctcctaaaaaaaaaaaaaaaaaaaaaaaaaagagtatgggctccgggccagattatccgggttccattctaaagcactccacttattagctggtgacttttcaaatgacttctctatacccaaatgatctcatctgaaaattggagataatgattgtacctgcctcataggattattattattaagattaaatgaattactgataaaatacttagaacagtgcctgatacacaatatgtgttatgtagtgtttgttacatgagtattcattctaaaaagtcttttaaaatataaagtaaatgcttatagattttttttaaaaaattatgcatctgcttgaaaactaaaggatattatttgataaagtgctaagatgttctcagtgctagaattatataatagtagccacatcctggaaccataaaggcattcttaaggaagtttatatttaaaaaagcaaaataaagagccaggaatgagtaactagtgcacagactgtgaaaccagaggataatattctatatctgtaaatacacataacattaaaatccttaatttgacaactggcagaagaacacagcattgaatcttgtatattttcattttctctttctcttctctaccacattcatttccatgttacttttatccttttcagaatgaccaattgcttccgttttaaactatactcactgtacttgggatttatttctcttaccttatactggaaaaaaatgcaaaaaaagggcattcagaacttacgtgtcatttttatattgcgaattcaaggaaaataaatatttttgtgactttatttctaagtgttacatttgcttattttgtcttttccatatttccccctttccctgtctttggcatgacatttggaattgttattggaaagagaatcaactcagaaatcaggaaagttagccagtgacacattcctttattacatgatgcaaatattttgctttgctcttttaacatttttcttttccataacaagaagttttacagctacatttcacagattttacatctctgcatctaacagaaacataaaatgtagtttgcatttaggtatttgtattttattttactaggcaggaatgtggagtgtgtttgtgagcttgtgcatgtgagctggaaggaagtgtggttgcccagtacttcctcaactcatgactgaaactttgttccagttcaagaaggaaataaagagcccttcaaaatagaatactgaatactttcttcatccgctctatagaaatcaggccaggaagcaaattaaaattacaagaatatccaaaacagaattattttgcttgctgtctgtgtatttgaccactgccttttatgattttaacctttccagacattctctttggggtcggttttccttgtggcccataggagatcccactgaaatcatttactagttgttccagatttccccacaatccccattgcgctaagtggcggctaatgtgggagctgtcatgtttggaaaataccatgatgccatgagttaatttcatacctgtcacaagatcttgcatgcgatcccaggggaccagtggtatgtcacacactactgcaagcgttcgttagtacctctcaaagcaatgaaccatggccaagagatcttgttgcaacatatggcagcacctgtcaccaggcttcatgactggcataaaattaacctgttttcctgtttgatgcgctgcttttttttgcttatccgtaaaaaggatgagaataaattgtatttggaaacaatttactgttcctttcaagaagtataatggtagacttgggttactggacacaatgaatagacagtgtccttgtagaagtacacacactgctattcagtaaaggtggtattttatgaatttctgaatggcagtctgcacatctcacacaggaagcaacgttttagtttctgaactctgtcaaacttagacatagagcaagaaatgacattattgtgagccacattgtggaagaaaaatccaggaagcatgagtttcagatgtgagtttgcccttgcctttcgaatggtttcaagcaaccttgagcttcctctctcttctctctatatttctcacgctcagatcttagtattctaatggggacgcacgaaaaagggacccacagaaaaacaatattcagaatgatgccggatattcagtgtcttagaaaaatagattaatgggatttagtctttaagtcttaaaactgcaatttagcagttatttttatggataaagacaaagaatatagtccagcatttatatatggctttctacctcagagaaatagtaaaagttttttgatcaaatgatttctcaatagagaaagtatccggtttcttgcatcatttttcttttcttttcttttctattttggatcttcttatatatctttttgcagagccttaagcttcttaaaatatttattttaatcgaggggggagctgttttctatagctagtctttttccttcttcttaaggtaaatgcttcttagattctgtgagttttaaaattcatatacagcaaagaacaaagataaatttagcagtcttttccctttatgtcactaccaagtctagggaacaaatggtgctgttcttccacaatctggactggttgctttgaattctggagtaatcaatttttcctggcatttcttaaatggtcttttttattcactgaatctcctttgaaagtataaacattagtccttgttctatggttttggaaattgatgactgctattctcaaaggatagtatagttggaatgattgaaggagcagagcaaaaagctgaactgaaacaatggagggaggaaagatagtaccagagacaatgagagaagtgggcagtgattggaagggaatccgaagtagggattggggacttaaaggctgcttagacttgattaataaatgctgtataaatgaaatgctgagacaagggataaaattgcacttgagaagtcacttgaaaatgtgttaatgcctttacttgacaagcatttattttttcatcctgggtataaaaccactgtaggaaaatgtagatcattttttcacactgagtattttttaactgctgattatggttatgttgtcctaaaatcaggtttctattatctgaaaagaaaataaaaagaaataaatataggtgtgtaaagataagtattttggaggcatggatcttcaggtgaagtgtcatgtaatatctttgctaagtcgggataaaaataaaatttaaaactgaaattcatatttaaaaagttcttagtagagtctaggcatttttttttttttagtgtacctaacagtgatgaaaattttgtatctaaaagaatgagggattttgcaagggattttcaggagactgtggcactgtcatggatggtagctataccattttctaacaaagtatgtcaagaaaattgaacatcagtcttcttactagaaaagagaatctgtggcaaattattttattaataacagcaaactgaagagccacaaaataatttagataagaattaaagtgctgaataacttagataagaattaaagtgctgaataatttagataagaattaaagtgctgaaacaattttattactggtaaagctgaattcagaactgcttctggtaattttactgtatcaagcaggccctgagaaagacaacctggaactgtttaaagggagatgttcaacgatggtcacaagatgcaggactcaagagcttccaccattagaaactatcacctttactaccaccaacaaaatacctttttctctgagaaggagtcagtgaagggtagagatgaaataggaaaaatttggttggttgggtgggtagtaagtttaatcattactcttctttaatgagtaatagagtggaaataactttcctctctggttttaaaagttaactaatagtaagtgtctttgttaaaacacgtagacacacacatgcaccacacacacacacacatgcaccacacacacacacacacacacgcacacacaacaactgtttgctacaggatttctaattaatgatatcacattttctaacccagtaattcccaactggggttatttttttcccctaggggacatctgacaatgtctagatacattttttggtagtaatgacttgtattactggtttctcaagggtagagaccagtgattctcctaaattctcctacaacacccagcatatctcctcacaacaaggaattattcagttggaaatttcaagggccctcaggttgataagccctgtaattgcttgaagtaacttaatctccctagtaattgtgcagtatctcatagttattccttcttccactactactccccacaaatttgcccacaaacttgagaatttacataactccaggagtacaatagaaagggacctcacatccaagtgcttgggtactgtgctatcctctggttccttatttgccttcaccactatgatttactattggtaaagttgtggtcatgtcggttctcctggactaccagagcccagaaatcttctcttgttgatggttcacctctgtcttaaagtctactttgtctaatgttaatataactaccccagatttgttttatttttccaatttgtaccttttttttttttttttttgagacaaagtcccactctgtcgcccaggctggaatgcagtggcacaatctcagcttactgcaacctctgtctcctgggttcaagcgattctcatgcctcagccccccaaatagctgggattacaggcacatgccaccatgactggctaatttttgtatttttagtagagatggggtttcaccatgttggccaggctggtcatgaactcctggcctcaagtgatctgcttgccttggcctcccaaagtgctgggattacaggcgtgagccaccatgcccagcctatttctttttcctatatttttgcttttgctttgtaaatacctttgaatatacagtttatctcttctagatacgacataatcatatcatttcaaaaactattctgctaatccttactttttgttagtgtttaattcatttatgtcttatataattactgataaggtagaattgatgcctggtgtttctatgtctttgcttttttattccttcatatctgccttgtttttcattaaataaatattgtctggcatgccattttattaccttgtttcttttgttgtagctttaaaactattttcttagtatctgttctggggaatacaattagcattttactaaaataatctagatcagataaaaattaacttaatagtatacagaaactttgctctaatatgtacctgttacttctttcctccttggctgttattgtcatacaaattacttttatactgtgtaagcccattaacgtggtattataattcttgatttatgtagttgtcttttaatcggatagaagaaaagagttacaacaatattttaatactttcttttgtattttcctttactagtgttctttatttatttgtatagattgaggttaacatctagtgttctttcattttagcttgaaggatccttaacatttttggcagtgcaggactgctagtaagaaattatctcagtttctgtttatccaagaatgtcttattattatttttgtaattttcaaagaatagttttgctgtgtatagaattcttggttgactgtttgtgactggttgactgtctttctccttcagcacattgaatatgtcatcccactgaaaaatgtgaatggcttcacaaatttgcatgtcatctttgcccaaggaccatagtaaccttccctgtatcattcaagttttagatgggtcaccaaagcaagcactctggatctttccatactgcaatagaaatgaggaagacttgggggaacttactatttctctccatataaatcctgcctttgccactttttatctgttttctggactatactgtatagaatacagggtctttctaagaaaacaaaatactttgattttgtgtccagggatccaagtaaaagccctgcttttggggcatctggtggttttctaacagctcctgctctgattgtttccttgtattccagttttctgcctaatcacatgcagaaccattccattcacatagtgaatacatctctcacttgacacagggatcctcatttatgggaaagaaacacaaacctttcatttgaaaaagatattattatgtttgctttatgcagtacataaataaaacttgatgatcactttctcatagccattctcttcacgaatatcattagcattcaatgcagaaattagcctgcagtcttcccctaatgtttgcatgtatcttttttgtgatccaacattttgctattaaatagaatgaattatgtggagacatgattagataataccaagagtataagtttcctgagattagcaatcacacatggtttattttagtcctttgtagaatgttgtgactatctttctatttatgtacacatgtatctatgaagtacttattcatccatccttttattcattagtctagccagtcaactatctattcatctatctgtctgtctatctgtctctaacatatctttttcttcacaggaattcaatttgatgttagcatatgatagttgtctaataaatacatgttaaattaaattcatatgaggaatacagactctagtgtaaactattggcattactgaaatatgggcttgatcattcattgtgtgggtaactaccccatgggtacatacattggatgtttagaaccatcatccccggcatctcaatataagccagtattattctcccaattgtaacaaccaaaaatgtcttcagataacataaaaacatccgtgggggaaaaatccctctcctccaccccagttgagaacagctggtataaaagcatcctttccttcttttatcacagtatgtatgattaaaataaatgttaacaatgactaatagtagggaatttatcagatgaatgaatgcatttacatatgtattttccagatagtcacactctccctcactgattcatccacccatttattattcaacaaacacttactatgtaccaattatccactaagtactttgccaggtagaggggatacattcgtgaaatgtaagtttctgccctgatggggcttacagactttcggtggaactagataaaacaacgaaacaaaagatattactaataagtgttttgtttacaataaggcaggaagttataagggaaagacaggggggctgcatgagattagtggacaaggaaggactttctgaggtgacatttaaggtgagaaatgaataataagaggaaaacaaacaaagatgtgaaaaatttattcattaattttacttatttcttatagcatatgaggtttatgctaggagtgcaaaaggatgatcatttggtggcatatcaacttgcttctctacccatatttgtgaaaaacaccagattgtttgtgtggaagccactgggaactgttccaaaccgtgtgagaagtctgacgttttttattgagggagcatagccctaccaatgtaaaggcgttgttttatgacaatgccgtgaaaactggtaagacattgaaaagcaaaaatgagacatgcagaccttaaaatatcctgtgtgataagaactagtgattgttcactgaaaaagacaaattttagttctatcttcatgacattatatgttgctggggagatggtggtgaccagggaaaactgttcagaggaaaatcctggcctgatacatttaaaagaaagcaggtaaatgcgtattcatctttttttttttttctccaacctcagtagatctaaggacattaatcagaccttgggataattatatatagctgtgctatgagtacgtggattcatttataattccattggtagtagataatgcaattaagtacaaaattctgcagaatctattatatcgttgtttgacgaatcaaataatgtattctgcatttttattctcatgaatatttcccttataaatagatgtctaaaatgaactattttgcatatgcttgccttatgaaagtaggcttatccactggaaatacaaagctgttttaagcatatttgtgtgtttaaacatgcttacgcatgttttcaagcataattgaaataattagaataagtttcattatcacctttcaccttttatgctagatgctggatcaagtcaaaactggaattgcaagtcaaacatcttgatgagatacagaattctgtaaagggaagagatgaattacaaaatacaaccttgtttgaggaagacattatgacagctgggtgacttgggcatttaaatggaatctgatgaagtccctcccaccattttctctataaaatgccaatggcatttaaaagtagtgtcaccagaggagccaatgtatatttttatactgcaattaagcaattgagtacaaaattcagtacagtcagtgggaatgtgatcagatgaataaaggaagtcagagaagataatcatttcagttctttccctaattttgctttctagcctggtacttaaaattcacaggctcacaagtctcactgggctccagagaagaagcctgactcctccccagctgtgtactctcaggcaaactacgtagactctacctcagtttactcaattttaaaattgagatcataattcttgtcttctagaatatttgtgaggattgaatgaaatactatgtataatatgcacattacatagctaatgctcaataaatcataactttatgattagcaatgtttgtttccctcagaagtgacctaaaaccaacaacaacaatatttttattttgctttctatgatcactgctaattatgaaaaaaaaaatgtgcctgccttgatgcttaggaaagaaaaatggttgcaatgagagagaaagcagtgtttccagacttgtgatgactttattcagttttctgcattttgtttctctctggcagttttttttctcctgtcactttcaagattgaacataattacagtaatgaattataaatgaacataatatgtaatgaatataatacataaagtttattacccccattttcataattctgattccaagttagagatccccttccaagataggctccatagcctcctgtgtaagatgtctctgcccaccctaccccagataacaccacccagtttgtctcctgcaaggcacttatcacaacccttaatgttttttgttattcgcagggggtcctgatccatgccccaaaagtgggttcttggatctcgcacaagaaagaatttggggcaagtccatagagtaaagtgaaagcaagtttattaagaaagtagggctgggcatggtggctcatgcctgtaatcccagcactttgggaggccgaagtgagtggatcacctgaggtcaggagatcaagaccagcctggccaacatggtgaaaccccatctctactaaaaatacaaaaattagccaggcatggtgacgcacccctgtaatcccagctacttgggaggctgaggcaggagaaccacttgaacttagtaggcgtaggttgcagtgagccgagattgcgccattgcactccagcctgggtgacagagtgagactttgtctcaaaaaaaaaaaaaaaaaattaaacaaagaaagtaaaggaataaaagaatggctactctatagacagaacagaagcatgagctacccagttgcttatacttattgttacttattgattaatgctaaacaaggggtggattattcatgattttccaggaaagcggtaggcaattcccagaactgagggttctttccctttttagaccatataaggtaactttctgacgttgccatggcatttgtaaactgtcatggcactggtgggagtgtcttttagcgtgctaattagaatataatgagcagtgaggaccaccagaggtcactttcattaccattttggttttggtgggatttggccagcttcttcaccgccacctgttttatcagcaaggtctttatgacctgtatcttgtgccaacctcctatctcatcctctgacttagaatacccatccttctgggaatgcagcccagtaggtctcagccttattttacctaacccccattcaagatggagttgctctggttcaaacgcctctgacattttcatttatacttttcacatatgtatcaacatataatataaaaatttaaaatgtcatatattatatattaatacatattatatttaccatcattagaatgtaaattctagtaggtcagtgaagaaatctgtcttgttcaccactccctctctagacaatagctctgtgccaggtacatgcagacactcaatgtatattgaatgttgaagaacttttcctgcaaaccgtaattgccacctgataggtttacacattcgattgtcttttcacctgctcttatataaatttgtgctgagacacgcaagccatttgatgttgtagttattttttacagtagaggtgctttgggaaagatgattgagatacctccttataatcttagaatccatcctaaaatgtcttctactcagataataaatgccagtctttgatttgatatatttaactctttaggtaatatttacaatacatagaactaactggatttagtaagatgctttaatttactgatagcatgctacttattagtgtgtgccttcaagcatcaaatataccaaaaaaatgatcatttttgttatggtagcagatagatacattgctccactggtgtctttttttgtttttttttttgagatggagtctcactctatcatccagggtggagtgcagtggcacgatctcagttcactgcaacctccgcctcccgggttgaagcgattctcctgcctcagcctcccgagtagctgggactacaggcgtgcgccatcacgccaggctaagttttttgtatttttagtagagatggggttttaccctgttggccaggctggtctcaaactcctgacctcgggcaatctgcccaccttagcctcccaaagtgctgggattacaggcatgagccactatgacccgccttcactggaattctttagctagccttattttacttggattctgattgaaatatgttctcctcagaatacaggatgaaacaaagctaatttaaggtgaccaagtttatacattaagtacaattagtgcatttttcaccagaaagttggtcactactttaagattttaccttcattttcattagaaggtattggttaatctattatctcctctctctaactgcagtcatcatattaaacttttgcaaattttaggtgacaaacacatgtcgaatttacatatatacaggcataatttacatatatgcatatacaatgtacaatatatccagaaggtaattagcaactggttacagtttgctactaatgtacaatatatccagaaggtaattagcaactggttacagtttgctactaatgaggtcaagtttacagatctactgttcctctgagtctgtcttttggctctgttgcattgccacagatcctatcatgatccctgggctgctgtttcacacacgttgtttgtcacaggaggggggccatgaaggaggatgtgattgctcccctgccaaccccctacctctactggtcaaggatctcagcatttttctgacgaatggcatgggcgggatgcgctccatctttgcattctctatgtgtcaggctgtgtccacagggaattgtctgtgaagggtttttaaatcagtgggaccagtaacaccatctttatatagtgaagacagcttatcattaaatatagtttgagacaagcttaattgtgcaactgaaaaatattttcgataatatttacaacttttatctatttagtgttattagatgaagactttatcatttttttccatcatgcctttggttttgtgagcttcttttttgtttttatttcccgatttctttctttcagatacttttaatcaacatttcttcctttggaaaacaggtcaaatgacaatgcgaagggtgatcaaggagaaaatgtgtgaagtagaagcctagaactcaagagaaatgaataatatcttggcatcacttactttgctttaatttcttagttttactcctttaatgtaacaactgtttttcatttaaaagggagtcatgaaacaaacatctatataatattttggggattaaaaatgcatttgcaaagttagatttattggtttttatcttaaagacataaaaacttgatatcatatttaattttgtgctcaaacttaccgataacacattacttaatccttgaaattatttgctttattccctgttgtggattaagatgagtgattttattctgaaaatattaggttgttgtaaaagtaattgtggtttttgccattaataattcacaatatgagagcaattatagaatctagctaaaattatatgtatttatccatctctcattattcatggtagttatcttctataaagtctctgcaaacactgaattagtaaatactgaacaattactcctggtaggtaaataagagcttggttcctgcacgactctggccacatttttgtcaatctatcaatacataatcttattttatatgtatttctgtttaatgatatcttatgtaatacatattgtatgctcattaatacatttatttaatacatattgatttaatacatatcttatttaatacatattttatgctcattaatacatttatttaatacatattgatttaatacatcttatttaatacatattgtatgctcattaatacatttacttaatacatattgatgctcatgtgctttcgagcatcaaatataccaaaaaaatgatcatttttgttatggtagcacatagatacattgctccactggtatctttttttttttttttttttttgagatggagtctcactctatcacccagggtggagtgcagtatactcacagtatactcatagccaatagcaccgtaactcacccctcattgaagcttgttcaacacagtttttttctctgtaaggcatgttatagcctccttgtgcttaagaaaactagggagcacttctgcattatttttaaacagcaagtcattttaaacagcagaatcataaacaaaaaacataaaaatgagaagaactaaatagaccatgaaaaaaccacttgtttatagtaagagaactgaaacatgaaggcagagtttcactttgttcaacctcagctggcaacatgtgtagggggtaactcaaattttgtgattctctgcacatgttggggaaagatcacacaaatattgtgagtattaatttggagtacaaattaatattagcaaatagctgtatttgcaaatatggaatctgtggataatgagaacagacagtatttatattctaggttagaaaagagaaaatgagctccttttagtcatcagaagccaatgaaagacctgggtttagtattttcttccatctcttgatttctgtttgcttaattgaatgacaaattctaattagtcatgcctgactaacataatttaggatgaaactatgtcttcatcactctctacttctgaccctggccctgttcctagagtacagtaggcattcagttaatgcttgttgaaagaatgcataaacccctttcctcatttggaactttatggaattgctgagaacatcagatggcaataaggtgattggagctgtaatcacacacaaaaagttgtctattttaattagccaggtgtggtggcacacacctgtaatcccagctacttgggaggctgaggcaggagaattgcttgaacccgggagacagaggttgtggtgagcagagaatgtaccactgcactccagcttgggcaatagaatgagactctgtctcaaaaaaaaaaaaaagaaagaaagaaaaagaaaaaaagttaaaaccaccaaattgtttattttctattttgaggattttaattttgcttaataacatagtcattgaaattaatttataaataatattgtatagttcaaaacattaatataggacttttttgctgtaaaccagggttgcctgtttaatatttgtatttcattatgagtagtgaactagtatctcttgtaatgcaaggtaaagaggaagaggttggttaacaaaaaggaactatgttaattttgctattaataagggggaaaaccttttgaatttatttatcctggagacacaaaacttaaactcataatgatgtcatatatattagcattactatatttccttattattgcaaatgtattctacccaggtcttttcatcattgtagtcacttaaaaaacatattgggtaagttttattatacaatttttctcagattgattttagttttattttttcttttctcttcttttcttttctttttctttttcttttttttaacctcagaaggaattagatgtccagtataaagaagcctgatcactctggccttacttggctttccaataatagtatttttaggatcactgatataaaacctacaaagtaagtaatttggttcatataagcaggcaagtaataaattttcctatacattgttatttctcattaaatacatactattactctccaaataagagatttttagaggtcattttttttctcatttttttaaaatactgactgacccatatttgcactggtagactcagaagtgtttggtttatacttgttcaaaatgattgtcagcagatgtaatgagccttggaccagtccagtaacttggctaacatatgtctgcagaaggattttaaaatcctgctgactaggctggtcctgtcgagtctcacagcagaaaaattgtcttttgcagctcagcttataaatataacctttgtgtgtttggaaatatcccttctaaggcaggacttatgctcaccctgaaattcaaatgttcattttgatgtcagcactaaccaggagaaagaaaaggtggaaacgattcctcttgcacgtttcagagtgttagaaaccgcctattatttgtgtcttgttctttgctgctctgtacaagctctagaagtcataaaagtgttcctcacaaattgactccttagaaatgctgactctgtgtttcaaatcttataaaaatatctaaatggtagacgtattgttttcattacagatgcattaagtcaaaactgccaaaggctgtgttgtttctgcaaacagggcaactactgcttgaatggggctaatctgtttaggcactgaggggctagctgtgctgtctgcacatatttaatcacaaagctttacttgactttcccacatatttccttttagtatttttacttatggaaagcaagaatcaggttttatagtcattcagtaagtcctctttttaaataaaaattgttatattggaaacagtgtctacaagaccactggtggaaattaatatagccaatataattagtaagttggattcaccacaccacagtaggtaaatcttattgggggcaaaaattgctatcttattcacaagtgtgttgagctgttcttgtattgctataaaggaatacccgagacttagtaatttataaagaaaagaggttagttggctcatggttctgcagtctacaaccatggcaccgctcagcttctggggaagccacagggagcttttactcatggtggaaggtgaagcggaagcaggcacgtcacatggccagagcaggagcaagagggagagagtgggggaggcgccacacgcttctaaacaaccagatctcaagagaactcactatcatggacagcacccagccatgagggatctacccgcatcacccagatacctcctaccaggcaccacctccaaaatcagggagtacgtttcaacaggagatgtggttgagacagatatccaagctgtatcaccaagtgaactaccgaagctttttattgatttgtattaagccaacacatgggtttacccagtaactcatgatttttacacaaaaaccaaattaatgtttatcgaacagttatttggatataaatacatagatatagcacagtgcttcaggttagtttataaaaatcaagtctttcctttaaataataaatgatttatgcattcattcaaatttagaatgctgaggaataaactacaaaaaaaacttgtggctgagtgcagcggctcatgcttgtaatcctagcactttgggaggccgaggtggatggttctcttgaggccaggagtttgagaccagccttgccaacatggggaaaacttgtctctactaaaaatacaaaaaattagccgggcatgatggcaggtgcctgtagtcccagctactctggaggctgtagcacaagaatcgcttcaaccggggaggtgaaggttgcagtgggctgagagatcgagccactgcactccagcctgggccacagagtgacactccatcaaaaaaaattttaaaaaaaccctaattgaatctttccccctgtatttctgagaaaaaggagcaaatataaaataaacaaaaagaatacatatggaacatttatttagaaatcaaagacccagcgtcatacgttctaatgtttgataagatactacccagtttcctgcaactttcacttttgttctgtcaaagattccaaatgatgattgtgagccactgtaacctgaagacatattggatacatttacttatgtgtgttaaattgtgattcttaatgctattttgtggaaaggctggagaagattttttttttttttttgagatggagtcttgctctgtcactcagcctctggggttcaagcaattctcctgcctcagcctcctgagtagctgggattacaggcagttgccaccacacccagctaatttttgaatttttttgtagagacaggcttcactgtgttggccaggttaatctcaaactcctgacttcaggtgacccatccaccttagatttttaaaataaaggttacaggctgggagcagtggctcacacctgtgttctaagcactttgggaggccgaggcaggcagatcggttgagcctaggagttcaagaccagactgggcaacatgacgaaaccctgtctctatacaaaattcaaaaattagctgggtgtggtggcaggcacctgcagtctcggctactcaggagggtgaggttggagaatcacttgagcctgggaggtcgaggatgcagtgagtcatgattacaccactgctctccagtctgggtgacagagcaagactcttgtctcaaaataaataggtacgtacatacctacatacgtactagaatcaagggggttgtttctgagttcattgagttaacgaggaaggtaaattaatcaggaccttcccaagttacccatgtaatattatttaattgtacatgtttaaacaagctcagattacgttgactgtgagtcttaaaacggtaaccacaaacaggttataccaagatccctcacaatgtgtgttgtctgagagaaaaatcttatcattttctttttttccacattcactattgttcctagattatgaaaggtagtcattcactaaacccttctaaaatattccttttttttccaaatatagaattattatattagtaacagtacaggcatgcccataacaaaaaatggaaactaatatagtcaatataattagtaagtttgattcatcacatcccagggtagaatacctcttgaccttcaaaactgcggtcgaccacaattcagattttgagctattcaccagtgagaatgcatggcaatacatgcctaattggcatagttacatgtcattaatttattccttttattcatttaacaaatatttattgaatgtttactatgtgccagacactataatgctgttctaagatagcttatattacttattattgaaattatacttattaaaatggtaataatttgtagagagattaaactttgttttcttgccctccctttctccttctcctcttcctttcttcctttgtttcttttctttctttgcctccttcttttgtgtagccataaacaggagtctactgggtcgtttctgtttgtaaggcacaatctgcctcccaatccccctcccaaaaaaactaacaaaatttagggaaggagctgatttcacatttcttcagagggcctgttagagtgataaaaggcaaaattattttctttacacgaacagtcacagaaccaaaaaggccaaggaagaagccagagagcacatagtatttaattaggagagtttctagtgtcccgaagccacagaagaagcagctgcttaaacattgcttaccctttgactaatggccaaaagcactgaataggagaaggattaacatggataagacttaaataaaagtgatacaatcatcagagcaacaacaaacaaaggcacattaaaaagtaacatgaaatgatgttaagaaagaggtcatggatgcaaaatgataaaatgtttcgttctttggaagtaactctttttttttcttctgttcttagtcatccatctctgtcagagttctcaaataaaaatgcaaaggaaagttagcaccactctaaaacagtgaagggtcagttctctgcttttggatatgtaatttgaatgggaagtgtcctaatgacaattaaacacaattttctaagcacaggaagaggactgataaagtcaagcaatggctgtggcttttcttttgtacttccgttactattaactatatgcaagttaacaaatgctggacagcctgtccagtgagcagggttgctccgttgccaggcttatgttttaagcgacgattgagtgtacacagatctaaacaatcatgtgcaaagtctaagtctctcattttgaattcggaagagagaaccttggtgccccttcttcctgaggaaatttgggaactatagtacaactccctctcaaaaaaaaaatactcctgtaattccatcctaactactgattgctttatatttttgatgtggtgaggagttcagaccccttcttagtgaatgcaatgtttagcacattctttggaatatactgcttgagtctcttggtgcatcagctgaaacttcattttaatatcccgtacgcacttagtagatacttgcctttcctctacattggtgattattcctggcctatcattcagttaagacctatcctccatatacagatttttatatcgttcatcgaaattaagacttgttgcaagtaataaaaactgaactcaagctacctaatacaaatggaatttactattttatataccaaaattctgtgaaaatacaggtgggactggccttagggatacctgatattaggatataaatcctgtcgcctttctctcatgcttttttttcttccctttgtaatcacttctttattatttgtcactgacctcttcatgaatttagaaccacggtcgtcggcactttctaactcatgctttcatagtttcatgaccacagaggaaaagaggctttggaaattctcaaggaatcactgtgactatccacacttgggtcacattttggactcattgcagcagcctgaaggttagatggtatggatgccccagcttaggtcatgagcctgcacttgggaaaaatgaggggaagttatttttaaaatggaaagaagtggaaggcagacattgtatccagttttatatatttatataaacaaaacactgtaagggggaaaatatagacttgaatcagaggagaagagttaaaccaatgtttatatatttctttaggtttgttggaatatatgtgcatgtaattatatcagcaaactacatagtgaagtcagggagacagattagagagataggaagagtgggagggagagaatgtgcaaaacaagcaacagaaagaagagtggggacatcctgagtttgtatgtgaggagaggacagataggagaggtacaaaggaaagggattagaacagagaattagttagaggatggggagataatacaagggagagatagccaggcatggtggtgcgcacctgtagtcccagctgctcgggaggcagaggtgggaggattgcttgagtcggggagatggaggcttcagagagctgtgatcacactactacacttcaacctgtgtgacaaagtgagacctcgtcttaagaaaataaataaaataaaataaatataagggataagtagagagatcatgagagaaaggaacatagagggacacagatgcaagaacagggaaagagaaggggtcagaaaagcgtaatttgtggagagaaaattaaaatgctattattattggtattattgctgcagttgctctcttttgcccattagactattttggcattattggcaggtttaatgtaaaatgagatttgtgagtaacattgatctccaaattataaatgtctttcaataggatatgaacaaatatcatagtaattctcaaagaatattgctatttttaatcaatggagtatacaacatattatattttaaaatcatacaatacttcaaacaccgtgaagagagaacaaagccatatcaaataatgaatgaatggttgtattacggaagtacttgtcctgatagaacacttcaaataccatttggctgctacttctctctgggtttgctttgtatcccatggagatgatctgagcttaagcttttgttagcttcaaagagagctccgttcttgcctcatctctgcagtattgaaaaaacagacccttggttaacaacaggaagccaaactgattttaatattgtgaactctttaccctgatgcaggaaatgttatctgggccatctcagtgggctggggattatagagctggataaggcttcaaaatacaaatgaactccataggtctggtacagctgtaaggtacaggggtagagaatattaggtggtcatcttgataatcatttgtgttatgttaatgcactccaaagtggacttgtttcttctacctgagtgtatatacaaccagtcttttcactattttcagtggttataactcaggaaagagacaacatatcaacatatgaatgtgggtatatccaacgagatctctcttataattttagtccataaataggcataaaaaatgtgttctttcagaaaacacttactggaacctgagataatacaataagtcgaattgctaaaaagagaccccatggatcacaggtctgacctaatatctagttttactaataattttaatggtataggtaatcacatggcatgggtgagccagggagagaggtctttgaccttcagtatagctcgcaaatgctttctttccacataagagcatgcactggacccacaggaaatctctaggtgacatgtgcagtttacattccttgctcaataggagtatttaggtaattaaaatctccatttatattcagatacttgcatagctttttccaggagaccatgcccataaatgcatagatttcaggtttgtttatcataagcagtgctagatagtgagcatttgatagatagggactgtctctaaatgccattaacttgcttgccaggagggtctctcattcatgagtcaaatctcatgtttaataggagatttgactgggctaccttgtttatttccagggagtggtcccttggtgaaaagagagaatgagtggtagacctattatttgaccatattcctcctaaataccttcttggtgatatggatacagagattagcaaaacagtcactgccttcaaatttttttaccatataagatgatgaacacaaaatcaacaccagagataatgtgcctaaacccttaaataacttgtgtgacacagaacaagtatctcaatagacagtaatattttttacgatagtattaacaatgccgtgttaaggtgctataacctggttgaatcttatttggatggtggagtcttagtggacaatggaatttgtacaagttttgagtatacttattctgctgacatttattgagtaacctcccatgtgccagacattatctgacgtgaaatgaaagagaattcctggtttccgtgagtttttagtcttagagaagacacagtcacgtaaataaataattgaaaaatatcataaagtgtttataaaaatctacttgttaagtatgagagtgcagcatacttggcctccagaaatgcagaaagtttcatcaatatacaaattaaatcttgaaggatgagtgaacacttactgggtaaataacaagatgaaagactttaggggaagagaatgagatgggctaagttagcagcatcagtgaacatatggacatgggggtgctgcagattcttaccattggttcccttttggatgttgatctaggaaaatgctggaaaattaggtttgcctcagatgatatattaggccaacaggaatgaatgataataaaaatagctaccaattttgagaaattactatgttccaggtacaatattaggtacacatttttaatattcatgacagattaggaggatgtaacatcttgattttataaataagaatttagttcagcagctagttagatactatgttgggatgtgcctccataactctcttactgcaaacccatccctctccatgaccctgtgtgagctcccctaggcttcgaagcttgcacattgttctcacctgacaggggagcagtgaaacaacactaggaggacaattagtcatcattcagagtgtatatcagtgtgcctctgcgaacacccacaggaaaaaataaatctacgaatagtgagattgctttggaaatacaatatcaaaacaaggtcactgctaccttctctctccattccatcgagattgcagctcctggcacctcttcaacaggaagttgttggccgcctctcccttgaaggttttagtaggagaatgaaaggatcagtattgggtttcagaaagataaattgcttaccaattgatggaaaatggcagcttagagaatctgtggttagagaaaattgtttgaaacttactataatatttcagagatgaagtaataagaagaatctggagtggcaaacatagatcaattgattgaaactaaaactaataagacttgctgtgaccattgaggggacccaagatatcagtttgaatcactacagtgagcagtgaggctacttagatagaaattgccagaaaaagaaaataaatgaacctttggatttactgagtttgtgggggctgaatgctaaagttttttgtttgagttgggggtagcttataggcaggcaggaactggctctgatgcaaacagaggtgatgggatagaagacatggatttgggttctgatgactttgtgagagtgaatgggaaagcacattcaatggcaagaaccttacaaggaggtagggcacaatgtggttaagctataatttttactatatttcttcatttttattggcatccaattattttatatgtactcactatttatttaaacagctttattcatggggtgcctattctgtgcaaggcaatacctttggcaatgacgacatgatgatgagcaaagcctgaatgtttcttactctcctgagtttattgtctagtaagagacaagcatcataagacattacactagtgaatgtataatttgaaactgagataagtgctctcgtgtgaaacatcttatttctaggaaaaaaaaaagtgcaacaaaaaaaagagaaaacccttgtgatatgaaaggtttccgaagaaagtgcagctgtgttaagacctgaaggataagagttgccatctaggcaaaaggtgatgaaagtaaaggattctccagactgatggaaaagttataacaagagattggagtgtttaggaagttaaaagaacatgtaattgaagctcaggagggggaagagagatgagagatgtgtgtagagtccagagcactcagaatttgcagaataataaggattttgatccatgttctgagtaatgacatgccattgaaggtttccattttttaaaaatattaacccagatctcctttacatgagcaatacagataggaagtgctgaggaatcaaagtagaggtagaagggattcagaccccagagtgtctacattaggagggagctgaacctcatcaagttctttccataggattttcttcatgcacaaatatgcatggctggcttagtctgcagaccacatttttggttcacctagtgtttcagatggcagatgacataactctgagtaaattagaagttctggctgtaccaaaaatatatacatcaggaaaatgaaaaaggaaactgttctgtgctgcttaagagaattcattgccaacctcctactggctgttctgacccaataaacaagcaaaagtgacttgttagagccagcagctatattttgagtaccattatccccactgaataattcaacacttaatggtggtgattttggttgctcagagaaggtattcttttgcaattgtgtagctctttgttgagattcagcattgtctagttaacagtatgagaagcaaagcagaattcttgctgtgaaaatcactacttctaaagagatgcggcattgccatatagtagttacattgtgcaattactacatggaaattacttgctgtcttgtagtctttttccggaaagaagacactcttttttattattattatactttaagttctgggttacatgtacagaacatgcagttttgatatataggaatacacatgccgtggtggtttgctgcacccatcaacccatcacctacattagctatttctcctaatggtatccctccccagcaccgcaccgccaacaggccctggtgtgtgatgttcccctccctttatccatgtgttctccttgttcaactcccacttatgcgtgagaatatgtggtgcatggttttctgatcttgtgatagcttgctgagaatgatggtttccagctttatccatgtccctgcaaaggacaagaactcatcctttttatggttgcatagtattccatggtgtatatgtgccacattttcttaatccagtctatcactgatggacatttgggttggttccaagtctttgctattgtgaattgtgccacaataaacatacatgtgcatgtgtctatcgtagaatgatttataattctttgggtatatgcccagtaatgggattgctgggtcaaatggtatttctagttctgcatccttaaggaattgccacactgtcttccacaatggttgaactaatttacactcccaccaacagtgtaaaagcattcctatttttccacaaactctccagcatctgttgtttcctgactttttaaagatggcaattctaactggcatgagatggcatctcattgtggttttgatttgcatttctctaatgaccagtgatgatgagcattttttcatatgtctgttggctgcataaatgtcttcttttgagaaatgtctgttcatatcctttgcccatttgttgatcaggttgtttctttttttcttgtaaatttgtttaagttctttgtagattctggataggtcttcgtcagatggataaattgcaaaaattttctcccaatctgtaggttgcctgttcactctgatgatagtttcttttgctgtgaagaagctctttagtttaattagatcccatttgtcagtgttggcttttgttgccattgcttttagtgttttagacatgaattctttgcccatacctatgttctgaatggtattgcccaggttttcttctagagtttttatggtctaggtcttacgtttaagtctttgacctatcttgagttgatttttgtgtaaggtgtaaggaaggggtccagtttcagttttctgcatatggctaccagttttaccaacaccatttattaaatagggaatctttttcccattgctagtgtgtgtcaggtttgtcaaaaatcagttggttgtagctgcgtggtgttatttctgaggcctccattctgttccactggtctatatatctgttttggtaccagtaccatgctgttttggttactgtagacttgtagtgtagtttgaagttaggtagcgtgatgcctctagctttgttcttcttgcccaggattgttttggatatgcaggctcttttttggttccatatgaagtttaaagtaatttttttccaattctgtgaagaaagtcactggtagcttgatggggatagcattgaatctatacattattttgagcagtatggccattttcacaatattgattcttcctatccatgagcatggaatgcttttctatttgtgtcttctcttgtttccttgagcagtggtttgtagttcttgaagaggcccttcacatcccttgtaagttgtattcctaggcattttattatctcagtagcaattgtgaatgggagttcactcatgatttggctctctgtttgttattggtggataggaatgcttgtgatttttgcacgttgattttgtatcctgaggctttgctgaagttgcttatcagcttaaggagattttgggctgagaagatggggttttctaattatacaatcatgtcaactccaaacagagacaatttgacttcctatttgaatacactttatttctttctcttgcctgattgccctggccggaacttccaatactatgttgaataggagtggtgagagagggcatccttgtcttgtgctggttttcaaagggaatgcttccagtttttgcccattcagtatgatattggttgtgggtttgccataaatagctcttattattttgagatgtgttccattgatacctagtttattgagagattttagcatgaaggggtgttatattttatcaaaggccttttctgtatctattgagataatcatgtggcttttgtcattggttctgtttgtgtgatggattgcatgtattgatttgcatatgttgaaccagccttgcatcccaggtacgaagccaacttcgtacctggtggtaagctttttgatgtgctgctttttgatgtgctgctggattccatttgctagtattttattgaggattttcacatcaatgttcatcagggatattggcctgaatttttgttgttgttgttgtgtttctgccaggttttggtatcaggatgatgctggcctcataaaatgagttagggaggattccctcttttcctgttgtttggaatagtttcagaaggaatggtaccagctcttctttgtacctctggtagaatacggctgtgaatccatctggtcctgggctttattggctggtagattattgattacttcctcgatttcagaacttgttattgttttattcggggatttgacttcttcctggcttagacttgggagggtgtatgtgtccaggaatttatccatttcttctagattttctagtttatttgcatagaggtgtttatagtatcctctgatggtagtttgtatttctgtgggattggtggtgatatcccctttatcattttttactgcatctatttgattcttctctcttttcttctttattagtctggctagcggtctaactattttgttgagtttttcaataaaccagctcctggtttcattgattttttgaagggtttttcgtgtctctatctccttcagttctgctctgatcttagctatttcatgtcttttgctagcttttgaatttgtttgctgtttcttctctagttcttttaattgtgatgttagggtgtcaattttagatctttcctgctttctcttgtgggcatttagtgctataaatttccctctaaacactgctttaaatggaaagaagacactccttaaatgacttggtgggagcttttattttatcaatttctctctgataaattatactggtagtcatatctggtcacggataaactttatttcgtttttgactgtcaggcatgttgaattcaaattgcatgccaaaccataacatttaggaaaacatcatatctctagagttataattgatttgtgctaatgatatgttagtagaaaagaatgacagtttgatttctttcattcaaaggaaaatctctacagtaaggaagaaagtatcatggctaaaagtcacttttatttaatctcaggttttatcaaaatatttacagaacactttgtctttgtcacctgctagtcattcagtatatttcaatgacgacagtattatctttggaatcacaaaaatatgatgtaaaagaaaacttttctagagtagagtgaatgcttaaaaatataatatatatccaataaatgaattacagttaggaatgttgacatgattaagaacgcttgcattactgatagtgacctctgccctattataactttatagctaaaaagtttaagatctttcacagtttctccttcagtaatcctttttccaaactgaatttcgagtgcctagtaacttgtgatttttctaggaaaaacccatggtctttacctgtttgttctatagataacaccctataacttgcttttttcacttaacaaaaaataatagatatatcatttatataacagatataaggcatactatacattatatataatataaatgtacatataaataaaaataaatataaatgtctggaagtgttcatatcttaaatgttttctggcagggatggggagaagagggttgtataatcttcaaatttttactgaatacgttcctttgccattattttctgttacaataagaatatattttattgtaaaataagtaaaaacaaattaattaaaaatggtacgtgatgataaaaacagtagttcttagaaatattatcaatattggaatcaaaacacataagactattaaacatgtgtatttaagtaaactgcacattatatccagaaaattgaatctaactggttatcatgcaaatgaagaaggtaatcagttcaaaaatgacatagtaactgatattgccttcctgttcttatttcttattcatggaaaacgaggacaagatatgaagggtttagggatctaggtcattggcccgggatttggcattaattcttctcatacaagcacagggaacgatcaatcagtgttgacagctctaatgccatcgttggagcagaagatgagccaaaggaaattatgagtttcttataaatgtgtcttaagtatctggaaatcatactttgtatcttatggcttgaatagaatacgtttgcttttaatgatttgtacagtgagaagattaaaatttctaccaacatatccaaagcactgatacatctattaaactgtttgcaacaaaaatacctatacctttttgaatttgaataaaaaatcccatttaaacaaccactgggatgtgattatgccccaaatctctctgattatagttggtttgctttattatattccacttgaaaattttgaattgacaagagggatgtttctgtgaactacagattttagaggaaaataagactaaagttttttgtatcactgtttggtgtttagcatttttcaaccagtaaattgtctttaaccaaaaaatttgtctcagagaatggaaaaagaaatgtgatgacaaaaaaaataatgcaaaaaataaacagttatgaaacagtatagagataaaaaaatcaaaggtgagatatcccaaaccatgaactatttatcttaatcatgcagccttttcatctctgaaagaatctattaatgtcatattcaaatgcttaatgttcactagcagttgataattatgatgaccatccctgtcactacaagatccttaagtgccttttgatgagcaaagaaaaataaaatcatattcaagtaccaactgttggaattcgtactttaaatacaacctgagaaatggccttaggttaaggctaatggtgtataacttgctcacatttctaaagagtatattttctgacaatgattccatatagaaagtttaccgcagataatagtttcttcatatttgcatcctgacctaatttttggtcattaggttactttttataggtatcaatattttccaagtcctagagaaaaatgagagttttaattttctcttataacctagctaccagatgctatgtggcaaggacagtcttaggatgaaattgtccagacaaacaaatatgtattagccatcaaatgtacacatatgctcataagtatgtgtacacatgcacaagcatgcatttacacacacaaacgtacacttcacagaattataccctgtattctgtcagcttgatggagtcccagctgttaaacctttgaggcattgtgacagaaatctgcaagaaagcttcactagaggcagatgagataatattctagctgcaggattcagctacattttcgattggagtcataggaaaaaacactcattgcaaaaatgaatgaaatcctaagcctggagtgcaatgaaattgtgtttaggctgtggggctcccttgattttttaatatcctattcactcaaggatgcttgtgtctgagcaaacatttctagcaaatccaccaatatatacaacactacttgtttttttttaatggaacattctgctaacatcgactatagtgattaagccatacttacacacttaacatactttacgaaataaagatacctgaagtacatgtagtaaccagtgctgctacatttgactagagatttagaagagttttgtttaagaccttttgaatattgactgactatacttatggggtacattaaaattcagtagcctctacattaccacacagcctatgctaaagtattttaaagtaaatttcagaaaagttaatgatttgtttttgttgacacttttaagaaccactaaaacctatgaatatggttggccttaagtagacactgtaaaatgaatgaggttgagagatattcatttaaagttctattagcctttatggaattattgtgagaagcccagcaatgttcagctcagtgttttacattcagatccatatttactttaacgagtatttcagaaagtttaatttctgagttgtctttggatgaatgagaaaataaaaggaattcagaattttatcaaccgtctatatctatgcagattatattcttttgtggacatatgtatgaaattcattcgttcatccagaaggatttattatgtgtatttcctatattctaggcaagcgcaaaaataatgaataggatctggcaactgcctcataaaatgtacagtctcctacaaatatgtagacaaggcaggtacaaaaaattgtgagcccttgtttattttagttttataagtaatgtgctcactactgatatccacctgaacaatttgattaacacaaaaaactggagaagtagattaaaaccatccaaaacattgggagatatagatagacagctgatagatagatagataatcatataaacatagatagtcatataaacatagggagattatatatatagataatatctatattatagaacatatatatgttataataatatgcaatgatatctatattatataatatatatactagaatgataaacaccgttattaggtgagctgagacaggaaggaggcgcgttggtttgcctctccagaccttgatctggctcagatggagctccagttccttgcactctagcacgtgtagccctctgctcagcacggccccatccttatgcgatgcacgacagaagctcgccctgctggaactgctcctccagaagactgctgtttgcggcattcattttcctttcattatatttttttctgaatttgttctggatcgttttttgtttaaaatctcttcctcctcaggagtccgctgggcccccttcttgtggcccggacggtgcacagtggagctcgcactgctgttgccaaggtgcgcggccggcagctcctcgccagggccccggtgcaggccggctggctgtgggtcacacgcagacaagatcagcgaccctcgttttgcgagtgcaacactcccagccacagaagttcccgggtccagcctcagagcccagtatttcccacggcctccccacacacaccccgcgtggatgcggcgagggcccgccttagtcctggcagtgcgcaccccagctcagactcccgcttcttgtggcagctccttctcttgcccctgtgccttctgctgcttgtgccagttgtcgtgagagatgcccggtgctgggcgctggttggaaagaaaaacttaggtatatattttctttttctttccttccttccttccttcctccttccttccttgctttctctcttttcttcctctttctttctctttctttcttttctctttctttctttcttattccttctctctctctctctttctttctttttctccttcctcttccttccttctttccttccttccttcctttttttgaaacggtctcactctgttgcccaggcagaatcatagctcactctagcccgaaactctggggctcaagcaatcctccaaccttggcctcctgagaagctgggagtataggcacgtaccctatgccttgctaatttaaaaaaagaaaatctttgtagagatggggcctcactatgttgcccaaactggtcttgaactcctggccttaggtgatcctccagcctcagtttctcaaagtgctaggaatacaagcatgaggcactgcacttgatcctatgtttttctaattagttttctacttttaaatgtaactgtaagttgtaatcaaacattatatatattatcctttaaaaaattctgaatttattgttatggttaaatttttatcattagtttccagactcaatgagagtcatttttctattaatggaaaataagggacagacctttcagcttacctggaagtgcctcatttcttttttgaaaattcctgccatggtactgatcaatgttgatatatatgtgaaaaaaataaagaggagacaaacagaggggatggtatttaataacaagagaatagtagagaaggagagaagacagttttaaaaatgagcattcatgggttgggcacagtggctagcactttgggaggtcgaggtgggaggatcatttaaggccaggagtttgggaacagcctggacagcatagtgagacccctatctctataattttttttttaattagctgcatgtggtggcggatgcctatagtatcccagctactagagaggctgaggcaggatgctcacttgagccaagagtttaagactgagtgatttcaccactgctgttatcagtctgctgtgattttaggtgtccaaggtgggagtgagtgatgaaaatctgaaaaagaattaagaggatgttctctttaatttacaaatatatttttgaagttgattttttgttatagcttagaaatctgtcatatattattattgcttcctctcacatattgcagtttttctttccaggaagatttcattttttagtgttgttttaggttcacagcaaaattgggcagaacgtgcagaaatttctctcatactaccggttctgcatatgcacagcctctccgttatcaacaccaccagcagtgtgcatttgttacaactgatgaacctacattgacatatcaataacgccccaaatctatagtttacattcgggtttcttttggtgtatacattctacgggttttgacaaaggtatagtgacacatatccacaattgtagtatcatacaaagtagtttcactgccgtaaaaatcctgtcctcctattcattccctcttctcccttaacccctcacaaccacttatctttttactttctcaatagttttgccttttccagagtgtcgtgtagttagaatcaaacagtatctggtgttttcaaattggcctgttcacttaatgtgcctttaggtttccttcacctcttttcatggctgatagctcatttctttttaccactgatattccattgtctggacacagtatagtttatttatccatttacctaccaaagaatatcttggtgactttcaaattttgataaatataaataaagctgttaaacatccatgtacaagttttttgtggacataagttttcaactcctttgggtaaaaaccaaagagttcaatggctggatcacatgtgagagtttgtttagttttgggggaagccatcaaactgtactccattgtgactgcttcaatagtaatgcatatactatatccacaatttattgaccacacaacttttttttttttttttttacccagcatactatagcatcagtatctgtcacagtgagggtttgcacttttcaggtagggctgttcttccttgggcaggactgtgctgagccctgcaggtcgtttattatccacggctcctgcccactggatgcaaatagcactgcccagtcatgtgacaaccccagctgctcccacataatccaaatatcacctggaggagagatagcaccttggttgtaatccaaaaggctagaggaacacaaacaggtcttaccctcttatgagctggccatgtgggatgctccaggagtgaagctagtggaatgtttttagtgactgaaagtccttaagaaatgtgaaaagtggttacctggatttatacatatgtaaaagtttgctgagctgtacacttaagttttgtgcattttagtacatctgagatttttatttaatttgaaaaatagtccctacaggaatttcacagctatataagttgttttctgagaaataactcagaaaataacttaatgttgggattattctccatccctgtagtcaaatgaccatgaatttccgtaattttctttcttagtctccactgtgaaacaatttgaattagatgtcattacagtatactattttttaagaatcttacatgtataggtgggaaaacaaaaacatgtatatacataagtttttatataacctgtatgtatatataggttatattcaattatattccagttagagttcaaccacagtaatttgctatttaaataaatgatattattaatgatattagtttatcccacatcattattaactaaagctgacattttcccaataaaatcaatttgcttataataacatcgacattcctttgatctactgtgtacaaaatgtgccagctctgcagggatgatgagttaacactctaagcagttcttttgtcgtgtcactgcggtgttatgagacatgaaagagtgtttgaatggatatggctataatgcacagtgtttcctttgttttcagagtaaaagccattaacagttatttcaggattactgtgtttatgacacttgtaaattgatttatggtattagccaggcaggtgattgaacaaaagccttttaatgtttgtgtatgtgtttatccttctcagcttcacaatgttgagtgattcagatcacacttcaggcttatggaaatttgctggacctcctccccataagaactgattccaaaccaggggaatagtttaacctagcctgataatcacataaaaaggagtttcataaagggacacttgaggtcagagagaagtgaaggtgacatccactccatcatgaaaatgtcaaatggctttatataagacatcttgcttgatgcagctcagtgattcttaagccattttatcatggagagaaaagaaaatttaaacatttccgagttatagcactgtctcagactattatacaaatccattgagttatttttaaaactataatttggatgccagtgtcataaaatatctcttcctgctggctataataaaagttgttgatctatttcaagcatcctgagtagaaaaatgttgtttaatgattttgcatgcatgaagttaatttctacctctggaactcatagtagctgaaacaacttaatgctgtttcttagtgaagaggaatgtcaacgtagcatgcttttttttcccttcttttttggctgtgtgcattccatgttgtcaatgaaaatggcagatggactgtcactgacatttctgctttgtgtagttgctgccatagaaatgaaaaagtttttaaaatggtgacgataagagtcaccttttgttcactgaatttgctgtgttatattttcttcttggaaatttgacctaaaactgtttgtgaataattattcagaaaaaatgtcaaggatttttaaaaatcactaaaataaaatgtgctatgtcaaaccagctgcctttctaagctgctttttgcccatgtatcacactcatcagattctatttccctctaggataaagtagaaacctctttttttaaattccagcatataaatttgaataatgttatttgcaaaagggaaaatcgaagcatttactattcattagagccattagagaaccatagtgccaaaggttttgtgtaaacatgacatcatgactgttaggtgaaaaaaacaagtgattattaggaaatgattattattcagagtacattaacaatagccttgggtctttaaagtaattttaaaataatttgttttagtgttcagtttataatggtggaatgatctataattgtccaaagtgaaaacttagtcttaaccatttgtatgcattgttgcctttctatgctttattattggaatttaaacagtctccagtggaaacataatgcaaagttggtgaattaaggatcaaagcattaaagaaaaatgaacaggcatcatgtatactaacagctaccaagacttaaatgatggtgtactataaaatgggcttacattttctttaggtgggctataactttcaaaactcttaaaccaagaaagaaaaagcaatgagttacattagttgcttaaactaaatatgcagaacatacacactgatgtttaaagaaaccccacattttctcatcttgttccaatagaagaggtgcagacagtatggtagctttaagaaagtctttttttctgtttgttttttatttttattttagatgtatggcagcaggcattctcaagattttgtctaccttttgcctaaagaatctccttactgctgttgaaatattttaggctgatttctgatttccaaagactgaataaacattaaaaatgtttccattaggaaaatgttaaaatgcacccccaatagaaagattagcataacctccccccaatcttgcactctctctctttctctctctctctctatgtgtatatatatatatatatatatatatatatatatatatatatctgcttcagcaatattcattattgcatcaatttgtttattctatctcttctacctaaattagctatttctaccttgaaaaccatcccaaaacactgattcaataaaggaaacatttattattgttcctaagtctactgtttctttgggagattctgctgaacttagccagtcttgactgatactgaccagctggttctagcatctgtgttcagctgacaggttagtagggcagtctcatctaggatggctgccattttacgtttagtggctggctggctgttggccaggatgatggggatgatgggcaaaatgtctcttatcttccaacagggtagtgcaggcttctttttaaaatagctgagcagagttttcagagacagagagaaagaggaaaaaggtgcaaggcttcttgaggcctagactagaattcatcctagggtcaaaagcctaccagattcaagaagtgaggaaatagcttcttaggaggagctacaaagtcttattacagagagtgtgaccacaaagaggggaagagaatcagagaagattttgcaatcaatctactacactctcacacttttggggagagtattttatatcaatcaatatcatttcaccactatatactttagagaatttgcctttattttgtaagttgttatgattttgtaactctaatagcatccacaaagttaaccatgctccttggatcagaatattagtaggagggactatatcctcattgccactatcaacacaatgatcatcactttcactagtattagcaaattttatttatttttctctgctaatgacacattacctcacttaaatctcataagtgtgctatacagcagcaactatcaccccagtttgtacagctgagtgagcaggctgggtaaactgcccacagccatctagcaatggtggctttgaacccaggtcatactaactttcccatggtctcatcactgcacatcactttgtcatgtgaccagtcaggaggccacagtagctttgcacttacttgggaggccaagtagaatggacaaagacttagccatctctctcctccatttctcaaggaataatatgaatttaaattaagggagcaagttgtttctagatttgccaccatggagcacttttaaaaacatcaaggggatctatgtggtcactttataatactcatgatgtgtatgttagaggcttctgttttgaagaggcaaagaattttatttcctttttgttgtgttggaagttgccctaggaggtacgcacgcttgtccatgttaaactaatgtcttgaaatcagtgtattcttaattcttatcccactagtcgtactggagaacctgagggagtcaggaaggttccattgcattgaagcgactgcattgtctggggtaaatacctggggttcattgtctcatgtcaagaaaatttagaacatggacacatatgaggagtttagaagcagaggtttaataggcaaaagaaagagaaagaaagataaaggaaaacaactctctctctagtgagagagaggggcttcccagaggaaaaggctggcctgctgcggatgcactatattttatagacaggcttgaggaggtggtgtctgatttatgcagggcccacagattggttcgatcaggtgtgacgtttacatagtgtgcagaaaaggcttgccaccctactcttattaccctaatcttatgtgaatgggctttccagttgaccggtgccatcttgtctgctccttactgtacatgtggctgggaagggaagatggagccaccatttttgaacatgattggcacaactgccagggtctatgtctgcagctctattttacaggttgctctttgttagaaaataatttgggggctgcatttcattgaaaaggaaaaccttaccgaggactctagtaccctcactatctgcctaagtaatttcttcttaactcctatgtcagtaagatgtgacagtaagatatgtattatgttggtgcaaaagttattgtggcttttgatggcaaaaaccacaataacttttgcaccaagctaaatttttcttttgaagtggttggcagggatgttttttttcctaaggatgagctacgatcgtaggaattaaaatttaacccagtttacccagattcataaaaattaatagatttctttgtggatctgagttgatatcattaatataagctatcagacatcagcttcatgtgacttaacttcaaaaatattttagtaagagtatgactggaatgtttataacacaaagaaatgataaatgcttcaggtgatggataccccaattaccctgatgtaattattccacattgtatgcctgtatcaaaacatctcatgtaccctataaatactagatactcatagaaagtaaaaattttaaaaaaattagttcttgtcttagtgccagctccatcctgagtttcaacaattgctattatctttgaggtctagcatgaggcattaaatgccattgtttcaagaaagataaatgggaatataattttattgctatcttactgttgcaaaatggaattcctaagaaacataccctttatgaattctggcaatgaaactaagactgactttccgttttcaatctgaaagctattttggagctttcatcgtcagctaatggagtcttacttgaacggggtcacatttaaacttctaataatttttatgttgtagcctgtgaacatacaaatttcaggtaaattgaagctaattcctgcaggaggtaaggtcatatgtagaattagtcattattcatattctgaaaagtgatgatgtcattatgggagagaatttcttgggtcaagaccatgcatttaaaacgattaaaattcaaaaaatgggatcaccattactgaataattagtatctataagctactttactaaaattagagaccagtgaacttactgccctaagtcaagagattaatggaaattgagagtgttctcacttatttggctatctagttattcttgttccctatttcagaggtgagatgatgttaaatattaatctggaaatacgatctcctagtagcataatacttgggaaagtcttgctccttacaaataaaaggcaactcataaaacacatacatgagatgctcttaaagccatcagcattgaaaactaatggaaccgagtattaaataataactagattgcaagtaaagattgatatataataaacaatgactttagatgactattaccaaactgtttcagaaaaaaaaaaaaacaggaaaaagaaaattcgaaggggcagggcattgatattttcctcaaaattttcatattaataatagctacatggtttaatgtctcccaactttgtacaaatacgtaggactcaccttttgtagttaaggcagtattttgctttttataatgaaagcatttttccatgttttatttcattgattaggataactcatttcatcagaagagtagtgtcaattaacatagtgacacattgaacatatatgttaaatttaccagtagaagttaaattacaagtataagttatttgtcattagaaaatattctgaagcatacatgagtcattttttccaattcccattttaagatgggtcagttgaggtcagccagagtagaataatgccattactctaattcaggacaaagattcacaacttttttggaggtgggagggtagtattttcttttatgattaatataattttgttctcaaagtaaagcataaacagtgttgctgttccttaagactgctaaaactgtgaaacaacagccattagttactactttaaattttaccaatcggtacatatatacaaaagatacaggtctataatatcttaagatgcaatttaaagtgaaataataaagcggaaatacttagaatttaatgtaagtttaaagactttactatctctgtgttagctaacttttttcaccagttctaagtgaacacatagagtaattgatttttagaaaacaaaacaaaattacatacctgaaagactaattctcacattttggagcaaattattgtattattacctgcaagaatacatgatagacaatgtataaacaatgtttagacatctattaacacaatgtttcagaaaaaaattgaaattgtaagagaaagtaaaaaaaattaaaaccttaattcttattctatttctgtaaactttgaaatgaataaatattctgtttaaatgagaagcatcttacgcctttgtcttctgcttgaaccaaactcacatttgtaaatttcagttaaaatggtggcctttattcttttgttctttattatttctttcctctatcttgctggaactatccatcttctattagtgtgaaaactttgaagatgaaaagctatttcaccggaaaaatcattgatgtatttgtgatccttaataatgactcaaatgggaatagatatctaatatgaggaactgagtaaaaaagaaccactttttaaataaaattaactaaatgaagttattgtcttagccattaacactcatcagtcatatacaccatggaatactacacagccatataaagaacaaaattgtgtccttgcagcaacatggatgcacctggaggtcattattctaagcaaattaactcaggaccagaaaaccaaataccacatgttctcatttagaagtggaagtccaacactgaatacacacggacataaagataagaataatagaatattatggacataaagataagaataatagaatattatggacataaagataagaataatagaataattgtggactactagatgggggagggtaagaaggagtgaggattgaaaaactacctatcgggtgctatgctcattacctgagtgatggaatcatgtatacaccaagattcagtggcactcaatttacctatgtaacaaacctgcaaagttacctcctgaatctaaaatagaagttgagaataaaaaagaaaaaccactcatgtgtataatatcataccttccaagtaaaacttcctctgacttaggattttttggaatagtctgtggtttacaatagagtatatattcgctgtcctttattttacatacaaagaggaaaaactaatttcattcatgcggagttatgagagaacagtttcataaggaggaaacatactgccaaaccaaaaaaaaaaaaaaaaaaagaaggtatttaatttgttctgttgaaattttagagtttgtgaactaacatgttattctgtttgtgtttttagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcaggtaaagttaaaacattcagtgcctattaatggaatttcatatttgcattttgatttttaagtagaatacttatggattgaggatgtgacttttctaccatatttctatatattctttagcaatctgtcatgagaattcatatctatctttttcgttttgtgggtggctgatacatgactgctgtaattattttgcaacccaggcttttagttccttatgcaaacttagaacataacaagaatagtaacctatagataagctagtatttttccatatgtcttggattatctgcaatattaccaacaacttcacttttgtatacttaggttagttaatcaagattcagaaattactggcattcaacaaattatgtcgaaaaggaattggatgaactttgtattctttttcaaaatgattatatttaagaatgaaaacaatgaattagcaaaacaataagccattttacaagtaaaagtataagatgatatgaactctcaaaatttacggcattatatagtgtgaattcatattaagaggttaaacagtagtctgatggaaatatataaatatatattctaacatatattggtaaaatggatgcagatttttagccattataaatcagtttgaacgaaccatggtaattaatagttaaaaaaatagatcagcatcagcaggacatggtgacacatgactgtagtcccacctatttaggagtctgaggcaggaggattgcctgagcccaggagttcaagactatagtgtgcaatgatcacacctgcgaatagacattgcacgccaacctggacaatatagtgagactttgtttttttaaaaaaataaaaactaaaaaaatctgcaaacagaacatatgtaatagtatatcaagtctgccatgtatagatcttgcagatttttcttgtattacatgcatatgggttctaaaagacccacgagaggttattaagacatttttatccgtatcattcaggaataatctctattgcatcttctgtatataatttggagggttattatattagaggtgttggttgtttattagaattttagcattgcaggtgatatttgtggattttctaaattctagagaaataatcttgagctcataaaatttaatacatcttagaaaagtgttgggacttaactaaaacgttgcttttgaagtgctcagacagactgaatgtcaatagaaaggaaacaactctctgactatctataatataatgtatttaaaaactattctaagggccaccttaaattacttgatgtacctattttatattatgcactttggaaagaactgaaattgtagttccatccccccaggtagaaatcccttctctattatttttaacagataagtaagctctgttttgacatttccatttcttaagaaattccacttatctgacctacaaatatacagacttaaagtctgctttacatttggctgaaatctttcggcctacacaatgtattagatttcttcactgaccagcctttttgtagaaattctggtcgggagtctaaagtaccttcatctttagtgaattcttttgctttgagtatgcagtagcaagttaagagcaagcttcttggtaatcctgtggaaaaatgttaataatttcacattgtcttccgaatagcaacgaagatgccactgagattactgattcagatttttgaccataatctctggcatacacatttattcttcatcatttcttactttgtcagtggtgaaggatgtgaaattttgtattaattcctggcccacatttttattctggttgtctcagttacttatgcattttcatgctgtaaggtccttagacaacaattgttataaaatattaatggcatattttcagaacatctgaatattattcatttatttcagggctctagagcactcacaaataaatgcaactaaggcagatatccaatttgaatgtcaaggagtctggtgtctctgtaattggcttaattatagaggaaaggatttataatgtagaatatatattcttataaacacccaaaggttattagctccgttccccaaataattagttattgctgagcctttacaaccttagcaaatttaggaaagaataatgttctaataaacaagttgttcacaagttattagctgatatctaagggactgtggccactgtgtatcatccctcaccgtttataactgcaataaaatttaaataatatgaatttgcaataagctcaagtcctgctctacacagaaatagtagtagtcagaaacaaagtaaatgtgaatgaaaatacagacattttgcatgttggtttatgaatatccagtagataaacactgaacttgagctaatatccataacctggtaaaactcacttatcagatttatcgggcaataatgaaaaattaaaaaaatagaattaatagaaaaaaattagagtttggaaaggcatttagtttttattctactctggctgtcaatgctcaaaatgtggtttccagaattcttggggtcccagggacacatccagatggtctgtgagattaaactgtttttatcataaacctaagacgccattttttcattttcactgcgttgtcatttgctctgatgatacaaaagtaatgagggctgggcgtggtgtctcatgcctgtaattgcggcactttgggaggcttgaggtcaggagttcaagaccagcctggcaaatgtaatgagacctcatctctaaattatatatatatataaaatatatatatatatatatatatataattatatatatatatataaaacgaatagctgggtgtggtggcttatacctgtagtcctagctacttgggaggctgaggcagtaggatcatttgagcccaggaggttgaggctgcagtgagccatgatcatgccactacattccagcctggcactggcatcaaatttactggtagtcaggtgatatttaatgtccatatactcagagtaaaaaactctcaaaacaaagcaaaacaaaaacagttttgcttatgattataattgttgaagcacttaaaaattattaatgttattaattatctaccttggaatacatactttctaacattctagtgaactgggaagtagatataaaataattctgctatgcgtcaaagtattatgacaatctctatttcttaattgcatcattgcttgagtcctgagctggacatcatctttactttaaagttatgactgacaaattatggttgttcagatagatataggtcagatattttcctgaaagtgaaccaagtgagcccattcatttcaagataaacaactgaccatatataaggtcattgattaaatgtgagtgttcaagaaaacattagaattgtggaggacatgtattgtccactgtaagcttgagagcttcccgatacttaatactgctgattagatcagtggcaattctaacaagtgtcaatttttgatattctataatgaaatgcatcaatgtttggaagacacaaaattcagtgagcgggtattttttccaaatgaaagctccatgatgttacaaaatcatttgtagattaaaaaaagtaaaatggtttaatggtacacagtatgaaaagttgattgatagggtttagatttcacatttcaatgaatgtttaaaaaactacacttgtatctacaatcatcagaaaggactctaaaatttcccatcattttttaactacgttatctgtgtacggctggattttctttatatctttgaacaaatcaaccctatttcaacagatgaaatgcagaagcagataaaagaatccatctgccttctcaagaaattgcagagatggcctttagttctagccactcgaaaggctgaggcgggaggattacttgagcttgggatttctaggctgcagtgagcaatgatcctgccactgcactgcagcctgcatgagtgagcaagaccctgactcaaagaattaagaaaaaagcaattacagagatttgcaatcatgtaaagtaatgcccttcttctcataatatttaaaggttttcataaaatatgtgatttactttaacattgaattattttaaataaattcataagtaaacattttgaaagacattttgaaagactttttcagtttttattcctgttatagtaaatattgttagctataccccacatgaacaaatgctctttgagatgtcttgtaatttgtaagactgcaaaagagtcctgagaccaacacgttgagaacaatttatctaggctaaatccttaatattacaaatgagaaaacagagagtggttcagggcctggtccaatgtcacaggttttagggcctcatttgcaactctactgtggaatagtacttatttaagttaggctctgtgcctgtctccaaattgcttttctcatactttatttgccaaagtcaggtccctgctgcgaaacagttttcatttccttgtgaatcaaccctgtctttttattagagattctaagaactgtactaaaactgggatgtctccttttgaaaaatattgagtgctcatcagcagtagatctttacacacttcatgatctatgttttatttcaaagcttaatccaagttgtatttccagcattagtaaatttattttatagttgtaattctcagaaatgtaatctcgctgctctactaggtgagaggcaaaatcacttcctactttatttatttatttatttatttatttatttatttatttatttttacttttatgaaagagtctcactctgtcacccaggctcaagcgcagtggcttgatcacacctcacaacagcttcaacctcctggtctcaaaattaatccagttaatttttacatttttttgtagggataagagtctccctatgttacccaggttgttcttgaactcctgggcttaagtgaccttcccacctcagccacccaaagtgttgggattacaggtgtgaggcaccaagtgtggcccactccctactttttaaaattgtgtttgtcttgtagattacttatcaaacactaacagagtttgtcacaagaggaggggatatttgaatatgaagaatctattaatgccattatgcatcagttattattatataataatggttattagtaagttaaattctctaaggaaacagaacaaaacttccaatagataagtgagaaaaggttataaaatgaaaacataaatgaggaataacaaacactaaacaagcccatgaaagaacatttattacccaaaaaaaaaaagaaaattaaaataaagggaataaggagtttatattttcctttgtaataaatgctaaactattttattattttgaaatgttagcattcactggtggcaaaaatatagagaaccactctatttttgttatttgtgtatatattctgtggtgaaatgatatttacaatttacccagagtaattaccacttgtgtccatgcctggaaatttatcataaatcagtaattcaaaaaaggaaaaatctatttactcaaaattcctattgaaatagtttacctggaaagaaaaaaaatggataataatctaatgaccagtaatagaattattaaaaattatagcatatcagtgggaagaaataatgtaaaagcagtacattaattataatgtgtttatagaaacacggaagattacaaacagaactttcaaagtgactgaactaagtaaaaatgcatatgcatgctaacatagattgaatgccaataattttaataatatatatttttaaattgtgatgacatagcaacttttcttctgctataaaaatcattaaattattctgggtttaaataaaatgaacatatattaaaacatgaaatgatggcagtgaagtgtattccttagaagtaagtacatgttgcaaagagagagtgagatttattctgattttcacttttgtatcatcctttcacttatcagtatacaaaagaggtttaaagtgttttcgctatagattaaccttgcctgctgtttgaatagtgtgtttttaagtacatattttaatatttagttcaacaggttccaacaatcataaaacagtcaaaagtccaagttgcctttcccttcgatgagtattttcaaattgaatgtgaagctaaaggaaatccagaaccaacgtgagtattgtttcaaacgaagtggttctttaaatgcgtgctgttctttatgctgctctttactcttaccatcacaagcctgttggactatgaatccacgcatgattaaagctaagggtttacaaaaaatcatatccatgcaaacaaaaaaaaaatttggttatttcacatatgtttttctgccacttgaatttattttgaccataaactaagggctgttattaaaatacttagagtagtctttggtacagcagaaatactccacaatcccttagtctacaaataaataaggtagctgaaaactagaagatcctttattctacttagtaaaatgtagcatttattaagtcaaagtttgtaaataccattctatacatatttataattgtgcgtctttaaatttaaacatcttattttgtggataggttgttacttgattttttttaagttgtcatagaaatattgtcatctcaggtggcagagtactattgcatgatatactactatctagtattattttattttagaattaaataattgttattctaggtgaccataatcactgatgagctttttcaaaataccttctatgtttggggaggaagaaaaaaatgtggatgtattggaagtgagaagggagaggctgtgggaagaattcccaatattaaaactctacgtgattctaaaatggaaagcaaagctacatacttttattattctgcatgattatcttatattcattaagaatatccatatttaatgaaaattgatgattttcaattgtatcatgactattattattgcctgatgggttgatatttaataatcattagtgacccattaacatgctaaattataattatttctatgtttaaccaaatggaatatattcaatcaaaatatgtaagtatggatagaattacaatggaattaaggataatttattcaatcaatatggatatattgatcaatatcatgatatattaatattaattagctgaattattatgtcaaaaggtaataccatacacttgtcaacagtgaaatataagacacacagagagaagtaaaataagtcaggagggtggctgggtaggcctactcctaatgagaatacatgtccattgaaggtttgttattcctgttggaagaataatcacatagattagtgtaagaatatggcgtcctgaaatatacccaaatttgcatgggtaattccaatatacaatgctgaatacaatctaattgggaagtcattgtttgtctatcagactgataaagatttaaagagacttcttaatgtcattgttcatagaactgacactctagcatactggggtgggaatttaactgtgtacattttttttctagaatataattttgcaacatttatcaaatactataaaaagtttttaattattggtttattaatcttatttctaaggaactggcatattgaaatatttggacaagtaccaaagaataaatatatagggttgtttctcacaatattgttcataaaaggaaaaacattgaaatggttaaaagtaattaaattagtaaccatatgacagaagataatgtagctataaaaattgtctttagtatcattataataatggaaaaattcagttggccaaattatatattcagtgtggtctcaaatatgtgacaaaattctaaaaatactaataggaaatattagcaagtgtaataatactgggcttatctgttttgggattttgagtgagttccttacacacacaaatacatgaacagaaattatatatgtttcttgtagtctccagaatattaataataatcttgtattacctttctaattaaaaataaataaataattttaatttaaaaaagcaaaagctaatttcaatcttaatcctctcatttatcaagctgttttatggacagtaatatttctcagattcttctgagacccttatttatatcctgttatattccattaagtatatactttttatcataaaatgtcttggttttgtcaattttatgcaattgttaataagtactctaaacatatgtcattatttttcaggattattaagttcagttttatgttttagattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtaagtactataacgggaatttcattttacaagtgttttagtgaagtgttaaataggagttagattgggttccaatgaaataaagcagttattaactaaatcaacttatatgtgtcttgtattttatttataaggaaaaatttcctccaggtcttgatacttaaaatcggatgaccttagaaaacaacataatttgactctgtttcagtaaccttatatctaacatggaaaaatataatatctgctttgccttataagatgagaattaaacatattattagttaaacttggctaaattctatgcagtaatagataaccccaaaacctctatgtaaacataaagttattccccgataaagcaatttactgtgggcctggcaactctttcatgcagccttcttgctgatcacagctaatggagacatcgtcattctgtggttgcctcttgtgaaacatgccattttggtcaaagagtctgggacgaaacatgaaaaattgtacactggctcttaaatgcttctgacaagaagttatgcaggcaactcctactcatgttttgttaggtggggcaaagcaagttgcatagtcccatctaacatcaatagtatgatgctcattaggaaaggagaaacagctattggtaatgttaaccgtaaataaaatttgtgtaaaactgcaagacactttgttgttagaggtgtatttatcagtaatcgtcccctgaagtagcgtactttattcatagcttatttgccctatgtgcatgggatatccatgaccaccttttatattttatcacgttttccccctgttcttaatatatccaccattacacaattttagccaaagcctttatagagtaaattggtaagtataaaactgtcagccagcttctattcggtaatttcttcttttagagtcctagatatgaaagtatttcaaagaaagtcctaggacttgcaaaatatgaacacttgattctgggggtgcagaatggccacaaacttcagaaaaacaaatgatgaatctttaacccaaaagttcagagagggcattgtatttaaattgtcctaaagtccttatataattctagaggaaggaatataggtcaaatttagactcggaagtaaggtgtgcatcttaaaatttataagtatgtacactaaaattataagaaaatagtattatcacacaatgtggttgatgcagggaagaaaaaataaaggagagaaaaaaagtaagacaagcagaaagaaaaagagatagaaataaattcaaatatatcacaaatgaaagacaaaagtaaatagaataaatgctctgagttaaaaaaaagctataaactttttacaacacatctatctaaaccttaaggatacagaattgttgaaatgaaaaagacagaaaagatatcccagacaaatgctttccaaatgaaggtaggtatgaccatattaatgtcagtcataacagactttatttgtaaaagccttcatggaaattaatttactagacatatataatgttaaaatacctgaagcaaaaatagaactacaaagagaaatagacaaattcaccataataatgagatattaacatatctttttcattatttgctcactcaagcagagaaaaacatcagtgagcatatagaagatttaaagaatacaatcacaagctccatctaatgaaaacacatagaatattgtaactaacacggcaaaatgagttttttcatacacatggggtaaaaggttatatttgatgatatattgggctatgaggaaaatatcaaaatgtaattaagttagaaatcaataataaatagaaaacttaaaaaacttatatctttgaaaactaagaaatacatttctaagtgagtcttaggtcaagtaccaaatggtaaggaaaatagaatatattttgaagtgatgacagtgaaaactctacataacaaaacatgttgaatgcagtgaaagcattatttagagggatctttatcattttaaagacatattagaaaaacataaaggatgaaaattaatgatcttagcttattaggtaacataattttaggataaaaatgaatgagctaatttaaggcaacagaataaactggagtgaagggagaaaatagtataaaagcagaaaataaattcaacaatgtggtatgtaatctttgtagtgaaagtatccatatttattaaaaaaagaaaaaatctagacaaatagaaaataagtaaactatttctatttattggaagaatctatacacttaaaatgctcattctcaatgggttgatatatagaagaattgaaatcagaacgcctatagtttagtttttgtttctgtttgtgaaatgtgaccagctggttcaaaaatatctttgaggaacaaagggcaaacttcagtagaaattattaaagaataacaagtcataggggattcttgttttcagaaatcaagattcagcttaattcaggaattaagccattatggttctgtgcagggttacacaaatcagaatagcatagtaaacccagaaacagaccatcacatgtgtaaaaatagttgagggaattggcatgttagcatggatctctctctctctctctcccccactctctttactttgaactaaacattgtggaacaattgataattcacacagagaaacatttatatggacttccacctcatatcatataaaaatcatctcagagtggataaaaggctgaacagtgaaaggaaaaaatgttttaaaaagtgagactatttgaacaatacgtttatcaccagggtcattaatacagagaaagatttcttttcctttcttttcttcctttctggcttttttgtttgtttgtttgtttgtttgtttgtttttgacaggaactcactctctccaggtcaggctggagtgcagtggtgcagtcatggcttcatggctcactgcagtcttgaactcctgggttcaagtgatcctcccatctcagccttctgagtaactaggactacaggcgagtgctaccgtgcctggccaatttttatttttatttttatttttgtagagatggggtctcactatgttgccccgggtggtcttgacctcccagcctcgagcaatcttcctgcctcagtgtcccaaagtgctgggattacaggcatgagccaccatgcccagtgtgggatgatttctttagtcatattaaagcctcatgaaggaaatcatcaagaatacattctcctacatttgattttagatcctttttttattgaaagactctaggaagaaagtacaaacaaaaataagccacaactcagataaaaattattgataatgcatataactaaaaatggtatgtattcataaataattttacaaatctttataaaaaaggaaaaatgacaaagtggcaacatatataaacttgaacctcagactggagggccaataaaaatgtgaaaatgtgttcaacctctttagttaccagaaacagacctattgtaaccctagtgataaaagcatttgatcctacccaattgggaaatatcagaaaatccaaaagtaaaaattttagattgcaatatacatccaacagaatacgtatccactactgatgacagtccagtttactgcgtgatctttggaaaacattttctaatcccctccttcgttgaagatgctcttacttatgaccaaacaattccgttccctagctcatgtgcatgtgcctcttgtccatacataccaggaagatttgtggtcacattgtttatatttaaaaatatgctggaaaaaatacagcagtccactcaaagtagaatggatcaatgcattgtgctctattcataccaaaaatactattcaatagtaaataaaacgtcaagaatatgttgagcaataaaagtaaatcttggagaaagtttgaaatatgtaaaactgactacaattttgattggtataattttattgttaaattataatgaaaaataagagaatgataaaaacaatattcatggcagtaattacctgtaatggaagtaaaaattggaaaatggaagtgggggttgagatcagcacctgacaaaaaggtgatgacgatattcctattttgtaaaatgggtagtaagtgaatggatttccattgtgtttctttctttctttgtgttttttttacatttattctataaacaattgttttatattcttaaaatgagtaagtgtgaagcatcccgtttgtctcaagtggacatttctgagttactgagatattttagaatcagaccagtgacatgtcaacctgaaaattgttctcaggagtttggatttgaattgactttcagtaggaaatgtccatgaattctggattagaaagtattgctatgaaaattgtggttgatcatcgttaaactgtatattacatttatatacttcactgaaataagttaagaccagagaaaaggacagataaaatatcttttgtaggaggcaagtcatgaggatgattcctaacctaaattctaggggttgctatggagacacaaaggaaaaggcagcagctagatctattgcaaagaaaggagcggcagaatttggtttaagattctgcaattaaaggatttcagtttttttttctgtcattatctaggcagaccaagtgaagacatgaacaatataaggataattctgaccagaatatgatatgagagtattgtattaagagctgggagttggatctgagctacgttgttggataattgctctattttttttattttttttttttgctgctgctgcagaaaagagcaaaataaattaggtttcttatgcatcatttccagcctctcctgaaattacttcatcatctgacagctttctgcaaccatctatatattgaatagtaacccaacccaatacttaggagtttataaatcagagacaatttaaagcttcctacaatctttaatcgattcttctcttaaactgtagagaattggttcttctcaaagattgatagaaactttgtgattcaaatgttacagtttctacttctcaatctcctgttaacaaacagaaacctttgtatacaatgtccagttttctattttcaacaacattgcagttaagtttcctagggaaagagtgaaagaaacaacaacaacaagaaccaaacaaacagaatgtaccatttttatatacacgaaaaactatttaactaaatgtattatccaagacatggcacagggattttgtcagtgagttattcaacaatcttcctgaaactcccataatacaccagccactttctagtaatttgggatttaacagtgaataaaaacaaagactgtcctccagaaatatacatcctgtgcatgtatatggtgattgggtctggaaaggaagggagctactctcttgccttcattatccaactatcagtaaggttaaaatgataatataaataatcctaatttgactgttgaatactactcacacttcagtgcacagattagatttctccacttagcattcctggcctattccagcctagataatttttttcctttttctgagtttttaaacaacttgtttgtttgtttgtttgtttttgttttgagacaggatcttgctctgttgcccaggctagagtgcagtggtacaaacatggctcactgcagcctcatcctcctgggctctagcaatccttccacctaaacctacccagtagctgggactacaggcatgtaccaccatgcccacctataaacatcttttttgaagtataatttacatatcataaattttacttgttttaagtgtataattactagtttttatacattatttatttatttatcttagagatggggttttgctatgttgcccacactggtcttaaactcctgggctcaggtgatcctcctgcttcagcttcctgaatagctgggattattggcacatgacactatgccccaccaatgacttttttagtaatttttttagtgaagtatcattataatgtagtattaaaacatttccatcaccacaaaaagatttcttgtgcccatttgcagtcactctctgttcccatctccaggccttaggcaaccaccaattaattttctgcctccttaaatgtacttttctggacatttcatataattggaatcatgtatatggtctttttcatatgtcttctttcacttagcatgttttggaggttcatccatgtagtagcatatatcagtagtttatttctctatattgctgaagagtatttcactgcatggatatcatttcctgttaatccatccaccagttgatgaacatttgaattatttccacttttggctattataaatagtgatactgcaaattctctggggttattaaagcatttagttgtgtactgttagggacagtctatcaattgtcatatgtattaattaggatccttaagaatgagaaaaaatatcagacagactgtcatatccttcccgttctgcattgccttgtagatgtcacaagaatgtgtattatatttatttcattgatttattggttgataggctgaaaaataaaagaatgaataaaagtaacactgcaatttgcacatgctattaaaatagtctacgaaatgtctgacaaagatgaaattttctatataataatttaatgaaaactaattagaaatattcatgcactaggtttctacatttgtgttaacatacttcctcagattcctcaggacaatttccttaagataaaccctggctttttaccaccctgattttggagggggagtgtaggaaacctggatgttgtagcctgtgctaaattctcctaagtgcaaatcaacaaaaacagatcaatttgttcaattaagggtgcaactttgaattctaaagctttaattaagttcgaggattttactctgattcaccaaagtatgtgaatgcctgtaatgaaatgggctgaactgggtgtccttccttagcatgaattcattatgagctcatggactgaaagccagtgttatttctctgtagtcctaagtggattaatgggatgttctgcaggaaatgggaatcaattaaatctctttaccaaaggaaaccggagttagaggtgataaagtatgtgcactcagtagcatgcagttgtgacaatgatggcagactgtgagcaattcgccaagcatatttaagtgaaatgtacggccctggaaagctcaccaggccagtcctgtaaacggagtgccaagtcaaaatagataaagctttttggtataggaagattcgtccaatgatggaaaaagggaaaataattcaataaacacatcatatgttctacatgaaatgaacaaatgaacaggattttcttccttctgtccttctacctcctctgaaaatgttaattcaaataattgcacaaagtcacagaagttgttgagatgcaggctatggagaaaatcaggagcagcagcagaagaaaactccctgtccctttggcctaccttgtctctgtgcgtttggctgtaccatgcaaagtgaaaatatttgaggagtagccaagatgtattgaataatttttaagtgcttgctcctattttaatcgattcatgtgaaatatttaaatttcaacataaatcaaatgagttaggtgttattacatttcccacttatgaatgacgacactgaaacatattaagtagcagattcaaagatcgcataggaagagaagccaggacgcaggcccaagcagctgacttcagtgtttatggataatctgatgctacagtgttgtctgtactttgagactcaggtaacacatgctacagatgagcaaaaaggcattgtacttctttgttgaaaataccttgatactagattacagtatcatctagaaataggaaaatataaggaaaccttctattttgttcctagagtgccggagaatctgtagtgttgcataacatggtagcggttaagatgccagtgttttttggtttttgtttttttcatcacagtggttagttagcatgaattgtatttagttaaatttccctgatggcatttcactactactcttcactattaaacatgttggcatgatgggattacacagcttaggttttattatatctctacccttaagaagcttctaccctggtgaggtgtttgaggagcctagagagatgaattcaaaggattctaagacaccaaaggaaaacaaaatgagatacagaaaaaggtaaagatattggtctgaatctttgtaaccagttagttttctagtgcctgggctagaacctagtttatgctgtaggatatcctatagatataaattctgttttcagaagtcttctttatttcaggaatgaagatgctatttttctgtatattatgttgaaataattgggatgatgagttttcaaaactcattgacagcatctgaagtcatagagctcctgcaaattttgtatctgcaggttggttgtgccttgatagttgtggtaataagactcctgtgcagctagcttgtctgtagggaagtgtttccatgatggatttcaactggggaagttttcaaaaacctagatgtgaatatatttgaatgtcacttatacccttggtgttagttgttgctagaaatctgtctatgacactgaataataaatgtgaaagcctaatggagaagagtgaaaagatagatgctgtgatatgcttgctttgctgatgcaaatggattaatagtggcattagatagaaaggaaattgatctcatctagacttggttataatgggatttccaaacattcttttgtttttgtttttttttttttttttgagacggggtcttgctctgtcgcccaggctggagggcagtggcacaatctctgctcactgcaagctccgcctcccgggttcccgccattctcctgcctcagcctcccgagtagctgggaccacaggcgcccgccaccacgcccggctaatttttttatatatattttttaaattatactttaagttctagggtacatgtgcacaatgtgcaggttagttacatatgtatacgtgtgccatgctggtgtgctgcacccattaactcatcatttacattaggtatgtctcccaatgctatccctcccctctccccccaccccacaacaggccccggtgtgtgatgtcccccttcctatgtccaagtgttctcattgttcaattcccacttatgagtgagaacatgcaatgtttggttttttgtccttgcgataatttgctgataatgatggttttcagcttcaaccatgtccctacaaaggacatgaactcatcatttttatggcttcatagtattccatggtgtatatgtgccacattttcttaatccagtctatcattgttggttccaggacatttgggttggttgcaggtctttactattgtgaatagtgacacaataaacatatgtgtgcatgtgtcttcatagcagcatgatttataatcctttgggtatatacccagtaatgggatggctgggtcaaatggtatttctagttctagatccctgaggaataacactgtcttccacaatggttgaaccagtttacagtcccaccaacagtttgaaagtgttcctatttctccacatcctctccagcacctttttttggcatttttagtagagacggggtttcaccatgttagccaggatggtctcgatctcctgaccttgtgatccgcccacctcggcctcccaaagtgcaaacattcttgaaattctgcttagctagactgttatgtgcaagttgattctgatccctttgcagagaggccattcaggatcaagtccagtcttgttgaaacaaagttaagtgatttttggttttggtgttgatgaagtacccatgtgaaatatattggcaagataaaggagtgtaattacctcatttaccgaaaaaaatatttttttaatttacttttaaaaatattactgttgtccaaactcagcaatgctaatgtttgtcaccagataaacacagtaaatgccactggttggatttatttttaaatggagtcatttctttatctgaattgaggtagacttcatgttagctgctgtgttatagtaattaaagttcacatttatctgtgagtgttaaaattttcactttttatcgtgccatcaaactcactaaatagtttcagagtcaaaggataagacataaaaaattcctgaaaaattaatgccatttatatatcttctaaaaccttaaatttattgatgtataagtatgcgtccctgttttccaatattcattttgtatttagttaaaagctgttctgaagatttatggcacgcgatagcagttttggtagagttataaattttcttttcttttttattgttggtgccttagaagccagttgaattacaaatttacattttcagaattagaattgtataatctagatttaattaatgcaaggatgataatgcttcagtggcagtactatctgttcgaattgctaggttttttttaacgctctcagggagcagctctccaattagggatttatacatcttattaattaactactttacaatagatattatccagtgaactgtgtattcatattagggactgtatagtttgcttgttatcgaagtggattacatgccctttccattttctaatccatattttatttcctctgctgcctcttgtatctgagtatagatagattcaccaactacccaacagcaccactgacttcaatgccagtgtttactgggcttaagttacagcgaataaaactaaataagtggttcaatttggagatttgggtacataaacgttttgtatattactatgccttatgtctataaggtgtactttctgcaaaatgttttccatagcatttgatgtcaatcaaagccgaggctttaccaaatagctggcatgatgttttatctacaagctcttaatgtagtgaatatactaaacatactttcccgacttttgagggaaatttcatgctacctatagcaaaaatgtgattcaaagatggttgctatttcaaaaatgtttccagagactttctaaaaggaatcttatagaacgagttgagcaagaggaaacccactaaaggactgtcacatggctgaatgtataaagagaaccaaagtctgccttccgaaattgcaaaggcagtgtaatagccacaccgccccctgcaatgttaagccttggaaggtccttgaatttagacaaaaagcaattcactgtaaccagctggtgcatcgataagagaaatgtcagcaaattccctcaacctctaaaggcatggatgggggttgaggggctataggacaaatatataggaagtgcacaaagcttctcaagaagaaattttacagtaaatgagtaaacctttatatttccaagaacaatgaaaatcggttgtgaatcataatttaagaatgaaacatacaaataaataccttctaatgaattccatcaagttgggactgttataactgccttcctaagatccttctcctccacaagagactgtgtaattctataatgcaaattcccccaccaaaagttgaaagatatcaatgtaatgctcaggaagaatacattttgaatatccttataaatatcaatacttccataaaaatattaaactttggtgttagatttcaaattctgcacaattctgacttatattctgattataactgcattgctcttttaagaaattgactccagtgtggggaggaaacaataggttgaaatattgacaagtctcatttcctacatcaattccatttcatttaaatttttatttaatgggagtaatttcaatgtggctggctctttttgcaacttaaagtggtcaaatttggctttccattgcattcttaccattttctccatatgggctgggaagtttttatttagtgtggttaatgcactggctggaatatttgccaatcacattcaaggccttcccaataaagcgagagatagagaatatgcaaccgcccaaagtgaaatcagtgtttggagaaaaagatttcacatctatcaaagctaaagcaagaaaatcctgtgactctgggtttatatctctgctcagagaaatatgcacaagtatgttattgccttattgttgtcgcataacaaaaacattattgtctggggtttcaaaatgcagaaatatttttaaagttgtgtaaagatgcacaccagtttcttaatagtatttaactctgaaggggagatgtaagaaccaggatctgtagcatagaatttatttaaattgctgaattttgaaaaaaaagaacatattaagatatttgttgttatagtcaaagttaattttaaaataacacattaaaatgattttttacaccaggtgttccaaaattcccaaaagaaaaaattgaccctcttgaagtggaggagggagatccaattgtcctcccatgcaatcctcccaaaggcctcccacctttacacatttattggatgaatattggtaagtaatgctccgttccatcaaaaaagggggacattttaattctatccatcatatcaataacataatgaatccaaagacaaaataaaaaataaagatctcttaattttttcatatttgaagaggagatgctactaatatgataagatttgtctgtgaagacaatacttcctatatttcaaacagtgcacttacctttggaatatagatcatgtgaaagctgaggatggcatgggtttgtgttgctagcttcatctttctattttagtaatgctctacctgctaattgcagtcacctaccaggaaattagtattaacttttttgcttaattttctaaaaggtttgctgactctgatctgaaaatctagctttgtaaagtctacttctagcatatgccttagcagtgatctctacatgttttctcattgtgaaccatagagaaaaatgctatttgcacagcactcagaagaaagcaaatgaagctactcttaggtacagccaattgttccagacatcagttcccctagaaccttccaggctgcaaccagaacagggagattaatatcacggataaaacttttggagagctttttgttttttctttttaaatcatgttttaaataaacgtgattctcagaaaatacaagtgttaattaggtcattgtctgcattgatcagttttcagttcagccaattcagattcatagggcagaggtggagacaaagatggtaaacagagtttaccactgtttgtctactggtggacttctttggttaatggtaaaaagtatcctcccaagggttttgctgctgtttttgttttgttttgttttcctatttgctcattgttcctgtagtaagaccagacttgagaggaattaaagagcaaacaggaaaaaccaaatgaaataataatgtaaaagaaaatgaaaaaggaagatgaagcacagtaagggacaattgcccttttcaatggcaagatatctcttttcagaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttgtaagtccacataatttatcgtttcatcatgtatgctgaatgcaaatgtgtctgtaatttccttctggctgaagccatttaaagctgggttgatattttgcaccattgtgcagttcaactctggagacttcttccagatgaaatagacatctgcagctgcagattcacggtagctctgtctctcacagccaggaaatcacatctcaattcacaggacaaatgtatttcatctgacatctgcaggatcttgtcattttcagtggatgaaatatacaatgaaattccagggttttctaagcaaatcttgggcatcgattcactgtgatcttggataaactggcagactgaaaatgggggagaaaacaacagaggcaaaaagatggaaatttgtatcaccaaactggcaaacttacttgaatcaccctttcccgacttgattctgtggaggccagcctgggttcccaaatgggaagagtaattagagggaggaagaaccgtaagattcaaagggaagaaataatccccaacagtttgctgagcgaataattggccctggtatagttgaaagttggcattaccatttcattgtttaatttggtccatgattttttcatttttatgtgtagatatgccatgccagggcttcactataacattcttctagtagcctcagttctcttcagtggagctataacttgaatcttctccacctggattcaagattaaactcactataattattttctatgtaaaactatattcccaaaggcaatgttctagtgaagcatggttctacatcattttgtaatttttctaagacaaaaatatgacttttcattctttattgatatcagcatccaccattatgtttgtgttttttccttccgtttttttatttcagtaaagcatgctaatgactcaagttcatccacagaaattggttccaagggtaagttgaacccatgtggagtgttggcatttgtgtatagctcattgtcatctcagattttgaattttttctttaatatcctcttaagtttattacaatactgttattatgaaaaacatctgaacttagagggttctattgccccccatgccctcttaaatatatgcaaagggagtgatttttataaatatataactgtataaatataatgaaatacttatatataatgcattgaatagacagatagagatatttaatggagtaattattttgggtctcccaaaacgtctcttatggtatataaggttgatacttttgcagaaagaaaagaaatggttaagtgtcaaaagacgtagagaaaacactgcgtttaagaaagttaagtggatttttttcttgcaaggctttttgaaatatttgacatgcaactgtacattgtggctttctgagaaaaaaacagtttgtagcatttttcaagttcatgtgtctgcgtgatctttttatttaattctttcccccatagaacgtctaccagaacttgtgttctatggaaaatgcctgagtaaatctgagttgtatagcaggctagttctctataatgagaagagtcagttacataattgcagcaaatattctctataaaatgtggaccagtgataacttagataccttgcatacttgcaagttcagtggaggaggatgtaagctccttttgaagaaccgtcagttttaaggtggactgattcatccccaacatcatttcctttgagattaataactcacacatatatagtgctatattttcacagcactcaatgaaaaatcattgcacatagtacatattcaacaattatttttcaaaaaataaacacgaagtatagaagactgtctactgctaaagtccctttgaagatggaagtcttctaatttgccattgtatttgaaaaatattcttaagaaaataagaaatgggacacttcaatatgcaggtagtgaggatgcttactagtcatttcctaaaactgtgtttttctttaaggagctgagactacaggtagagttgccgaaagagcttgataaattcatagatgcctagtgtctaccacagccttcctcagtgagaatttctgagtgcaggagtgaggaagctgtttttagcagaaacctcgttaaattcttaggcaatttaaattaaataaaaacataaacataaagtcattgcacatgacatgattgaagtatagaatataaaatcatagattttcaattaaggacttctgtttgaccttctgagttagcagatatggtataaataataatatttataaaattttgcagtgctacgctcagtaaaaacatatgagggacaacccatgcttcatggtaagagagaagaggagtctatttaaatggaaatatgtgaaatgtgtatagaacacacacacacacacacacacactcgtgtgtcggattttttgttttaagaaagatgtggtgtcacagaattttatgtatattaatttgaaaaaattctgacttttcttttctattttgtagcaaattccatcaagcaaagaaaacccaaactgctgttgcctcccactgagagtggcagtgagtcttcaattaccatcctcaaaggggaaatcttgctgcttgagtgttttgctgaaggcttgtgagtaacctgactctcactcatgactttgtccatccagttctgtaaagaataagacatcaagcacattaagactgtgcttgcaaagatattttaaaattatttccttaaaaaaattaaattctgccgggcactgcagatattctgctcaggactgttattccaggtacttaagaggctgaagcaggaagattgcttgagcccaggagttggaggctgcagtgagctatgataatgccattgcactaaaacctggatgacagagaaagacctcatctaaaataaaatgaaattaaaattaataaaataaaataaataataaacataaattctgtcattatatctctggaggaagtaatttgtacttcactctacagacttcaggcagtaacaggctcataaaattagatctctctgtcaatttatgatattgtggatggaggggatgatgataacattctccttagttaagtttaagaagcctgaggttgttggtagtcagtccctcacttttggtgctgagttttctctctatgctatactacttgccccactcctgtttgctatgttacttactaaatctgctgctttgcaggttccaaggagccctatttatatctatttttactctgctgccctttgcacacatggaggtccagaccatgtaatttaagagagttttacatcaaaatctaattaagtgaactttctttacacctgaaaaagcaatccatttatttatttatttatttatttaattatttattcatttattcatttatttatttttttgagacagggtctcactctgtcacccatgctggagtgcagaggcgcgatctcagctcactgcaacctctgcctcctgggttcaagcgattctcctgcctcagcctcctgagtagctgaagctacaggtgtgtgccaccacacctggccagttttttgtatttttagtagagacagggtttcaacatgttagccaggaaggtctcgatctccggaccctgtgatccacctgagttggcctcccaaaatgctgggattataggcatgagccaccgggcccagcccgcaatgcacctttttaaatcctccaagaaaaccctaaaggacctcacttggtcacctcttaaaattgttccatttattaactactgttaagtacatgtaaacagggaccatcttatttaatatttaatcatacagggtctcctatttttaccactatccttccgaacttacggtccttccctaccattgaggataccttgggaaaatgcattccagcttcctagcacctgggattactcatttgaaatataatctgttcgtaagctaagggctttggggactctagttagtggactaggatttgaaattcaaaaaatcatattcattcataatttagagtacattctgaacgactggtttagaaatggagcagattttattggttttacagcccctaagctttgtaagtttctctttccaaccaccaaaaatatcaaagttgcttgtctgtcttcaactcccaatgtgtatttacataaattagttagaagtactatgacacagactctgtttggaatgtttggtctgtgtattattttagaagaggaaagtctcatattgagtttgaatcatgatggcaacaacctgctctactggttgtatttgtacatgtttacagtggtagaaattacattcttgcagagttcatcactgtattgagttgggcagggtgatcctttctgtaattcttttttcttatttcccacaaatgccttcactgacctcttggattgactagcaactgcgcagaatgtcttcaaaataatgaaatgctctcatgtgctttttagaaaatgaagagtcatgaaggaatatataaaaacagagtggatgaaaatatatgttgttgtgaggacatgaaaattcttgatgcgctgtcctaagacttttcacctgaagtagtttcttcttactcatactgattttgtgttgggtaatcctgtctgatctgggtcgtctctcagaagatgatacatttttaaaaagttttttgggtcctttaaaaaactctttctaagaagttttcaagccattaacctcctatagtaacaaaaataattataattaaagtattgtactattattttgtgtcaagcactatatttgggtctttgaaaactagtctaattgtctaatacattttacttgaaagaataaagtaaaatgattatctataagtgtcaggtgaacatgagatataatttatctcaagataggtctatatcttggcaagaatttccagctatattcttgcaaatgtttttcatttccttttgttttagatttaagggatatttaccaacagtatctgaacaaatgtgttttgagggaaaacttataaaatggccatagatggactcatgtgcactgctcaaatagtttttttttctgttttgtaaattcgtgggtttaaagtaggtataattctttcacaagatactactttataaatagagaaatatgcaaataaaagttggccagacaaggacctgaaaaaaattgagattatgaggtagtgtattttgtgtgcaaaaaggcattaagcaatatattttccctcaaaacacattgcttaaatgctgttagtaaatgttatttaaatttaaaaaaaggcaggaggtataaaaaaattggcaagaatagagctgaaaatttttgccatggtatagacctatcctgagattaaattatatctcattttcacataatactttagatcattattttactttattctttcaagtaaatggtattagaaaattagactagttttcaaagacccaaagactagggagtccgggagatcttgctgaaagtgagttacttgctctaataaaggatggactcttgaaaaaatcctgttttaggggaagtgagttccagagcagcctataacttggcaaattgtcattttgacagatggagtgaaaagccagcagttaggagacttgagctatgcatcctcttaggtggtgtgctcagaaagccagcagctaatatgctctcacagctgtctgcccaggcatcattaccatttcctacacaagcgtgccatgtgctcttagcctggtaaaatataagattattattccaggctgcacagcacgttagtgtttgaggcttgaaggaagaaggaaaagagtagatatatagagattaaagagccttcatctttacctccaattttttttgcataaataactgaattattttaaccacaaactatcaatacaaataatttgagaatattgacacacacgatttcaaggaattgctcaattattacatagtaactaatgggcaatttgacaggaagcatatattctaagactatagagttaggaaggacataggttgaaaagcacaaaataatagaacacactgataaaaaaggaacaagtttagagtagacaaatataagttggggtatatcatttattgctccagtgaccttaagaaattaatttattggagcttcagactccttactgttaaatgatcacaataatatgcccatctttagaactcaccaaataacctacagctactaataacaagaagaaatatggagaggaaaagtgttgcatcaataaaattagcaaagttgtttctcctactcacttatagaacctgactggggaagagaaagagacagtcatccttcatttagaaccaaccctttatgctttccacataatttttaaatcaaatgagtcacagaaggtatgacttctgcacttgtctgcttttcatgaggaggggtttttcttaatgtagctgccttgactccccagtccttttttcctccttactaaggtggggaaagttatcatgctggtgtgtaacaagttatcatgctggttttgttttgtctttactttcctgtttgttttgactgggtgagctaatcttttgaaagcgctaagcaagggaagatttggttcattcctcctttcctctgcttcccgacaagggcgagaacgtgatccaggaggcagtatctgtgctgcagattccagcttgccctggaataggctgttcatgggtctaatcgacatgtccagctttcacgcaggagccccattctccatgatcagcatcataggattaaaagggaaacttctctctgctgactgttaagtcccactttactgtgttttacacaaacagggaatagggctgttatcactggctgccccaaaccacccactgggagattttcacacttggaaaatatcttggtaatattatttcaatgagctccagctatttttccttcgctcagccacacctagtcagcacttacatgtagttagcccttgtaatagaggagagagaagacttccaaggagacagaccactggaggaactttcagtgaaagagacttgcttcaacaccagtgttcactattgttggtggtgggtgtgtctgtccactggtaaggatgacgtgattcagtggaatatgagcacatgtgtaaaagcaccctgataaaggatgtgtcctaaggttttctttgtattttactttccgcttttaaaaaaatgtttatttatttaactattttttgcaggccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaaggtacctttcccatgttggtctatttctctgcttttcaaaaaagtaactgtatacatgtagtaggccttgcttctaaatcatacatgttaaaacaggtcagcagtttcaacttttaattgtagtgcgggcattgaattatattacacttcaactaagcaggtttgtcatttacgccccaaaatgacatagaagggacaaatgacaagaaaagatctcatgttagggattaaacacagacagtttacatgatttattcaaatagtcattaaagctagtctcctaaattatttttattgtaatacacatatacatttcataatattaaatcataaaagcagcagtaaggattatgatgaaaggaagtattaaaatgagcctggaagaaagcttggatttaacttgctgtgccctttgccatttatttcactctccgtacctcaggctcttcaccaaagaagtgaaagaggcaggcaaattgttgtgtcagctctttcctgcatataacacttttgtaatccatatcttgggttcagatgataaattcagtatgttacttacaggcaaaaaagaatagactgtatgctataatattaattctctcaaaaagtgcaaaaacattatattcaagtcatcttctctctgtaaattcagagattttgatcaatcaaggttttattggtattagttacatttataggaataagtaggcaaagatgataccatttaaatgtggaatgtagttattagtgctgtgactggctgatgtgaagtttgtctagtcctctgaatgtgattgacacagactattttctgtggatccaatcacactgaggctttctatctacaatgtagttgaccgtattgatcaaattaatggaatgatgactgcatttgtacttatttagtgcagtgtaagcttagctactgaaaggaattattctttttagactacaatttagtgaactagtgctctaggcacccattaatattccagtaaagttcacctcttaaaactttagtttccacaaggaacacctaagtaatggcctgttgtttaaattaatggaaaaaaaaaaggactcagacacaaattctcctcccaagtaaatgttaacacagttgatttaggcaaacccctgtttggaataacactgcatttccaagccttctccataatgcatattattatttaaggtaggaagaatagaaaaccgaagttgagaattttattttctttgacttgacaaaagcaaaacttatatagatatgcattaacgtcaacatctgccaaacagtgatatattcctttgacattaaattattcacaaagaaattcaaggaagaagagtttgaaagatttatgttatgtatatttttagtcatcatttgatgtttctatataatttggctacatcgtgcaacaggggtatttttctgtaaccccctcctcccctccctggcacacacacacccacgaaccagacatatctaattgttagattctcctccaagttgctgactattagaaacacttccagatggctggaacatagctacggtagctgaatattttaacaatctggccacagttttcttgactataaaaccaaacctttcaaaagaattgcaagggttgcaaaaaacgaaatcaaagatgtaacattaattatgcaatttaaaatgttgactataggactccaaaggaatatagatttcctgaacaaattgttctcactactcataaaacagctattagcactattgagatgtaaatgatgtttttatgaagaacttttaatcctctctctttagtaagaaactattaaatgtaccttcagttgtatgtttttgaagtttctctttacctatacacatgaaaaacaaattgagcttaagaagtctttacttttttttctaaagtgtggaggtaataaataaaaactttgttaatcatctggatggatgagctcgtgtttattcaattttttctgccttcctgcaccctctccttttccttttttgtctcttttttagaagcccacattaaataataaggatttgccatgtgagaaaatagcaatgctattgtatattttgaaaatctactccattctgaaaacacccattgtgcttaagtaaaatcatggattcgattggattctttctgtatgtgcaatgtctttcctattaccaaacataatataatcaaatactatgagcttgtaatttaggttgcaacatcctaaatataaaatcagactgcacttcaaatcctataatatgtatgagcaaaagcagccaggatgtcttgactaggtacaactgtatattctaaatatctaagatatgattaattacacattcaataaaaagagatatattatagtgacatctaaaacagtctacatccagaaatcaaaatataatcacaatcacatttcaatagactatttaaaaataagctcccaccaataatttttatgttgtcaacttttgaattatttaaagcctttgaattttagtaagtgaaataggaaagcatttatatgtaattatagagccatagtataatccaaaatgtttttgcattttcaaaggttgtcataaaatcaaatgcaactcagtcattaatatacttgagaaatccttgttttcaaataacaaacctatttctaaaatgttgcgattaaatccaatttttgttgaacctaacaagttttgatttattaaaatatagattttaataagaacctgtgaagaaacagttttactaaaaataaccagtgttgtatgttctataggtaccaagtttgttttattttgtttttttcctagtgataaacatctctatttagcttgcttaatatatagtcccaatgttcagacatttgcatctgtttccagcaacatgagaaatatttatcatcttatttttgtatttacaattatgagaaaatgcataaagtttcaacataagcaattttcatctgttaccatatgtcttaggataatagataaaagaatgggtttctatgaggatggtatttttcctcagaatttttggttttaaggctcaagaagcagctgtttctgagcagaacaagcttgactcaagtccctcccaatattacatgattcaggaccagcttacttctataggagaaatggatgaaaagcattaaagtaaattttcaagcaattataaagaaagcttataaagaagggttaaggtaaagtatagtgaggaagcctagtgaatgctcagaacttcttgagtcagttgataaatattgggggagcttggatttggaagcataaattgggctggccttctttcctgtctttgatacaaattcataagataacactaaattagaaacaaaaaccacatgacttcagagtctaaatgctgctcatccatagttgctgtgtatttatctgtggaatggcgagaacaggaactggagcttcctttgctggtgggcctgggcaagttaggcaacttctccaaagctcagccctctgtctgtaagatgaaaggattggatgacgtgataatttggaacctctttcagtaatactaatattactaatagtcctaatagtaaatatcctaatggcaatagtaattattcaagaagatttacagaaatatcattattgcttgattttctttatttctgcatacgttgaaagcaatagttgtaattttctattataaatatgatatgccataatgttcatgttcatggaatatttttctctaacttacagatatttagttttatattggttgtattaaaataaccagaaaaaaagtaaggatatcattaaaaaaatgcaaaatagacaaaaataaaccttcacctcagaaaatgatcgcagtttataatttggactagtgtattttaaaccaagtgactaaacatttacaggtagtacagcttatgaatacagatatttaacttggaatttaacaattaagtccacaccctgtggagtaattacaaaggcacttatctcacttggacttgaacttgaacttgccaaggctagttgtgtacttttgtttcctctgatgaacttacagttctttcctttttacataatcctctttttcttcctttacttagaaaaattttaatgatattttttcattgtatacatacatatatctttgaagactttcgtttttagctaaaaatggaaatctaaaatatctttggggaaataaccaaactacacttgatgggagttgctacctgcaggttttgtgcaattttctctgaaatcaaattatccaaaccatcaacactttaatctaaaccttttagttacccctgacatagcaatattcatgaagttataaaacatagagttataaaaacatggaaatccagtaaaatgtgtcatctgtttctgacatactttgtagtattgttacactggagcattagggcatagaaagatacaggtaattttaaggtatattttgctgcattgttttgactgcagaaagctaaacactgcttttgggcttctctctctcccctcttacaaaaaaactctaggaaataatatttttcaagtagattatatgtataaatgctataagatcactaagaaatattcaaaataagcattaaatattttaattagttttatttttaaaattcttacaatataattcttgtgtatccacctttttagatgccatgctgcagcttgaaaataacctgtagtgagctctaaataaactcaccatctgcttattcttccctcattttttcctagtggggtagctacttgtatagctaaataaaatggttgtatataactattttcagtatgttgatgtatgatacatgctgagtccaaattaaacacaagcacacacacacacacacacacacacaccatacaacacaaaagcagctcccaccttgctttgcagagcaagtttaccaaaaagagctactatgaaaccctttgtggtgtctgccctctgctggtgcaaagtagaaatacaggccttaacatttttggactttttgacatagataacatctctcatgagctcttcactttacatccagagcctcctcgctggacaaagaagcctcagagtgctgtgtatagcaccggaagcaatggcatcttgttatgtgaggctgaaggagaacctcaacccacaatcaagtggagagtcaatggctccccagttgacagtaagtttaaaaaccaattgcaatgcaatgctgaaggccctggtttgacgggattaatgatggtcagacgtgtgtaaaatgaagttggtatgtggttggattagcaggacagatacaaccagcaaatcagagattgtttatttctaagcaatttggttgttaagacttgatattcatggaagagccataaataatatttatactgcctgtgccctcttataaattatatataagaataaagatttttaatttttaaaaagaaaattgaatgagaaagaggatgcatccaaggaaaaaagccaattattgttcctgtccctgagaagaaacagaacagtagcctagcagctgagggcacaggttcaaagtcaggacctcctttaggctcaggcaacagcaacacctgtcctgggctctgcccttttaagggacttgctctgatcaccctctggtcccgcttgtctccatgatttgaaagcatcctcagggaaaaggaggcatcccaagtctgaacatggtcccattactgcctatttgctaccaacctcaagcacaaagacctgaaaatccccatgcccggtccaccctgagcccactccaaatgggctgggcggggaaagacaggaatggcccagcactgagggccaactctccccatttcaccatgctcagcatagagctccaaggagtccccaaatcttccactggaacctagagctcagattattttggatgtccttgttcaggaagaaggatagaacatatttttacgtgtcaattgcttaattaagagcaggtacgatagtggcttccatttgtccttttgctctggggcctgcacaagtcaagggtgagccacttggtggataacagacctcgggtcccgtctaggatgtgcaccttgccagctgtttcatcttgaggtgttttctgaatctccccaagcttacgttttttaaactgcaaaatggagatagtggcggttggttgtgcttgaatgaaaaaaaatgtggccagctgcctagggcagtgattcatctgtagagcactgtgatggtttataaactctggagccagactgcctgggtttgcatactgactctaccacttactagctgcgtgacggggagtatcactgaccctcttcaaacccatttcttcatcagtaaattgggataaaaataacactgactcacggggttgttttgtggattaaaggaaacatcatgcagagaatgcttagcacggggactgccacaaaaacagccccccgtaaggtatggttggttggtattgttttcccataacagacactcaggaaaccttagtcctcattattaactatcttcagatttgggatttttctcttcatctctttagggaacagaataaaaaatgaaaaataataatgaggttttgggtagacgaagggaaatgaaagcaacttttgtttataatgaatgttcaggttacaaaagtaaggaacgcagattctccggaacacaaaatcataaaatattatatttggatggtatttggctgtttacaaaagacattcacaaattacttagaatcctcaaaagaactttataaaggaggtgctattattcatatttaactgattcgttcattcaataatatttatggggtactttctatgttcccggcactggacttcatgcttgagatatacaacagtgaataaaatggatggaatccttgctctcctgccattagacaaataacacatgagtgtgtgctatggtgtgataaagcagaaaatagctgggtaagggcagtgcctgaaagaggttcaggacccagagttgcaatcttaagatcataatagtaagacccctgtggtaatttacctttgagtggagatgggaaggaagtgaggaagtcagccacctaaatagcagggaaagtgctgtctcagtggagaggtgtgttgaggaggagaaaagaggtgagtgtgactgaagctgagggagtgcaaggggcagccctaggccaccagatccgccagcaggggaaggggccagagctcaggtaaagatgaacatcgaagtagggccttgggattttgagaatacactaggcagctcttggagaattttaagcagaagagtgacacaatctaatttacatttttacaaggtattttcctggcctttgaatggagaatggactgtgtgattgatactaggtaggaggccatctgagaggctctgcgctcagggctagattggtggcagtcatggttggcttctggatttattttgaaattgagccaataggtttgttaatggatgaggaggtcaaggctgaaaataaacttatgcgagaccacacagctgaataatggtagacttcaaaccaaagccaggtggctggaatccaagctcggtgttctgttcacagcttttggccctggctctacttgttgccctgcaaacaggtcgtaaacttttataggctgggatatttgatgacagagtgttggctagaggatttgaaacctctttaagcttattttagttttagaggttatatatcctttccccatgttatttcaaaattaaatcaaaatgattgctattattgattatcggactaacccttttcacatgctttgcatatgatatttctgaacctcgtagcagcttgaaaaatagattctattattctccattggcaactgagactcagagaggttacattacttactggagaatgcaacccaggtacatttaaaaccaggaactaaacccaggaaggattaactccagagctgaagtttcgtccattttattgcatgatttctcacagggttgaccaaagacaaaactgagaaagaatttctgaagtatgtcaggactagtgtgttttataaagacttggccttcttgaatcctgggagcttctgttagcctttgtcaatacacaacaatttccatacccatgccaacaggcagatttaagcaatgtttaattacttaaataaagtatcatttatatagtctaatttcttacttttgtaatgcagtgttaattcagagccatgcatggatcagacgggataaggagaactaaatgggaggatggcgttaactctgaaagtcttaggaccctgagtggggtgtggaagtgaagagtgggattagagactcagtgctttgcagcattcctaaagagtttagcctttaaaaacttggaagagctactcatcttgctaatttgcaagaaataagtgataaattgttcaacaggattgtattagttttctaacattgctgtaacaaattaaattaccataaacttagtgtcttaaaatagtgcatgtacactattttacatttctgtaaaagtccaacacgagtcttggctaaaatcaaaatgtcagcagtgccatgtcctggaagtgcttggagagcattccttcgtttgccttttccagcttttccaggctgcccacattcctggctcccttccgccattttgaaagccagctacactgcatctctctgaccatccttccatggtcacatttccctctgaccatagccaaggagggccttctgattttcaggagctttgtgattacattgagcccacttgggtcatccagatgtaggaaataattttcctacctcaatgtccttaatcttaatcacatctgcaagtcccttttttccatgtaaagtaacaaagtcatacattctgggacttagaacgtgtacatctttcaggggctattgttttgcctacttacaggggcctttcaggaataaaggttacccaacctaacattttaagtcattccaataagtatttactggctggattttctctggtagctgctctttgggcagtggggacacactgcacaacctcacactcaggtcctgcccttagagagctcacagtcaagtgaaaaaaatcttcatttgtgactcctaggcagaaaaagatgtgtaagtcttttatttcaatatgtagtattcatgttttctagaacctaaagcttagtatagtcattatctcgtataatggagagacaatcagaaaagtagaattcgattgattattaatcttgtaatgtcctttaaactaaaaatttttgcatttgtgcccttcccttgacatttccagctaacatgttttccttcccactggatttatatatataaaatatatgttatatatatatatattatatacggatattatatataatataataatatatatttatatctatatatatactatagatatagataaagatatacacatacatagtatcatagcaagggcagggcttttagagtcagaaaagtggccaaatgttgtgggatgtgtcatccaacttctctgtaatccagtcccctcacctttaaaatggccatgtaaatgctgatccatcgagttctgagcagtgtcagtgagatcatgcatgtgccacatccagtagagtttttggtccttaaatgcatcagaaatgttaggtattcttttttttcttccttttctttttcttcacttttattttaaagtctctctccatcacccagtctggagtgcagtggcgagatcttggctcactgtaacctccacctcctgggttcaagtgattctcctgcctagcctcccaactagctggggttacaggagtgcaccaccacacctggctgatttttgtatttttagtggagacagggttttgccgtgttggctaggctggtcttgaactcctgacttcaagtgatccatctgcctcagcctcccaaagtgctgggattacaggtatgagccaccatgcccagcctcatgttaggtattctcatttccaaaagatattcccagaattatacttggatcaggagtggggaaggttttattgccccaaagtagaaaatctggccctttttctcaagaagagtttagtcttcctgggaaaatgaaatatacaagcaatgtacatgaagtggttaaatagtgaagcaaggcaaatgaaatcaatggtgcagatcagaaaactgtagagaggcagagaactgaaacgggaacaaaagcgtcaagggggaaaatagcagccagtactggtagctagggagatcgtgatgtgttgaccatgtgacttgtgccaggcagcatcagtgtctaaattcagaagagtaacagagtgtcacttcatcataggtcttgaatgcctaaaggataatccagaatagtgccatgagtataggtatggaaattctgggaggtccagatgagcagatattttgttgctaaatattaacttgaaagataattgaaaattcacatggatctggaaagaaaagtccatagttgatgttcagaaaacctaaagaattggcttcaatgaactattagtcaccctaaactggtttgaaaatataaatactgtgtgacacatttaataaatggtgtataaatattttatgtcctgttccttatcaaactgacattctttaatctctttcagatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtgggtgagtgtgcctgggagctgacttaacatgctattttcctaaggaaagtggtcaaggtcatgttcagaagtgtattaactcttgacacataatatatggagggaaaaatcaaactacttttcaccatacatttgagttttagacttcacactgaaattgtactttcttttttttttttattatactttaagttttagggtacatgtgcacaatgtgcaggttagttacatatgtatacatgtgccatgctggtgcgctgcacccactaactcgtcatctagcattaggtatatctcccgatgctatcccgccccccctccccccaccccacaacagtccccagagtgtgatgttccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcatagatggacatttgggttggttccaagtctttgctattgtgaataatgccgcaaaaaacatacgtgtgcaggtgtctttatagcagcatgatttatctttgacaaacctgagaaaaacaagcaatggggaaaggaatccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccagaagcaatggcaacaaaagacaaaattgacaaatgggatctaattaaaccaaagagcttctgcacagcaaaggaaactaccatcagagtgaacaggcaacctacaaaatgggagaaaatttttgcaacctactcatctgacaaagggctaatatccagaatctacaatgaactcaaacaaatttacaagaaattgtactttcaaaaatgtattgaattgggatacttctataattcaaaacagacaccataatattctgctgttttctgtttgtattcgtatgactaggacatagaaaaatttaatttgcatatctttcttccacaaaagtttaaaactgcgtttatgttattttcaaatagatgtccgtccattgatacaaaccaaagatggagaaaattacgctacagtggttgggtacagtgctttcttacattgcgagttctttgcttcacctgaggcagtcgtgtcctggtaagccggtggctcatggttttcttaagagaatgtcaattgtagatttgaccttgtttcttcatccgtcatttgacaggctgtattgtgtctatattgttacatgtacccagtacctctgagacataaggtaacaaacttaccggtccaggaaattagctctactgaaagcattggctagatttctaggattttctcacatagagacatacagagagccacttgtgttcataaagaaaagcagagaattgaagagattacagagacaattttaaaggtagttttggtttttcattatgaggtaccacaaggtcatgttttactctattgttgttgttttgggattatctaaatgattatctaagctcgaatttaattccaaatgcatgtgcttaagacttttccagcattcattttgattttaatttcaatgaattaattggtatcataagtccaaagacattatcaatatggatctaccttattagttgctttactgaaaaagcttggttaaatagttcttgaataattttgtcattggtctgtagggcagtgtgagatgagtgaccccaggtcataaatttatagggtcagatattgcctttattttaaatcatgatacgtattttgttcatcgtgggttttttgcattattgtgatttttcaaaatactagattgaaatattatttaccttgcttactgagatgtttggcaccctgttaaattttgcatctggggcaagcctcccacttgcctcagcctagtccctgtcctgtatgatcctacatggaccgcatccacagcttatccttaaaaaaaaaaaagaaactcaagcagtcgcttattgtcaaatgtacagggtaaatcaagctgtagcagcaagggcttggaaatggctgaatgttggaggaaatggctctggggttgatagggtaaatgtaatccatgtccacaggacaggcaagactccccagcttataatatttctgaatgaccaatgttctcccaggacagcaggaggtttgaaaggttcattatctctttcaattactagctttcccatttagtaccctggagcaatcattaactaaagagttcaccatcaataagccagaaaatatttattaagctctgaggacacatgcaaaccggtgctggtggctatgacaaatacagcagaagcactgagcatggacttggattttctatagccacagtctatttgggtagataagatatacaatcttggtccattttgagaaaaatatgaaacccactggaacatttcatgaggttttctgagctattgaaaggggattagcctgaatgacgtcactgactagtattaaaaagcgtatacaattttgccctacctcagatggatgtacgctttctttgtccataggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaagtatttttatttcactgttactttgcatgaattgtcacatgggttcagtctgtcttcatttgcccaaatggaataataccatttaagttggagtaccagataaagttctttgaaccgtttttcaaaattcctagaatgggtttcatctaaaagattattgcaagaactacagggtatgcccatgatatgtgcacagcttcatcctattttaagaggcagccaggtgtctgtagtgacagatggctgtcaatatttaaaaattacctattaaccatactacaccatatttctgtaactatattttatttccaaagctaactcaaggtaatggtaacagtaatcaagtttttgagctaaagatttcacaaactcataactttataatgactgaggcatgacagaatgaggagggtttttgatcctctttttgagtcataaacagctttgtattattccttctcacttcagggcacagtcctgggagctgttaatagtttcttgggcttcactgatattttgattttaatattgctcagagaatcttcaagaaaacacaaaatggaaaggatcttcggtattaataaggagcatttttgtttcttctgtcgtgtccatatcccagcctgcttctcacttccacctagataagggagagcatatttgtttgatcatctgttttcactgatgccacttttcctcatacatatctgctgttgtatccactgatgtcttgacatttctttctctcttcccatatatatccttccttccttcttttttcatcctgttttccttttcttttgctgtacatccttttcttattttatagcatttgtctctttctgtgccctgagtaaatcagtgtgccagccccacagactatatttttaaagcactcaaatactctcccacaatatctacttatctctgatgtcttttacattttcaagtgtcatgtacacttttcaagatgccctcatgaagtcactgaagatggtgatgattgtttttatacttcaaaaagtaaacctatatcaaggttaagcaactcagctaggtgtaaggagcgtgaagcctcgaatccaaatggaactttgcactcctattgcccaatacagtgcttggcccaaaatggacctcaaaactgctagtggccagagagatggacaagtttagaaagtttcaatatgctgtagtgtctattttatatgttaaaaatatatacgaatcgtatcaatggaggattaaggacacttttttttttacatatacaaaaggcatgttgagaatggagttaagtgagagcctatatagtatagtgattgagagcatgagctttagtctcaggcagatttgggttcaaatcctggttcagcccattcccggttaggaaaccttgtcttatggctcaatttcattttagccttaaattattttctctgtaaggtgggagtattaatattcataaagttgttataattataaaatgccacaatgaatatgcattacttagcagagccctgatagagaagtgtttattaaattgtatctattattattaaatgaatttctggctttaaatttagaattagaagtaggatgtcaaataattcacttaaaattaattcaatttaatagtctcttcaagttttgtgcctggaataacaattaattttattaatactttccatttttagccagttccttgagaaaaatgtacatagccaatatcagagtataattatagaattggaggtcagcttgtgcagttggtctctgggaggtccccaaaatgccaaatgccacattaagagtatacttacttttaatagggcattaaagagtaaggattgcacgttttgaaacaatcataatgaaccaaacattttcttaaggcagccataaaccaatctttgagtttcataatgttgataactacaaatttatttttgtttcaaactatcactccctgtaattcattcaaaaggagacttaacactatgtattgaatgcctacggtgtacaggctcccttctaggctctggagacactgcagtgtcatgaaacagtcacaggccctacttccctgaggcttgctttctagttccccaccttcatgttaatagttcatccattcatgggcttaaacatttaccctcaggtttctgaattaataataaacaccctaacagaaaatcaaatatctttcccttttcctttacagtgctttgattatatatccagaagcacttgaaggagaaattatgttattttcaacttctagagacatttgtttgcttatactttgcttactcccttccccaagaaataatgagggaaattcctaaactattagttgatatttccacttaaattttgtcagatgtccaagcctggatggaaagaaaataataatgacatacaatgttaggaaattacagtgggacaaaccctgcatgaggattggacagttatggtgacaatttgggttacttaacttgcaggcacttaataacaaagtaagttacgcttagttctaactaatatctttgtttggtaaaaacagatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggtaggtaaactattatgatatgtcataatatttgcttggggtaaacaacttgcatttgatttaaaaagttctaggtcgggcatgctgactcacgcttgtaatcccagcactttgggagaccgaggcgagtggatcacttgaggtcaggagttcgagactagcctgaccaacacggtgaaaccccgtctccactaaaaatacaaaaattagccgggcatgatggcacgtgcctgtgatcccagctactcgagaggctggtgcacaagaatcacttgaactcaggaggcggaggttgtggtgagctgagatcacaccactgtactccagcctgggggacagagagagactctgtctcaaaaaaaaaaaaaaagttcttaaagcattcatacagaaacaaaaacaaaaactgagtaatatttctgtcttcaagtcacttcactctgctatcatatgtttatcatcctgtttttgctactgacttttcatgtaacatgtaccattctattagtgtgtgaaatggaaaccactctaagtaaccgaggaagaattgcatgggcttggatggttgcaaaaaaaaaaaaaaaaaactggaggagctaggcctagaagaggctgcatactagtcttctaggttcttgatcacaaagcactgcagctgcaatccaggtgtctggaaactgctgccatcttcatggccacctcaccccattggtactactcgtgagtcctgccactgccacctctcatgtctgccagaaccactgtctgctcccactggcccagagaagatggcatccattttccttctacttttcaatctcacatgagtttatttaactcactagcaaaacctaaatcatatctgggattcttcctgccagagagtactgagaagtacacctttgagtcttccaaactctgtatagagaatatagacaaaatataaaagagaacatatagaggaaagtgtgaatggatgcttaatagcactagatgatattaagtacatcaaagaaataaaaagtcagcatttgctgaatgtctactctcttttgaaaatatgagaaagtcagcttcgcgtccttttgcattgttactaagtaagggttaaaacttaaccatcttggagccaaatctcccctctcattaattttgtaatttattaccctgtaaaactacaaatctgaaaatgtttagataggacatgtgctgcttgcatgagacagcaacactgccatgggtaagatcatgaactctgaagctcaatggctcagattcaaatctcagctcagtcacttattagatctttgaacttagacaagctgcttaacatctttgtgctttagttttaaatcccataacatagtttgaattaaaagtattaaaaaggtactttcattatagggttaacaataccaagtacttagaaaacattaacatacagagcacttagaaaataccaactgcacagtccatttttgcttttgtgatttgtactgctaatttcttcatttttttccttatgacaaatttctttttttaatttttgtttttctttacatcttcattaaaaaatgggatacatgaacagaacatgcagatttgttacataggtatacatgtgccatgatggtttgctgcacctattgacctgtcctctaagttccctccccttgccctccacaccccaaaagtccctggtatgtgtgattcacctctctgtgtccatatgttctcattgttcttctcccacatgtttgctgatgatgatggcttccagcttcatccatgtccctgaaaaggacatgatctcattcctttttatggctgtatagtattccatggtgtatctgtaccacattttctttatccagcctaccactgatgggccttggtatcggtttcatgtctttactattgtaaatagtgctgcaataaacatatatgtgtatgtgtctttatagtagaatgatatatattctgttgggtatataccaagtaatgtgattgctgggtcaaatggtatttctggttctagatccttgaggaatcaccacactgtcttccacaacggttgaactaatttacattcccaccaacagtgtaaaagtgttcctttttctctgcagcctcaccagcatctgttgtttcttgactttttaataattgccattctgactggcatgagatggtatctcattgtggttttcatttgcatctctctgatgatcggtcatgttgagctttttttcatatgtttgttggccatgtaaatgtcttcttttgagaagtgtctgttcatatcctttgcccatgtttgatggggttgtttgtttcttataaatatgtttaagttccttttaaattaagaatattagacctttgtcagatgggtagttgtaaaaattttctgtcattctgtaggttgcctgttcgctctgatgatagtttcttttgctgtgcagaagtgctttagtttgattagatcccatttgtaaattctggcttttgtttcaattgcttttgccattttcatcatgaagtctttgcccatgcctatgtactgaatggtactgcctaggttttcttctagggtttttaatggttttgggttttatatttaagtctttaattcatcttgaattaatttttgtttaatgtgtaaggaaggggtttactttcagttgtttgcacatggctagccagttttcccagcaccatttgttgaataggagatcctttccccagcgcttcgatttgtcagttttgtcaaagatcagatgattatagatgtgtggtgttatttttgaggtctctgttctgctccatttgtctatatgtctgttttcataccagtaccatgctgttttggttactgtcgccttgtagtgtagtttgaagtcaggtagcgtgatgcctccagctttgttctttttgcttaggattgttttgtctatatggggtcttctttgattccatatgaaatttaaagtagttttttttctaattctgtgtagaatgtcaatggtagtttgatgggaatagcattgaatctataaattactttgggcagtgtggccattttcgtgatatttattctttgtatccatgaggatgggatttttttttttcatttgtttatgtccttttttatttccttgagcagtggtttgtagttctccttgaagaggtcctttgcatcccttgttagctgtattcctaggtatttgattctctttgtagcaattgtgaatgggagttcatttatgatttggctctctgctggtctattgctggtgtaaaggaatgcttgtgatttttgcacattgattttgtatcctgagacattgctaaaattgcttatcagttcaaggagttttggggcttagacaacggggttttctaaatataaaatcatgtcatctgcaaacagacaatttgacttcctctcttcctatatgaataccctttatttttttcttttgcctgatggccctggccagaacttccaatactatgttgaataggagtggtgagagagggcatccttgtcttgtactagtttgccaagggaatgcttccagcttttgccaattcaatatgatattggctgtgggtttatcataaatagctcttattattttgagatgtgttccatcaataactagttaattgacagtttttaacatgaaggaatgatgaattttatcaaaggccttttctgcatctattgagataatcatgtggattttgtctttggttctgtttatgtgatgaattacatttattgatctgaatatgttgaatcagccttgaatcccagagatgaagctgacttgttcatggtggataagttttttgatgtgctgctggatttggtctgccagtattttattgaggatttttgcatcaatgttcatcagtgatgttggcctgaatgttcctttttttgtgtgtctcttcctggttttggtatcaggatgatgctggcttcacaaaattatttagggacgagtcccttcttttcaattgtgtggaatagttttagaaggaatggtatcagctcctctttgtacttctggtagaattcggctgtcaatccatctggtcctgggctttattggctggtagactattaattactgcctcaatttcagaatttgttattgctctattcagggattcaacttcttctggatttagtattgggagggtgtatgtgtccaagaatatgtccatttcttctagattttctagtttatttgcatagaggtgtttatagtattctttgatggtagtttgcatttctgtggggtcagtggtgatgtcccctttatcattttttattgtgtctatttgatacttctctcttttcttctttatcagtctagctagtcatctatctattttgttaattttttcaaaaaaaaaaaaccagctcctggattcatttatttttttggagggtttttcatatctctgtctccttcaattctgctctgattttagttgtttctcttgtcttctgctagctcttggattagtttgctcttgcctctctggttcttttaattgtgatgttagcatgtgaatttgagatctttctagctttctgatgtgggcatttagtgctataaatttccctcttaacactgctttagctgtgtcccacagactctgatacattgtgtctttgttctcattggtttcaaacttcttaatttctgccttaatttcattatttacctaggagtcattcaggagcaagtttatcaatttccatgtagttgtgtggttttgcgtgagtttcttaatcctgagttctaatttgattgcattgtggtctgagagacggtttgttataatttacggttttttgtatttgctgaggagtgttttacttcaaattatgtggtgggttttagaataagggtgatgtggtgctgagaagaatgtatattctgttgatttggggtggagagttctgtagatgtctattaggtctgcttggtccagagctgggttcaagttctgaatatctttgttaattttctgtctcattgatctgtctaatattgacagtgggttgttaaagtctcccactattattgtgtgggagtctcagtgtctttgtatgtgtctctaagaacttgttttatgaatctgggtgctcctgtattggatgcatatatatttagaatagttaactcttctggttgaattgttccctttaccactatgtaatgcccttctttgtcttttctgatctttgttggttttaagtttgttttgtcagagactaggattgcaatccctgctttgttttgctttccatttgcttggtaaattttcctccatccctttattttgaatctatgtgtgtctttgcatgtgagatgggtctcctgaatacagcacacagatgagtcttgtctccttatctgatttgccagtctgtgacttttaatttggctactcagtgcatttacatttaaggttagtattgttatgtgtgaatttgatcctgtcatcatgatgctgtttggtcattttgctcattagttggtgaagtttcttcatcatgtcattggtctttatattttggtgtgtttttgcatgactggttctggtttttcctttccatatttagtgctttttttcgggagatcttgcaaggcaggcctggtggtaatgaaatctctcagcatttgcttgtctggaaaggattttatttctccttcacttgtgaagcttagtttgacaggatatgaaattctgggctgaaaattcttttctttaagaatattgaatattggcctccactctcttctggcttgtagagtttcttctgagaggtccaccgttagtctgatgggtttccctttgtaggtgacctggcctttctctctggctgccctgagcattttttccttcatttcagccttagagaatctgatgattatgtgtcttagggttaatcttctcatggagtatcttagtggtgtactctgtatttccttaatttgcatgttggcctgtcttgctaggtttgggaagttctcctggataatatccggaagtgtgtttttcagcttgtttccattctacccatctccttcaggtactccaaccagttgcaggttcagtctttttatgaagtcccgtatttcttgaaggctttgttcattcctttgcattcttttttctctagtcttgtctgcacactgtatttcagcaaagtggtcttcaaaatctcatgtcctttcttccacttggtagctttggctactgatacttgtgtatgcttcatgaagttctcctgctgtgtttttcagctccatcaggtcatttatattcctctctgaaatggttattctagttagcagctcctgtgaccttttatcaaggttcttagcttccttgcattgggttagaacattctcctttaggtcagcatagttttttattacccatcctctgaagcctactcctgtcaattcatctgcctcatcctccatccagttctgcgcccttggtggagagacattgtgatcactgggaggagaggggtttttagcattttttttgttgattctttctcatcttcataaatttgtcttccttctatctttgaggctgctgacacttggatggggttttttgtgggagattttgttgttgatgctgttgttgttgctttcttttctttcttttttttttttctttcaatggtcaggtctaccttctgtagggctgctgcagtttgctgggggtccacttcagtccctattcatctggttcacgcctatgcctggagatgtcactcaaggaggctggagaacagccaagatgggtgcctgctccttcttgtgggatctcagacctcaaaggtcaccaacctgttggcagtaggatcactcctatatagggtgtctgacaagccctcttggagggtctcacccagttgggtggcacggggaataggacccatctaataaagcactttgtcccttggtggaggggatgtgcttcactagggggaaaccgacttgtctgggctgcctggattcctcagaactaccaggaggagacgctaagtctgctggtctgcagagaccatggccacccctccccctaggggctcaggcccagggagatctggattctgtccctgagcctctggctggagttattggagttcctgcagggaagccccacccaaggaggaatgatgggtcagggtcaggcctgaaaaggcactcagggtcaggcctgaagaggcattgattctgccacagtgggtgtgttgggctgtgggggacgtgtcttgggaccaagccatccagcctccctggctccagcaggggagaaagcacagcctggagctacagatatgaatgttgcctctcccccacccagggagcttagcgtgttaggcagttgtgattcccagtgctggctgctgcccctcttctaaggagctcaaatggcttaggaagcaggcagctgcagctgtggggctggccgcccctccaccaggagctcggtaggcttaagcagattccagctgaaaggctgttgagaatctgtggggcttcggggttgtgatgctagacccagtggctggagtttgtgagtggggtcttccaatccatgggtttcacagttctgtggaaaaagctgggtagcacattcactcaccgcctcccttggctggggggaagggtctcccctgccccgtgcggctctcaggtggaccactgcaccacactgttcttccctcctctccgcggatcatgccagcctcctagtcagttcttctaagagaaacctggataccttggttgccagggaaggattcacacacttactatagttcttttccatgggagcctccgaacacagctgtttctagttcgctatcttggtcctgctccctgcctccgcctcccccagcccccaccgccccactgccttcatttcttcatctgcttgtctcatttctgttgcttgcttggtctatgttggtatttatgtgtgagccgcctctatgcaaaggcattggtctcagccttggttcttgatttattctctcccctccttccgatatatacaaaggtttgcagaaaggcagtgtatgtattacaaccagttctcattgaaacacgagattaattatatacctctaaaggctacgctttgcaatacagatctccagcctcaggttaggtctccgctgatctgccaactgctcagatatgcctaaattctgcctcttttgttactactgcctgactatccggggtcttccatgtgacctctgggctacagccaagaagggaatcagagacccatggctggtgggtaatatgacatggacatttaggctttgaccccagaagccctaagcaaccttttcatgtgacccagttttacagttcctgcaggatcccagagctgacactgaaatgaacctctggctatctgagtggactgagcaagtgacacagatgttctgccaatttccctaaacaagtaacagggataaaggacaataaccttagctcagaagaggccccaggagcaaggaagcctgggagtaactgctgctggctggccttgactgctgccaagggcatgcacggtgatatagcagggagtagaagtcacaggtatctgctaattttctacaaagccatatcagtaacctcatacttcttaccttctgctgagacaccttctccttattactatgcagaagaccggaagctttaacctaaagggaggttaaacttctaatcaaatatacatggtgaacaatgagaagtgaaaattccttcttctcttctcgcttgtcccctttcttgtgtagggatgcagtaagtgctgggaactgccactctgaaccattagacctacggggcttcatgttatgttagtacttcccatacatgctttctctctttaggcctcccaataatactattaggtagattgaaatgcccccccaggaattttctgtggatttcctacctgcaggtggccatagaccatacaggctatagaccatacactatggttatgaaaaatgaaatggagcatggctatgaaaccatttttagaatttatatcgtgcttaacaaaggtaatggggactgttcatgactgtaggcaaagggagggacctagtcctgtgggagagaccactgtagcatgaaaagtgggatatactgataactaggagggcgtgggaggaaagggcattgagaatccagtgggagggtttttccttggcaccaaataggagctgcttttttccccctccagaaatagtggcaaattaatgagggaaggggagaagttgaagatgcaaagatgaagatgcagtcatagtgaaaggtctctttctaacaaattaggaaataaggtaatttgttcaagcagagaggcaggagaaatgggagttggggacattaaaacaccaaccatgagaaatgtgattagcaataagccaaaaatgaatgaaatcaacttgattaatattattagtaacactctctgagcacatactctgccaggctgtatgcactaatcactttatgtgctttacctcatttaattctcctaaagagaaagaaaatattgttatccccatttttcagataagatgaattaggctcaatgttttgttcaaggttgtacaaataataattgatggaactgagccgcaaacacaggtctccaaagagagaatcgttttgtcatagtgccttcagggaaacacggatattactcagctgaacagggtaagacaacaatggctgctgacatggattagggactagcagactggataccgcagatgaaggagtcgagtggttttagtggatagatttctcaggcaaggtaattaagcagatgaaggcaaacagaggaaaagattggggcacgaagatgtgaagaggtttttagcttcttctaagagttcaagtgttatgagagtagaaatgatacaactttttaaagcagaatcccagctgacctatgatgggaacataatgtgagggaggaataagtgactgttttcttgggcatggggaatttggagctgtctgttactgcagcacaccatagtgtgaccccgtgtgtgattttctgtgtgaccctatgtgtgacaactatttgtgattttgacatgtgacagaattatccaggcttcatgttcaaatgcaatggcccttgccccatctccaaatgtactgatttggaacctggactgaggctggaacacgacatttttaataagttctttaggtataccatacctaccacatttcgaggactagtgaggcacccaacgttgattaattggaggcacctaagatacatttgtgagactggaaacaaggcatagtgcaaccatgacttgccaaaaaaattggtagctttcttctctggcctgaaacaccccgtgccagggtataaatcttggcaagatttcagctactatgggccctcgtgcagggcacagaagtcctatttcaagaggttattaaagtatattctttcatctaagaaggtacatttttcaaaaattgtcaggatatgcagtattctaatattgtatcaaatggacacctgagtaacatgacctgacatgttaattcatgtcaaagttttattatgtctagaattatggtgagattcttgattaacaattcaaggtaatattggttggcaaatctttctattattggtgtaggaataagggctgattctgtctataatcaaaataactatgtttcattacactgcaatttaaagtaggtttatataattcaaaattctcagcattttatatgaaatgtacataaaaatattaattatgtgagcctcctttcctcctcacaaggatgacactatttaagttatttcaacaaaatgctaattattatgaatacattttaaattttacggaacttgaaaaatactttaatagttatctcaacaatggtacggggtaaaaggtgaagtttataaagaagcagttttctcatagtaaacctgatcacaaattggtaaaaacaaatgataaaaagtgaggtgaaatgatttgcaaaaagaagtactacactgccatcttctgttcaaataagtcatatgcttcaattgctatctgatcttaatgtgcattgtacttgggagtggaggggcggagaaaagagaaacttgtgaaaaactgagattatccgactccttctcaggtattctggttctgtggaatggagatggaattcaggaatctgcctttgtaggaagcactccaatcgagcctatataggtgattccctaaacataccttaagaattactcaaatatatcttggccattgtgaggtatgatgcactctttaaacatgccaggcaacatacagttccatcactgacccatgcaaacagatggttagatttcataatttttaatgtgattttgtttatggctatgtagacagttgtgtatgctagaataattctttatctccaggtttcaactgtggcattctctaatcaaatttgcattgcataaagtcatctttcactcttagattgttttcgataaggaatatgcatttttaaaagaattgggtttctatcatttctattgttttccttctcatcatgtactcactttttttctgataggataattattgatggagctaatttgaccatatctaatgtaactttagaggaccaaggtatttactgctgttcagctcatactgctctagacagtgctgccgatataactcaagtaactgttcttggtaagtgcactaactaatgagaaatctgttcatttcttcatttctgattaaatcccatcgttcctggccaataaagctaatgattctttgagcccctgcacatatattgttagtttcaaatttttgtttaaaaagcaacacaacttcaaatcctttctccttttttcatataaaagaaattaattaatgcttaattttttttccctacatgtgttaatttgccaatagcagtgggaggtaagtgatgctatccgcagaaagaaaaataaagcacgcttgagttcctagcactcttgagctactctttcctggtgtacaaagaaatggggctgaggaatggaggtgggctagactggaggatctcgataggggtcaagaggtggatgcacggtggtcatctctaaaccaaaggcacagactgagttcccagggttccaggaaggatggagaggaacttccagcattctacaaaggaatgtctttgatttttgtcgttgttgttgttgatgaaagtactaatcaggaaacagtgtgcacacttcactagtataatcaatgcaattactcctgaaatcaccaatgtttaaagctcttagaccatctgctggatgttttccaaaatttcccttccagattcactctctaccagctctttgacctagaaaggttgcttttaaggacaacatcagcaaaccactttccttccagctattatttggttcagcaagtggagggccgtttggagtgttgtactgattctccctactccatccctgtggactggctgtgtcccactgccaaagtcatggcttctgcagacagggtctcctcacaccattccttctgatgaggctctagcagctgcatcccaccaccaatatttcaagtctctctcacacccaacctactgaacatcctgcccacatctttttaaagacgttttattaaaacattttggaactatcgtaaatttgtgtgagttattcattgattttctgcagggaccctaacagctacagacatttgttctgtttcggtggccaccatgtagtctttcttttagtttgcagacattccttaaaagtgttggttttgcctacccttctttatcatatgtctacattaatcactgttatcaacagacctttgtgtctttagcactccagctgttggggccacctgttaggttccaaacaagggaggtggtggtacagaccaagggagaaagttcagtctcttctgagagactgataaaaaaatgggtcaacaggctggatcccttcaagtaaagcaaatggccaacctgtctcgggcgaaacaaatggccatcaaggttgggttctaaaataaaagaacagtttccacttacagaaggtatggacttgtagagttgtcgagtcggctcagtagaattgtacctttaggcagaatgtttggccattgggtatttgagcattttcaggtctttacaagcagaaaggtttaatcccctaggatgatttcaacaataattcatcagataaagtagtcgagcttcagataaactggaattcatcccaggcctagtgagtagaggggtaagtgtcaggctccgtgcgctttgtccctaagtattttgagcagtctcagccaccaaaaggaccgggtctcctactgcttggtgctccccttctcaatttccttacaaaatttaaaagttcattcttgcgattaggctgccatttttggaactattaatttttttaattctacataaattttacctacgattatatgtactggttatatacgcagtaatctaccagtgtttacagaataaaaataaaaataaattttggagaatattatgtttaaaatttacattcttttattttttagacaaacttctgatttaccaaagcatctctcgacaattgacaataaaaaaataattatatagacacatacgaggtttctaaaagactatgttttaccccctggaaaacaattttttaaagtacatacttgaccccctttaatcaaaagttatttttaaaagccttgacataaacatgctttcaggatatcattttttaaaagtttcagttgcaagttcatcagttctagctccatacgattctcagaagagccagattttaatatcagatgcaatacacagccttagtttattccaggaagcttcagaaatcagtggactcagtaaatactgaagagaaaccaaagtcctctgagctcagagattctgaaacctgttgaagaattaactttttatttatggctttaatgtttggacacagtcatgaaccacattttttaaaaaacatgttctctcttctgaattggaaacgatgctttttgtcaatgtaaatttctaacaattagcaaatattcaggaggagcaatggacggtgctttccacttggagaagaaagagcccattgaaaggctacattagataatatcttccttttctcttctgctaaaagataaaagtcctccaatgcttgagagaattcaaacccaattttcagagtaaataccattagaaataagatttctttttactgttgctttattttcaaagtaccagaaattttcattttctttagtactcaaaaatttgtgatcatttacttacttaattttccagtttctgtcacaacatttaacaatgccaaatctccctgttctgatataaactgccttcctactctttttgagaactccaggttaagacggtatcaaagttgctataatgaaaattcattgttatcaataatgataaaaatccaacacagttgcagaaaagaaagcagagctcatgatctctttttctataaccataagacctaatgtttattgctttaatataataattatacacatgattgaagtaataatatctttttcactgatttatttagttataaaacatttatgtgtgaggcactgtgggcaatgcaaagcttaataaaatatgacccctattcttggagatgaatcaggcatataaacaaatatgtactggacaaacagaaatgattcatttgagatacatcatgtttcccagacttgggtatacctaatccccatccaaggaacttgtttgcaaatgcagattcctgggcccaccttcctcagtaagccagaaatagggcctaggaattttcattgttattaactactcctaaaagaattctgatgtccctggtcaaggataaccccttgagactgtaatcagagaagagggaggtaatatggtccattggggaggacatgtggagatgctgcattttacaaagaaccccagaccccagagcctgatgcgattgaacacagtggagacatgggcccagaaaagaagggtttttatggaaccaaactggggtccaccaacccagtgcagtaagaccaggtatctatactgaggtttgcagtgggagaaaggaagacacttatctgcagggcaccaaacaagaactggtcagctcatgcttaagtcccaacctccccagtggcttgcaggtgaaggtatttaaaagcaggagtaaatttcaggagagcaaatgctataggcaaaatagtaaattagtacattgaggttacacattgctttatgcctaaaagggtgaggtatcttgaactggagttggggcatggcttacaggtcataggtggattcaaagattttctgatttgcaattggttaaggaagagaagctttgtttaaaaattgggagtcagccaaaaagaatattagctctggctcatggatgtggctccctttaggccctcaggaagaaatttacaaaaaatgatggtcagaactcagacttcagtttccccttatctgaggtctccatgccagcaaagttatttggtgagagtctgggttccagaaaaacaacttagagacatatattaagatgttatcttcagtttctataggagaaccaaacatccctgtgattccagcttccttggctattgtttaaagctactattacctccgttcttatcaagttgtttatttacttcttagggctagctaggtgcctgaattacccttgaaactccacctttcccttccatatgtggggtggggggcgggggtgcttcccaggtccctaagagggtggtacctcctctgtctccgggtagctggcaatgtgtctgaggaagggaatcaggtaaacaaaggcaattatctacattttcccttcctttattaattagatgttccggatccaccagaaaaccttcacttgtctgaaagacagaacaggagtgttcggctgacctgggaagctggagctgaccacaacagcaatattagcggtaggaagacttgggataactgttttcattactctagatagtcaaaattaatagcgaagtcactttttaaccactcttactggtttattcttcttataacatccttttgaacttttaatattgagtataaattttggtataacttatccatactccatacattctaatattttttccctgtttatactaccagagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcaggtatgcaggttctcacatcaggtttctaacaaaatatttgtttgtccccatctttgaacatctaaaaaaaaaagattgatagagtaatgtaggattttagatttctccaaatagtgttaacagttctctaaacagcacacaaaatattcaaagcacacaagtttcagaagtgttacatacgagttcgataaaagcaggaaattaggggagtgacatatgaaaaaaaaacattactttcagtaattttgtgatggctaaatatcaagtttaaccagatatcatcaagtaagttctaaattaaaattcaatatgtatgcatctaacattattaatttttatgcattcagtgtcttttcttgtgtctcaacatcaatctaaatttccaagatgcgtttgaaaaaatctcaaggatgactgctaaaatttgtattactgaattgttattgatcatcaatgtggtcatagcatgatattttatttttccttggctaaaataaatactctaggacataatttcctttttggactgagaaaaagcaagtgaaggttataactggatcagatagaaattaacacttgtgtgattttagtgcatgtcaacctttgcactaaactccacatttagctatttctaataaaacgaatccatctaaaaatattcatgactactgtacaggttttattcattttgatgtccttaaaacttggctgctgatattaatacatggtgtttactttattcttctacaggcaaatattcacaacatatgtttctaatgacaattctaatagaaaaaatagagcaggcttaaattaaaatttttttttaaaaaagcaggttcagaattttaaaaagcagttttaaaaattttaaaagcagattcaaaattaagacacatatactaaaccatctactctccactggataataattatttcactccaagaagactgttttactcttttaaataaaatacatatttaaaatctaccttaaatctttttaggaactggaccagatataaattaataagtacaatcaaacttacttaattatctgtgtttttggggggcaggagttgtgatatgatgacttacctatgggttaaaaggaaaaataatgttaatgtttttaatttttcagctccagataggaatccacaaaacataagggttcaagcctctcaacccaaggaaatgattataaagtgggaggtgtgtatttcttaatacgttatgtatttctttgtgcttttctcttcctcttaggtctgcatgctaactacaatgatagcacaacatttttttaagaacaaagataagatttggaaatgaaattaacttgtgagtcatcatcacaaattttaaagatcattgtgattaaaatgatgttatgaaatcgagtttaacactggtcaacaatttagggaagattatacagattgatttagttgtaatacattaccgaagtttcaaattattaataatttaattaacaatattctagattctcttccattcaaaaaatactgaaaatctttaattaatttagtataatctactagatattatgcatatcaaactgatgaacccccataaagtattcactactcattaaacaccagtagacattttgtattctcctttctagtaattctgaggatggtcttgtgaagaaagcatcatgaacgccttattctagatctggagatggcatccaggattatgaatgtcttgcccatcaccacacaaccagaaatccgcaaagctaggatttatgtatgaggatctttggactccaaacctcactttttcctcctttacatatctcggttaaatgttattaaatagacttcaccatttgaattttgcataaaaatgcccatctacccagataattttaattattctagggtcatttccaaattttttctgtaacagtggggcattttattttctctctactacttggatgtatttaatgaccagtatattggcctacctaaaaggaaattatcattcaaccattctgatgagtaataggcctccaacattgaatttataaaattttgtgtaaacatagaacatttttaatgtatgctgaaatatactaatttatttccacaattcattccaggtataatttttgggagaattttagaatgcacaaagtttagtttgctttttatcctcatatgttggtctttgtactcattacacaatcacatggcccatacctgcaaaatatttagtcaatattttttagatcaaaattagatctttatttccacttcagtgaaattaagttttacaagtttaagatgtggaaaactttttttaaaatggtaatacatagaaatgaaatatattcaataatattatttctttccttgaatgtgtggttatagttactactacattgtcttgataattacttaatttatagtctaaaatgatgttagtcttttagggtgtatctgtattatcctcccttaagttccatagaaattttcataaagtagataatatagttggttagatatcagtaatactgtgtatttgccagtcagttcctcagagaagcacatcatgttccagtaacattagctcattaatcctcactactcctttgggagggctgtggtccatgatggtgtcagtcttatatgtcataaagagaaactgggaatctcagagtttaatgacctcacccagatgccatgggctgagtcatatggaaaaaaggccagaaatcttcagtctttttgactgctcctctcactcataagtcattttttattaccccaaagatacacaagattgattattaatgctctcttcttgtaagaatgggactgtactaagaaagcatctatggccaggtgctgtggctcatgcctgtaatcccagcactttgggaggccaaggcgggcagatcacaagatcaggagtttgagaccagcctggacaatatggtgaaactgcatctctactaaaaatataaaaattagccaggtgtggtggcacatacctgtaatccctgctacttgggaggctgaggcagaaaaatatcttgaacccgggaggtggaggttacagtgagttgagatcatgccactacgctccagcctgggtgacagagcgagactctgtctcaaaaaaaaaaaaaaaaaagcatttaaaattggtctttgaggagcaaacgacatgtcatttagtaattaattgactagaggaaggaagtagtcacaggatttggatctaggctgacagttacattcccaatatgtcccatggtgtctcctattatcttgatgtgtcagagatctaatcactactgacacagccagtgaagtttaagaacattcattcactgagtatggttctgtatggatcatcctgcggaaaggagttagactccaggtttttcccagtttcacaatcagatagtattgtgaatgaattaccagaccccctccagagatgtactagaaataattcctatctacatgataatggtcagagggacataatttgaaaaaaaaaaaaaaaaagctgatctttcccaaaagaattaacaatgaagatgagcagtaggaacagactggacatccctaatttttgtttatttgtttatgttttacatttaacattaaacatgattcaatttaaagtaacattacaatttaacttaatggtagaactaggctttttagttagcattaccttcagacattcacttctcatatattaagtcggtcatgactcactcatatattttgagtgttcgaacatcataatgttctacttgcaaaacaggacaaaagagtctactgcaaccttatcagttaaatacctgtatcaggataatttttgcttgagagtttccattgttcttaagcatatgtatgtgaatttttaactttgctcagcaaaataacacatttcaaacttaaaggacaccaaaagcaaaaccaaaagcccaaaaccccactaatgttgggaagcaggaacatctttaattacctggttatataatcgcatccaagatagttaactcctaatggatctaggttttattatttataatacaagtataataagaagacctactggctttaaaatgaaaataagtggaattaaatgaaatattgtataacataatgactatagtagataacaatgtattgtattcttgaaaattgttgagagactaggttttaagtgttctcatcataaaaaataagtatatgaagtaacatatattttgagtagctcaatttagccactccacaatgtatacatatttcaaaacatgttgtacataataagtagatacaatttttgtttctcaagaataaataaaaatgttcaacaattttttaaaaaatggaatcaaggcaggacggcagtctttctgttttctagattaatagttataaccttgcttgggtcatagatctctttgaaactatgttggacgtgcaagctctttttctagaaaattacacacaaaaagtcatactaacaatatcattggtttctcagatcctctaaaggatacacatgtaccccatctagagattcctacaccccacgttaagaacctcttttctaaagactccttcctcgtgggctccttcacgagaggcagagggaagggaaggctggtggcctcttcctgcttactctgccctggctccttttgttctttcttgaagagattatttgggaaatgtctgaggctcagtaggcattgccttcaagtcaaatacaaagcattcaggctgtttatttgggttcccaggtactaaaaaggccgctaatatagctaaaatatttttgtttaaagtgttatggtttattatttatttatttaaaatttgtcagagaactttattaaatttaactcctttctttggagcaaaatgtgtaaaatgaataatattatttgcacacacttattgtcagcagagactgaagaaaactatcattccagattgcagtacggcactacaagcccatggcctaattcactgggacaatgctaaagcccctggtgaatttatatccatttcacactctaaaatatcttggagcaaaactttccaatgaatccaagtattaacaaggtctgcagaaaatctcagaaagttttcattttgttttgattttttttttccctcagttagtttagtttattcaccttggaataggaatacacttaaaattattttgctgatatgtcactaccctttcaacttaattccaagcaatgcctctaataagtgttttagtaaattagattaagttgagaaggattacagattctgtaagaacactatgtatgacattgttgactcactcacatatccagagaaaattactgtttatataagtgaaccttaaatttaggattaaaatcgtattttaaacttattttatataactgattcatttcaatgcacaatcccattatctttgaaagctaaacaggcagtttaaaccacattattgtttttaaattaaagtgttgctcaattaaaaactaaagtggaaataaacaatttcccatactagaaattattcctccaggctgggtgctgtggcccatgcctataatcccagcactctgggaggccgaggcaggcggatcacctgaggttgggagttcaagaccagcctgaccaacatggagaaaccctgtctctactaaaaatacaaaattagccgggcgtggtggtgcatgcctgtaatcccagctactcaggaggctgaggaaagagaatcgcttgcacccgggagatggaggttgccgtgagccgagatcacaccactgcaatccagcctgggcagcaagagtgaaactccgtctcaagaaaaaaaaaaaaaaaaagaaacgaaaaaaaaagttattcctccaaatatttctatggagaaaaataaagtgggtaagggtgacattttttcttaaagaaaaataaagaatggtcaaggagctgggaaattataagaaagaggagctactgtttttttgtattaaaatatgaacattcatattctccaaaaatatttacatgatctctctcttcttatagaagaaaaatggagaaggatagaaccaggtgcaagaaagagttctcttcaaaaagccatgggagaatcccattcacaaccaaagaattcgtggccatattattttttatttcagcctgttctttgaaaatgaaaaggcggaatgtagtggaaagcataagcaaaaagctaaaacactttgtggaatttctttgtaacttccttcgtgtgtaaaaacttaagactttaccatgaggacataatccaggcatctgattgtaggcttctcgttacttggggagttaagggattaattttcatacttaagctcatatgatgacaaaactttttcacaactgtctctaaaccaagaagggggatttaagatctctcaacaaatgaccatttcattacattgttccttattccacttagggtggttcaccatcatctctgagtcaacacatctgtgatcagactaaatgagtcttgccttctgttttagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactgtaagtgatgcacctaaaactgctaagcacgtcagtaactgttgctttcaaatatattgtacttcaatcaacaaatatttgtgaacaactactgcatgcaaagaggatgtactagccgtgggagataaaaacaaatataacacatgacttctatcttaggattgattgtaggacagttgatcgtatagagtaccaaggaagtatgttgaaagttttcattttattcagtttcctataaagctctttctacattgaaaattgaagacctggaattatcactgcaatcatttaaagcagcataactgtcataagattttcaagtacatctgccctttgcccttacttgtcaaggatcccctaagagccacttgctctcatgccctgggcttcagtggcatgtctggagctttcctaatactgatgagatatatacccagatttatatgtagaattatatgcacacacaccttctgatgccatagtaactgctgcaaataggttattggaagaagaaaaaaacactgcattctgtattgctaatactgtgaataatattaggggttattctcattgcctttccagcatctaaaggaataatttgatccaaaaatagaaaaggttcagaatgagaaatagccaactcattactcacctgccgtctaaattcttctacccaaataaaagcacacaaaacacatatcacaagtgaattaagatagtattagccttgactgctctgtatttggcttattactctgtagtaagaactcctgtagaacagagataataatatcctcttcacagggttgtatgaaccaatttaggtaagtcccttagaacagtgcctgacacatagcatatgctcaaatgttagctgttattaatatttgattaacaaaattcctgaccaattttatttatattactagtttaattcacttgcttccaaaggcaagatgcccacagaatagtttctggttttatttatccacattgtatctatctggagggctttgtttctcagtgtgatacagtctgtcctcttctttgggaaatctatttgggctgataaacttatctatcatgagaaactcttttggttccatttggagtgaatttcacaaaagtgctttctccagaagaaacattatgaaaatttttgaaaaggatcctaacaatcacatttgcaggttattgaaaactaatcaatcttctatgattaacagatcctgatacagctccagtgatccatggggtggacgttataaacagtacattagttaaagttacctggtcaacagttccaaaggacagagtacatggacgtctgaaaggctatcaggtttttatcatcatggtttttcctcttcttgttgaattggtatctttcctgagaataaagaagaattgatttcagaagaagtcaaagagaatctgcgaccacaatggatatactaaaagattttggttttcattgcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggaggtgagaggataatgatgtagagtcatgtcaaaaatggaggtgatccatggccatattaaacattcttccttatggccaggcacagtggctcatgcctgtaaatcccagcactttgggaggccaaggcagatggatcacttgaagtcaggagttccaaaccagcttggccaacatgatgaaatcctgtctctatcaaaaatacaaaaattagccagatgtagtagtgcatgcctgtagtcccagctactcgggaggctgaggcaggagaatcacttgaacccgggaggcggaggttgcaatgagccaagattgggctactgcattccatctagcctgggccacgtgagactctgtctcaaaaaaataaataaataaacattattccttattagtagttaattaatatttacttcagatgagtttgcttgtcaatttctataaaatttataatataataaggcttttttgaatttttctaattgatgtgagtttatttttggtcttgtgttttctagtacctgaacagccaacttttctaaaggtcatcaaagttgataaagacactgccactttatcttggggactacctaagaaattaaatggaaacttaactggctatcttttgcaatatcagataagtaagtagaaatttgaattggagttaacttgttaatgtttcattttttggttgaatattctctgtgctatgttgggagtctaatgatcacttaaggccatggtttgtaagctgccgttcttccttgtagcccaggggtctgtaaactggcttgcaggccaaattcagcctgctgcctgtttttaggaataaagttttatgacgacatggccatgtccacttatttatatatgtctacagctactttctccctggagtggcaaagttgagtcatctcaatggagactacacagcctacaaaggctaaatgtttaccgtctggccctttaatgaaaggtttgcttacctgttttagaaaaaaagcagtgtgctgatgggtacacaaaacacgtgtttaatgtttatatataagatgtttggagaagtaggaaacatgtgaaagagttattgagtgatgtgatggagattcaaagcataggtaccttccacgctacctcttctgcctcagatatatgctcccagactcaatcctaaatatgcttgtgtttatccaatgtctatgggttgctcactgtttcatggagatgatattgcaaggactaaataattgtctttggatcatgactcagaatgggctctgcccagatgctgctgtgcgactagagtaacgtgaatgtgtttagatgagatcaggtcgtttttaatagcagcgcgttccctctgaaacagtcgtcaagtttaagcatcatctcaaaatggaaattcggggattgacattatagaaaattttatcaacaacccatcatgaaaattttaggctttcaagacatcaattcccaaaacaccagaaatacagagacccagcacacactgcttactagtcaacttgatcatagtcctgttgtgctactttcacatcagctcaagacttccagcaatccaggtcacgtatttgctttagtttctgatggtttctgctgaaattagcacgtatgtttaaatacatacaggcataatcccaacggaagtagactttagcacttttacgtgcttgctaagtagcaggatcaatactaagtgtatctctttgcattgtgccattaaaataagaaatctattagaaatgtactatcactattttatgaatgagggaattgatgtacatcagagtcaagtagtaaaataagtgttaagtgggaggccgaggctggtggatcacgaggtcaggagatcgagaccatcctggctaacacggtgaaaccccgtctctattaaaaatacaaaaaattatccaggcgtggtggtgggcccctgtagtcccagctactcgggcggctgaggcaggagaatggcgtgaacccgggaggcagagcttgcggtgagctgagatggagccactgcactccagcctgggcgacagagccagactccgtctcaaaaaaaaaaaaaaagtgttaagaatgcaaagcaagatcagtccaattctagatgttgagctcttaaccttatattagtcgatgaactggttttcaaaaaaattgtaagaactgcagaaatattttaagattcttttaaatgtcaatttgtttggtaaagatataacttctccttatcctaacaataggaaactcaactaattaaattcccaccttcatattgatccgtatgtgacatttacgtttatttaaaaacaagttcttagaatatagaagttgaaatattaacaattgtaatgattattgaactgcttgatatgtgtattttaaaataaaataatatataattattttgctttctattaatattaattgatcaagacattttaggtagtttacctttttcttattgcttttagatattttaaattgttgcaatttatatgtatgagagctctatgtatactctcctgaattcttatattgattgtagtcgtttttcaattgactttgtggtcattcacaattatgtgttcaaaaaatctaaaaaagtgatgatttcacctccttctttccaatgtttgaatgcctagtttgtttgttttttcttttcattgatttgaattgcatttttatggaccaaggaaggcatttttatgtcaataataaatgcatttttttaacctctatggtatcttggactgggagtcaagaggatttattctacattccttcttgccactaacagctgcactatcttgggtgtatttcatctcttggactattgttacagtaatcttataatactccatactcttacacaaatctcatgtctttgctgggttccaaattctttgaaagaagctgtctatctgattcagctttttacagtgagcactttacatagtacttagtacacagtagatattcttaaatatttaatatattccttcatttattgattctatgtatactgagtagctatttggtgccacatgttaaactagaaaccatagaagacacaaataaattatcatctcaattattcttccaaaaggaaattataatacttaagtcaaagatacaatgaaaatatagcaatggggaaaattcattattattaatgcgtattatgaagctggagcagctggctccaatatagcacagggattaaagacgtttctctggggtcaaaaggccatggtttggattcaaatcccagtctgcaaatttagagacccaagatgggagcaaagggcttattcttgcgagacctcagttttgtcatatatgatatagtcatagtagttgtatgtacctcataggattaaatgagttgatggttatgaatcattaatgtatctttacgtaccacaagcataaggagaaatgaaaataatgaagaatgcaacttgaatggttaaatacatttgagctgttgttcatgtttatttttttagtaaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaagtacatgaggcttctctttttaatagaggctttaaaaagagactgcatctttttaaacagctgcactgaaaggaaagcaccgtgccagtcattgtaaattagaaatgattgtgatcccactctgtctgaccttctgttttccactgacatagaggcagaatttattaatctgtttggaaagttcacactgactcaatttatggatttctgcgcaataccaatcaaattatagcttagtgtatacaaggtcaggaactataattttacttaattaaagtagcaggacataaggtcacaaagctattcaaaaggttagtaaaggtacgtttttcttttagaaatgtttccatacagaaaaatatttggctcttccattggtagacattacagatctaatacatctcactttcatgccttcactctatatacattgattcatatgtcaattttgttttactgtctgatgatggatgccaagcaactgtctgggaaatggcttataaatgtatggtttcacttgtaacacaattatcctaattcaattacacttttctgtttttttctacctttaaccatttcctttcccaaattgcatctccagttatgattttagtgaggttcttgctaagctttctatgatagcaacaggacctttgcagagaaatcaggtcagaggaactgatgtacacacgaagtgaaacagagagagatttatgtagggcttaggctgttcaggcatggaaggatattggagaaagaaaagaaggatgtagaagatggcagaaagggaaatagagttgtttatttatcatgtattaagtgtggtgcaaaagtaattgtggcccttccattaaaagtagtaatggcaaaggccgcacttacttttgcaccaatctaatactatgtgtcagactgtgttctggatgcttttccaagttgtagattagaaaaacggtagaatcaatgaaagaaacatcacagaggggaaaaatagtagagaaaatgcagttgcctattatttattgaagatgtatattaaaatatattcaagcttgtgagtgactgtaaatcaccgtgtttgtgtgtgaatggttatgctctgacctttaatattggtttgtttttacatcttattgtgcctactatatctaactaataacaagcttacgtttttctcagattccttaaacatttaaaagccctttatgtgggaaaattgtataatccaaataattacttccctaaaactcacaaagtattcccagggatgaattgaacaccaagtgaaatgaagaactaatttcactgactttacctactcataaaagttagacttaaagatggggattggaaacttcccagtaactaaaaggttcttatgtctgaagcattggaactgacatcaagtgtccaatacaaagagaagtcagagtggtagtagtccaaacatgcaactgccatatttttaaaaacagaatttaaggcatggagttggttgctattttgatataaccaagaccataatgtgcatgtgaaatgctgatcccattcttaccaattggaagcacatgagaaaaaatattcacagaattgcctgacaagtgttacacattctagtatatatgttgcgaaatttgggcttggttgcattcgtgcttgagaaattgtttttggaggatgaaagtgctgttcatgtgattttacaggtgatgtggcatcttttctttaaactaaaaatgtaactaatgtgctgcatgtcttaaagaacatttcttcactgtcgtatgtgtcaggaatttaaaaatgtttcttactggtgtgtttgtgctctttttcaggaatccacattttcagtattccagctaactgcccccttcccgagttgacactgatttctattctataggcatgtcttgctataagtacagggaaaaaaattacaatctctttttctactagagttcaacatgatctttgaaaaaaatatatatttccaatgaggagagatacatcttgttatcagtcagcactctaaaaatgatcacttgtgcaaataggaacctactgctatgcatctttcttcttgctctgcctatatagctcatttcaaggtcatttggcatttgttcaaaaaataggatttgattgacaagtatttttctctgattgttttcactctgatttccaagtaaatcatattccataatctaagaggggaaaagatggagttaatcagaaatattatttttgtgtcattagcggtttgaataaatcacttgctttactctatttttcaaaagcttgcactacttaatgttatactaatatctctgtttttcaaggtcaaaattaattgcactctgtttcaatgacgcttaatcttgaaggctttgctcatataattggccttatttctctcatggtgtcatttttaataaaacctttttgttatttagtaactatataattaatttttattttatagtgaaaatacataatgaaatattgatctgtaacatatacccacttaaaatagcatttcataaccccttgtagtctcagtaagaaacatattttatatcattgttaacattttctgggttatgtttattatattgagttgattcccagcaaagctgtggatcacatgcaaaaatatttaagatatttggtggtaagacaagaagttaacatatttttgttcaacttgattcattttatcttctactatgagattctactattaacatattgacatattaatattttttgaaaagtattaacttctcacaccactttcaaaatgtcagtaaaaccattccattggtatgtacctgcaagcctgcatttcacgtagtttggacttctataaatttcaaatatttaatatatgaccatattttaatgctatttcatcagtgtttatggagaagaccaaagcaaaaaaaagcaatatatagttagttacgattataaggttatgtgctgtcaattataagtcaaaaggccatattcagtttcgcattaggtttgcgaaaatccaaattgcacaaaattatattgtataatttttttaagtctgtggttttgaaccattcatgtgaccaggcagatttacagtaccatttcatcttaaatggccatgcattgagttcatttcatttactcaatttcattatattaaaaaagaaagttgaaatgttgattttcttgatctcctggtaattcaaaaactatctgagaaaatatggtataagtgactttcttattcacctctaacaacaatatttttttatgtcctgtttttccatgattacaattcacatgatttaactgtgtacatttcttaggtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagaggtgagaaatgagattatatttggggaagtcttagtcaatctatgtcctgtagaatacttagtgttgcctgtgtcctatattaaacataaaaacactgagtgtattaattatgaaaatcgtaatttcaatttgttttgacatatttttaaattatcaaaatgaaaaatgtttcacagtagtccaccatcctttattttgtttttactagagttgttgcctaaaaatatctcctgctaattaacatatcttaataacacaaactaaaaagaaaaagcaaaacaaaacaaaaaccaccggtctccatggtcatctgcttctaaccaaggcagcttgcgcttttgtttgctccttgctgcttctgagtttaacttcatctgccttcattatccttctttggtttttcatcctcggaatcaaacacaactcgaagaagtccctttttaaataaagaaggaaagatttaccagtattctcccattaacatgtccttcaaattgcattccttctggggtcattaaaaaaactgatactatttggtatgtttaaaaatgatgtctaattttccccaatgttacagaatacaaaagactgtttctagtttacaatgctgtgacttctctttctaccacagaatatgctggtttatatgatgacatctccactcaaggctggtttattggactgatgtgtgcgattgctcttctcacactactattattaactgtttgctttgtgaagaggaatagaggtggaaagtactcaggtaaaattgtttcttaatgtgattttcaacttattaaaaagcattttctgggaagcattcttcagagacaactttttttaaaaatacacattcaagtcaaatttatattagcaagttagatgtacaatgcactgacaggaaaaacgtattgctaaattaaccaaagaaaatatgtatgttctagtttctagcacttaaaatgggctctaactgccgggcgcagtggctcacgcctgtaattccagcagtttgggaggccgaggtgggcggatcatgaggtcaggagatcgagaccatcctggccaacatgatgaaaccccgtctctactaaaaatacaaaaattagccgggcatggtggcagctgcctgtaatcccagctactcggaaggctgagacaggagaatcacttgaacccgggaggtggagtttgcagtgagctgagatcatgccactgtacttcagcttgggcgacaagagcaaaaactccatctcaaaaaaataaaaaataaaaaataggctctaacaaggttgataacacttccaagcttctattgtctatctgtaaaatatcagcgtcgttgagagacatatcactaggtcacatatatgctttagtgttttaagaagtgacccatgtatagcacgcctctctctatgcatgacatacatgactcatatttttcgcactagtgcattctaatattactggctccactggtcaattttgttggtgttaatcattactaggaatgcatttcttattaccatggcatgtagtagacacactgcctcttgaattaatgatacataagatatacatgaaaaccatcatagttggtaatatgacgtttgcctttaatttcattcaactcccgaatttgttttgtctttttcagatatacatattgtatcaagatgatgattattactagtattgcttagtattcatgatgcttttataaagggacaaagatttaggttacactgctatttgtttcatgatgttcagatatatgagaagttcattactggcttatgatttatctagcaaatatttattgggaacccgtcatctacatagaaacattgagagcataatttctaggtttttgtaaaatgacatgcataatttatggagttatgcgtttcacttttttctctgaagactgaatgattatgaattaagttcacaatgactaataaatgttctgagtaattaattggaaacgttaaagagttatagcattctccttatccccaacagataatcatttgtgtattgtggtgctatccagattccaaagatgtttcttcaaatcatgccctaaaaagaaaaaaaaaattagcatttcatattgtagagcaactaagagaatctactaggtctctgcatgtagtcgtaaaatgttccaggaagaacaatttgtatttgagggctttttttttttttttaagtaaagggaacaagagctttttggtcttatattccactaataagagaaatcagccaggcatagtggtggctgcctgaaatcctaactactcgggaggctgaggcaggagaatcccttgaacctgggaggcagaggttgcagtgagccgagatcacgcctctgcactccagcctgggcgacagagtgagactgtctcaaaaaaagtaataataaaataaaatgtcagtggagacctgaatattcagattgttgcaacaattttgagtaagagtgatgtataacaaccaaatgactgcctttttttttttttttttttgagacaaggtcttgttctgttgcccaggctggagtgcagtggttctatctcatctctttgcaacttctgcctcccaggctcaggtgatcctccaacctcagctcctcgtgtagctgggactacaggtgtatgctaccatgcctggctaatttctgtgtttttaatagagacagggtcttgctttgttgcccaggctggtttcaaactcctgatataaagtgttctgcccaccttggcctcccaaagtgccgggattacaggcatgagccaccacatccagccttgattgactttttaaattcaatttagtttaatgacacagatctaataggtgtctatgacatcttcaaaaagttcagatagtaaaataaatatttagtaatttggtcttcactgagaaatcaaactcagttgggctcttccaataagacttctcgttcacataaaattgagtagtcacgtgaaaatatgcaacatgctgcaggtgtgacgacaagtagaaccccccaaaatcccctctcttttttgtttaaacaaagaagcaactgatgggctgtaggtatagccagaaaaaaatattgcctcactggtatcaaaacatttgagcaatgctgttcttactgactattaactattccacagcactggtaaaatgtcttttaaatggtcactgtattacttttcccactttttttctcttttttagttaaagaaaaggaagatttgcatccagacccagaaattcagtcagtaaaagatgaaacctttggtgaatacaggtaaacataaggttctgttgtaaaataaaacacatattcatcatgttgaaagcttaagtgaacaaaaaggtgtttattcttaataaaaaggttacataactacaatgtaatgaccctataaagaatactttgtacaaatagggcccacttaagtgctagcaaccaaatttctgtgtgtgtgatgagggtgtataaataattaccgtctaggcagaaatgtcaggtaggacacttttcttgaagctctgtgcctaacacaaagaatatctatttggggtagctaaaacatctatagcatggccattatgaactcgggttcaatccaatttgcatccacacacgcatatctgtatacctacagcgttgcacctgcaaaggtaagtaagttacaaaccctgtcctctagatgaacctgatcagcagagaaaaatatcctatatatgcaaatgactgtaatgaattaaatagaataaaagagcacaaaagagagtaactgtttctgcccaggtaggattttggaaaaagaatcatccataagagataagctaagccttaaaggataaaaagtattgtgttactgttaaccactggacagaggatgaccaaatgagtgagggtgtgtcgggcaagggaggaatggcaagaagtctactctgagctaggtaggaatctttcggggacgtgttaaactgtctcattctccttttatctttctccaccttcccctttctgctactctctcaacttcttagttcttttttgttgtaatgtcatcatttttctcaggtctcctgtatatttcagccaacagacatattgtaagttccaggtttgtattgattttagcacatgggaaaccagagtttatattaaagaagaaatctgattgatcctgattctctcatctctggattcattactctagcaagggatatggagtattttcattagctaattggtagacatttgggcttacctgtacctccattttgtggtatacttatttttctgtattctacttagtcaataccctttttatatttttatatttcttaataaatgactttaaattctttccagaataaagaacaataaagagaaagaaagaaagagagaaaaagaaaaaggaagaaagaattttggaacttcacgaattgtgatcattactattgtattagttagcagttgcctcataacaataaccaccaatactcaacagcttaaaacaataaacatttattatttcaatgtcctcataattcaggaatccagacatggcttagatgggtacttctggctcaggacctctcatgaggttgcagcaaggttttgaccagggctatggtttcatctaaagtttcagccaaagcacaaatcattcctaggccattcgtgtggctgttggcaggatatagttccatacaggctgttgaactaagggcttctgttcttcacaggccagaggtcattcctaactccataccacgtagatatctccatggggccattcacaacatggcagctggcttccttcagaatgtgtgagccagggagcaagagagagcacccaagttggaagccacagtccttttgtaacctaatattggaagtgatatcccatcacttttgttgtattctataggaacaaatcattaagtttagctcacaactcaaaggaagaggattatacaagatacaaattccatgaggcaatgatcattaaggacctgcaacaacttttcaaaagctgaggcaggagaatttcttgaactcaggaggcggaggttgcagtaagctgagattgtgccactgcactccagcctgggcaacatagcgagactccatctcaacaacaaaacaaaaacacaaacaaacaaacaagcaaaaaaaaattttgaaagacaatattagctcaattttacaggcaagaaaacaaaaacaatgccttgtctaaaaacccatttccccacaccctgctgctcctttataaagatagctaacatcttcctgtgcattatttcctatgacatccctttatagtagctgatgtgttttccaacctctttcccccaaactacatatttatcaggataattgtctactttccacattatcccaggagacacttttataagatgctgtgcccttgcataagtcctcattcttctagcttctgataatcatcccttttgttatttttctttattctttgttcctgattcctcagccgatgcctcattgtttttcttgatttgttcttgtaactgcaatatcctaattcaagagccaattatcgtatcagtcaggggagcctgtgttatgctgctgtcaaaacaactccaaaagcattttctttctcaagttatgtgtcccacagagattgcccttttcatcttaatcacttaggagcactggctggtggacgagcatccaggctccccacagcagggaaaatagaatgtaataaactgagcactggctttaaatctttggctcggaagagacacatgtcacctttgctcactttttttttaaaccaaagaaaattccatggtggcatataacacagagtaggcaaagaagtgccatcctgctttattcctagaaacctgacatacttgatgaacagctctgacaaataccacaaattataaagtgatatgtacatccaaattatattttttccaaatgcttcattgatcaaatttgataaaatcattttatatggtgtatagcttcataatgtaatactaattggtacttaaaaaaatcttgatccaaaatttagaagatcataccatttgataagcatttcactaatggatttgcttctgttcatgaataaaacacctaccataaatatagtatacttatttatgttcttaaaataccagccatttctttctgtcttaaaatgtaacaaacttgaattgttaactatattaaagaaagttatttggtttcaaaaacagaatgtgattgatttttaaaaaagaacattttatcaggatataagagaatcaaaaggatcagaagtaaaggcagaagatcaagacttggaggccaggagctccaaaagttcatgacagcaagggaaattgcatttgttctctgtctgagtccattagggctactataacaaaataccataagctgggtggcttataaaagaacagaaacttaattcccacagttcaggattctgagaagcctaagagcaaagtgccagcattttcaatgtctggtgaacgctcactttctgggtgacagatggcaccttctctttgtgtcctcacatcgtgaaaggggtagggcagctctctggggcctcttctctaagggcactaatatcattcactagggttccacccttatggcctaatcacttcccaaagactccacctctaacaccctcacattggttatcaggttttaacataggaagcttgggaggacacagatattcagaccatagcagccactgtggacatcaacaggttgaatcccacatgtcctacagaagctaagctgctcaattttaaagagaagcacaaatgttgtgaataatgaaaaattgtttggtggaaattgcttatgactttgtagacatgtgtttacagacttcgtaaacttggtaaacatttgtggtagtatcatgtgggctttactatctgtcttcaatgctaacacaaatgtcctgaaaattataaaatcttttatcacttatgactgtgttgctttacatgaatattaatattagattttgttgagctatttttgtttgtttgttttctagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaa

SEQ ID NO: 1509 - DNA, 2163 bp, Homo sapiens
actctgatgaacactgctctcctgcctagagataccactgagtccagaagcaagacctgtgagagtgcacagtgccacttcgccccatggctgaagatggtttgcccaaaatttattctcatcctccaacagaaagcagtaaaacaccaactgcagcaaccattttctttggggctgacaatgctattcccaaatcagaaacaactattacttcagaaggagaccacgtcacttcagtaaatgaatatatgctagaaagcgatttttcaacaactacagacaacaaactgacagctaaaaaggaaaaactcaaatcagaagatgatatggggaccgactttattaagtcaacaactcacctacagaaagaaattacctctctgactggcactacaaactccataacaagagactctattaccgaacatttcatgccagtgaaaattgggaatatttcatcaccagttactactgtttctttaatagatttttccactgacatagcaaaagaagatatcctcttagctaccattgacacaggagatgcagagatctcaataacctctgaagtctctggcacactaaaggacagcagtgctggtgttgctgacgctcctgcctttccacgtaaaaaggatgaagctgatatgagcaattataattcctccatcaaatccaatgtccctgctgatgaggctgtccaggtcactgattccactattcctgaggctgaaatccctcctgctcctgaagaaagcttcactactattccagacataactgcccttgaagaagagaaaataaccgaaattgacctaagtgttttagaagatgacaccagtgctgtggctacattaactgactctgatgagaagtttatcactgtgtttgaactcactacctctgctgaaaaagacaaagataaacgggaagatactctgctaactgatgaagaaactaccgagggagccagtatttggatggagagagatactgcaaatgaagcagagacccattctgttttgcttactgctgttgaatccagatatgacttcgttgtccctgcatcaatagctacaaacctagtggaagaatcatctacagaagaagatttgtctgaaactgataatacagagactgtacctaagatcactgagccattttctggaactacctctgtattagataccccagactataaggaagacacctccacaactgaaacggatatctttgaactactgaaagaagaacccgatgagttcatgatttaaaagcaacaaaagggataccatgtagaattgtgcaatagtctagccagctagccttaacatctaagaaatttttccaacaagcaaaaacctttagaaatgaaagaatgtgggcatttaaggcaagtattcgactcaataaatgcagatgcttaggactacaggtcatgtaacagatttacggaaacttagaaaaaaaaaccgcagtgtaagggtccccctagtatcacaaagtttcaatattctaacaattacttaatgtaaaatttttcgtcctagccttcagggagtatgaagacagagcaatgtaggggctcatttctacaacatttaatgatgcatatcatttagttaacagtcaatattatacttaagtgagaattaaggatatgaagagaagcaaattaacctctccaaaacattaccatagcctaaaaagttctcccaaaatgcttgttctaagcaattttttcattagtatttcatcagtgattctcttctatttaaaaaatttttaatcctcatataagaattaagacaattcagtaattgtttagcacccacatgtaagatacataagatttatgatagggttcttggcacatgttagatacaaactaaagcaaaatgatattttacaaatatgcatatttgtcagaaaaatgttctgtaaacatatacatcaatttaattttctttctgttaaaatgtgttttctgaatttttgtccatgttttccaggtcttaaacactgaatatcacactcttcttatgactcttgttagcgattcaaggacataaatcttcattcttttctggcacagactacttaaatgggtctgttttcactttgctcatttttcttcaataaatctttttggcaagcaactga

SEQ ID NO: 1510 - DNA, 12316 bp, Homo sapiens
aactccaataaaaatccagacagaggtatttaagaagaaaggcttttctatcaaagttctttctcttcttggacttttaaattgtggctacctaaattgagtatctggcaagagtaagattaagcagtaatttgttccaaagaagaatcttctaccaaggtaggtatatagaaatataaatgtaagaattttcacttcggaattctagcttttgctcatattctcaagaatatcatcctcatggcttttaatggaaatagcctcgttacccaaaaatctcagatgtgtttttaaaaaaaaaatcattgtctgtggtaaaattgcttaaaattcctgaaaaaatgtcaagaacattcatattgattagttgcacaatttacatccaatttcacaatctattgactttttccactgctgtattttatggtctctaaagtcaatcatgagtagaagagtcttaaaaaggtatattaagttagatttgcatttttgttgttcttgtttgagttaggtttcttatgtattgtcaaactgctttctaatatgaaaacatataagaaaaaagctattttaagggggtagacacacgcacatacaactataggatctgtcaacctgtcttacatcactttcaaggctaatgccaatgacagataccacataaaccccaagacaatctgtcagcctatgtgcttgaattttgccttcccagaacccagggtgccatgtgcttcttatatattgttgaaaattataaacaaattaggataaaaacatcttttttctaattcacacactgatagacaataattgacttttggaataacttggaaaaaaatcatatcaaagtaataatacttcagtagagtgatgttaaaggaaaaatacacattacatggtttcttttgcttcagacagatctaataacaataacacaataattgtattaagaagttattttttacaatagtcgtgtcacgttgacaatatttaggtcacaaatctatagaaatctgtaagctttgactaattttaagtaaacatactaaaagtataccctaagtagttatgttccaaagtagtcaccactaaaggcaacaaggaatttccaaaaatactttaattttaaaatgtactttcaacaattatctgaaaattatctttcataaaataaagtaccaccattaaaaaaaaaatcacaaacatgacagtattgctgtgcatctatgctgcttcctctccccaaaatatcaaacacatctttaaaggttatgttggtctttcttcatcattttacataacaagtgttaaaatgttttaaaaaattttttctgaaaaacactgttgatcgatttggctaactgtggataatctttggcctgtttgtaggagcaactttaaagaatgaaattaactttcttcttgggcctgttggctcttatttcatgtttcacagtaagttccctcaattctaaatttacttgttatatttattgttaatcatgatttcaaagaaagttttgataccaagaattttgtcctgtatataaaaatacagtgtcaggctgttgataattatggacttgctcttactttccttttcctttctcatttatgactaaccatctagtcagcggttgctaagcatgaagggacagtggactgcaggaagaggacacagggcaggtagtatctaggagagctagctcttatctagagatatctcttcctttttatttctttttcaaaaggactactatcaaattgtcagaaaaatataatttaagcttactaaatgtttaaaagctgtagggaataagaaagcatacagttggagcttcatgataaattttctaaaaagacaacatgatatatcaatgcaaggattgctgattgtacaatagttttttattgaaaatatttataaaaactaaaatcaggaagcctttctgatgcctgaaaatatattcattatgactaaaatattcctttaactgactggaaattaaagtgctactcacttgggaaaaaaatacaaacagaaaaagaagtcatttactcaagaagcacttacactaattcaaacttttgaaaatcatttgttaaagctctataggagatccaaaaatatataatgcaaagtaacaagtgataagtgccatagccaaaaacatcatagcatgatacgaatttcagagtaagatcagtttccctagcatatgttggggttaggtgggcttgcgaggagagaaagagccctatttatctcatttcttagtaattactgataatccactgtgtgttgggcctagtggtggttgatacagaaataccaaagtcgaattccaaattgggatcttcatagattaggtcttcttttcataatatagtatctacctaagagaaactagtgagcaaataaatatcaatagaccctagcaatgatactgtcagataaagtaacgttatttttctgaagcattttttgatatttaatgacatctgtattgttctgaagcatatagtgctatgtaataacatttgtataaaaaaattatacttctgaggttgaaatagaagattattatactccatgagatacctatatcagaaacacctgatccacttaataagaatgaacatttccagaccttatcccagacctgagaaaaaaagaatagctgatcttggggcctggaaacctgcattctaggatactcttactcaagctgaaatctgagactccttgagtaaattttcttgaaatttacttctcaagctattatgttataattgcatgaaatatataaagagagctttcaaggtaaattcaacttaaatcaatccatcatatgaaaaaacctaagtcaataattagaattaattatcaaatttattactctggaataaaccacttttttggtagaattccccaaatatgacaaatatgacttctctgttaacattaataaacactaattcagactttatacaatagattagaaggtaaagaaagatccatgatcaagtaaacttgagaaatttggggaaatgaaatagaggttgttgactagaatacttctcagagacaataatagaggaaatgctgtctttgattctctatctacaaccttctgtttcatactgaggacagacaacttctgaggagtcctacataaagcatctaccttgaggattcatatgaattaatggcatatttttattccagaagcctgaattgcaagacaaatgtaacttaaattcttttctaccttgaaagagtatagaatcccatttatataagaagcagaggattccatgtcctaaaaaaacatgagtttaatacataaattttctcatgttagaattaaatattattggatataagaaaacaagaaccacaagacataattttaaggtcactctagcaaaaatttcttgctgtattcattgtctcatgagaagttggtaaatcttaacaacagtcttaagcattagtctaaataaagaaactttattgtacttagcatctagaactttcaatatatcagagattatcttttatgagatagggactatctaggatttaaattaaaaataacagttcatatttgtatatttacaatgtactctggagcacagttttaccctcaaacctcacaaaaacccaggaactatttgggatgctcctttacatagcacagagctgaacatgagacaaaccctcaataagtattaggggaatgacacaacaagtgaatgggcctttgtgtagttgacgccaagtaataacaaataggtttcagagtcttacctgttcattcatgccattggataggctatatgaagtatgacacagggatggataataggccaagtgtaagctcaaaggtaaagtatctcatggtggacaaggatatctgccatgctcacaagatgagtaacgacagcatttttgccaatacctgccatccctaacttagagaagactttgtttgcagcacaatctgtccactaaactgctgtcagctgtcagttggttaagctgtcagtctggcagtttctaatccttaagaataggaaatagaagtttaaaaaaagtaaaaagtaaaataaacttaaaaacagaacataaataaaatactttacagaaagggctatgataaaataattgccaaaagcaaagcaaaacctttagcctgaactaaaccaacgataagcagatatcaaataaccgaagacagacagtggttctccaaactctacaaactctagaaactctatcaggaacacaaatcatctagggattttgtagaactgcagactctgatccagtaggtctgcctgagccccataagtctacatttctaacaagccctcaggtgatactggtgctgatctgttggtcagcaaataacattttgagtaacaaggccctggtcaactgagaaatcaaacagagaaaggctgaggacttcttacgggtttgtataaatgctcaaatgttgtcacgggaaaggattacgctccttgccatgtgcaaggaaggaaatggcattctgaaatcaagtaagagaaatttctgcttatcaccaaatatggggaattcattcaacccaaaatacttattgagcacttattgtttgccaggcactattctagatgttgggtaaacagcagtgaacaaaacagacaaaaagtttctaacctcatggagcttatattctacttggggaagacaagccataaacaaaataactgactatgtaatgcagaaaatttgggaagaaggaattttaggaggaggtagaacaaggatgtgattttagatagggtagcccagtggaaaatggcatttgattaaagacctgaagtgggtgaaaaagccaaccatgcaagcagaggaaacagggagttccaaagtctggagtagggtacacttgcctagtgtgaagaataaggaggctagcatggctggtagagagtgagatgggaagagaggagcaggaggtgatactagagagttagaggagggtgaggctgcatcaggtctcatgggcttttgcagagccttagttttactctgagtgacatgcaaaactttagtacatgaagtcagtacaaaacctcagaaagatgccgtctcttcccacacactcttgctttccatcatccataatgatttggagaaaaaaaatgaaacttctaaaatatctgaatggcatccataaatatttacttaaagtcacctacagcttaagaaggatacaaacactgataaacatgacctctaacttcaaggggtatatgactgtcagaggatacaagatagattggtaataatagccagagcaggagttgacaaacttttctgaaaagggccagataacaaatattgtaggcttctgtgggcctgtaataagtggtcaacttggctgaggtagcttgaaagcagctacaataaacgaatgggcatggttatgttccagtaaaactttatttaccaaaacaggcaaactacatttggcccacagccttagtttgctaactcccagtctacagagacagtgaacaaggcaatatggcatgtaaaaacctgatatttcatttacaaaataatcataaaattaacccaacattattcatgagtttgcaaaaaatatttatgtttcattgaaacatgtttgcatgtttgtgtgcatgcaaaatactatgctaaattatttgtcattttaattattttttctaaagaacatcatgtgatagatactattactttctctcttttaaagataggaaaagtaacagagaggttacataacttacccaaattcacataacttgtgaatggagaaacaaaattttaacttgccttgatctatttgcctatcttctgccttttcttctattatctgggatggactaaaatcaacccaatatattctaagaccaacccctcaacttgtacactagatcccatcctctcccctaagcaaggagattcctgcaattatcctgcaattatctactctaaatctaaatatcagcaatttttccttctctctattgattgttcctactagcacataaatatgaggtaatatcatttatatgtttgttttcatactccactgatcttatggctcccatcatggtccatttgaaaaagttgcctctgtacatcttcacttcttttcctgttctgtcttaagcctactccaagcagactttgcccacatcatttggatgaaaccacatttgtcaaattgtactcaaaatggccaggcgtaagggtcagctttcagtccccatgataattatgtctaaattgtatttgacatgatcagtctcctacttaaagagttttttctttttcctcaactccactctcctgatttttctcctacttcaatgacgactccttgttggtctccttctccagacacatctcctcttcctgatctctaaatgtcagagtctcccaggacaccatcttcttaccctttctccatctatgagcacaaatccagttgctcaagccaaaaaaaacttgaaatcatccttgactctatcacctcccagatccactccttcagcaaatattgcccactctgccttcaaaacatcatctaaatcttaccctttctcaccaccctcctgctaccattctaggccaagccatcatcacttcctacctgtggcaacaataactgatctctctgctttcactattgtccctgcagtttattctccacacaacaaccagaaagatgtttttccaaagtaaatattgccatatcattcctttgttcaaaagcttctaatggttttccataagacttagaaggcggggatacaaagtccttacccctacctacaagaccctgctttgtcctccccgcaccttaactccaatatatctatgtaacaaaattgcatttatgctctttaaatgttttacaaataaataataataaatttaaaaatatctgccctcatggaactcacacattaaatcgtttttgattattttaaaccatcaaatgttaaaactacagagagaatataatcaaatttaaatataggtgggctgcataataataatattaaagctaccacttatggagtgtttaatatatgccaagaagtatattacaaaagtatgctgtttaatctctccagaaatccagtgtgacaattattattattatcctctcttaacaaataagtaaaatgaaactcaaaatagccaattctctattctgtttcaaataagcttatcatttgtgaaggtaatccccccaaatgtagactccttaagaaggcattttcatcatttgtctagggttataatgttcactaccattggccagtggaggagggaaactagctagtgaaaaattgtattaagagaataggaaaagataaaaataataagaatggagatcaggggtcagctatttgctgtaaggtgtaatttttcacatgatttctccccacctctgcttagggtccagagagcagctcattgaagatcactttgaacttaatttccatgacactgtaccatctgggtttcctcctgtctctgattttccttcactggctgctcacctttctcttattgatacccaagtttctgtcttcagccatttcttcttcattactttcttacttattgctttgacccaacagtgctttccaaatctatttctccagttctgagatttcaatctgcatctacaaacttccatgacttttcaaactcaaaaggattaaaacttaattaatttttttcctcttgacacctatatcttcattaatgttagcagccatgacttaagatctcaatttcatttgagtccacattcatttattcaaaaacatttactaagaacttggccaggcatggtggctcacacctgtaatccccgcattttgggaggccaaggcaggtggattgcttaagctcaggagttcgagactagcctgggcaacatagcaagaccccatatccacaaaaaatacaaaaaaaaaatagccaggtatggtggtgcactcctgtggtcacagctacttgcgaggctgaggtgggaagatcacctgagcctgggggacagaggttgaagtgagctgaggtcacaccactgcacgccagcctgggtagcagagcatgaccccgtttaaaaaaaaaatgtactgagaacctccaacgtgccagaaactggagatagaatgataaacaatacagagacattgtttgaagaagttaataattactacactatataataagtgactataagtattataatagaagtgctaaagcaacaaaaagaacaaagatacctaacttacttcgaattcctcataccttttattattcacaaaggtgccaggcactgactaagatactaaagacacaaagctaaagaagatacaacttattccttcaacagcagtaaaatagcacatggcctaaaagtggagaaaaatatcaaaacaaacaattactatcactgtgaaaaaaagtgatgaagtttgcttttgtctccaataaaagatttacaaaagtaaaattttggctgattttatattgtataaagatattttctgtacaattcttttaattatcatatcaaattattgggggagaggagtgaagccacttaaacattttgaaggaagagcttgccaagtgaatggaaattagggcaggagtgaaacattctcagctagaggaactgcttttatgaaggcacagggactaccaaaaagagctcgttatgttgaaagaactagtactagttctacatggccagagtgaggataaagaagtggcaaaagatgagattggatggcggtataggcttttgtttggttgcaaagaacagggttccactcacaatatttattcttgcatttttagggctgccttagtttgctgcaccagttctaatttatatttattcttgcattgacttcctttttccttaaaggaaggaaacatgcctggccaggttctcaataaatgttttcttccttccttaaataagaaagtcaatgcaagaataaatataaagtagaactggcacagcaaaagcaggcagccctaaaaaccggtctttgcttctcatggcaaccctgcttttctctgtactgttccctccctgagatgtgctctctttactcacagtccctgtgtccttatagcttagtttgcacgtggcccttattaatgctccagcctctgtctggctcctctcatctcacaatattcacattttagttcctacttctaagtaggatatctcaatatttcctatttcaagttacaaagagaaagagaattttattaacgtggcttatttttcttcttctggccataaggcctaagatcctggatagccagtggtttggaagtccatggaacaatagcccagaaataacccaaataaatgtgtttatgtttatgttacaagaataaaaggtgatgactaagacaggacagtccctggaaagggagaaaacatagatataaaatatacagaggaattgatcatgtgaccatgacatcactatggctccctctgaaatgacttggaatttttgagttgtcactgatctttgtaagagattcagttaagttgtgtgatggggacagtaaccagataaaagggaaattgagaagtggagacagaaaatctaaaccagccttccttactatctggctaggaatggagagagataaactaataaagaaagcttcaagggtaccctaggttaagaatgagattctttaatacatgagatatcaatcaatattatagacaggaagaatacagccagggattagaaagaggtttattttacaaaaataaaagagaagaaagaccctagggacagagaagatgtagatataaaacacaggtgaagagactggtcttaaacaggaagagagaacagcaagatatttatgagttttataggcatagggcaggaaagtgaagaagttctcacgtatcatggcctaaattatgtgaattagaaggcaagatcatcttctgatgggtgtagaggggagcaagaaaagtagaagtgaggtatagatgctgagaagatagccttttggggaaaatgggaggaaatgatttagcagtgctgatgcaccagacaaacacagacactatagttctctagtgttgctaccattagagattgtggcattctccagcaatgttcatcaccatggaagtaggactagggaaggtagtttgcatagagttgatccaaaagtttgatgtttctgaaggcaatatggcagagacacaggaaggagttgaatgttgtaggggaatgattagagtcttgcaccttcctaaagctttgtttcaggcaaactggtcttctgatggtcgctagaatagaacctatattttcttgaccttgttcatttgtttatgatattatcctaatttggcttcttcctcctcatttctaccctgttattttatcctcatttcaaatgccatcttctctacatggcaattagtcctctctctttgataaaaattaaaattttcatctaaattactaaaattgttacaatatttatcaattatttcttgaattgctaccatctacaagccatgcttgttattaatagagtacaaaatcactcaaaattatactgagcccttactctaccttactatgtctaagcactttacatagattatgtataatcctatctaccactataaatggtaagaactatttctagaaccagttgaggagtgagcaaacaggcagagataaccataagcaagtcacccagctagcatttaacaatggtaggactggctctaggaggctctagcaatcagactccagtgtctaaattttaaccaacatactatactagctccataggctttttgttgtattgccttgtattgtcattggagggttatatcttccactgatttcagactcacataagcagagtcttaaatctgtttctctttgtccctagaaagaagtgttgcatgtaatagttatacaattaatggttcagagtctggaatctcactgaattcttagaatgaagtaagaaagaattttcccagatagtcaacctgggtatttacctccacttgaaactacattcaaaggtggtcttttcttatacataatcaaggtgatttggtccctccctaaaacctacaggtcagatagcaaggttaccacttttttggttttttctcatttaatactattctacttttctttgattgcccaggcatccagaataaacaggaaattttctattccttattttttctaagttattttctcagtgaaatacatgacttatggcttagtatatcctaatgtttacatagtagatatattaatacatagtatatcctaatgtttgaactttaaatgatcaaatttagaaattttgttttttacctttgtttttatctccacagcccagtgagagtcaaagattctccagaagaccatatctacctggccagctgccaccacctccactctacaggccaagatgggttccaccaagtcccccacctccctatgactcaagacttaattcaccactttctcttccctttgtcccagggcgagttccaccatcttctttctctcgatttagccaagcagtcattctatctcaactctttccattggaatctattagacaacctcgactctttccgggttatccaaacctacatttcccactaagaccttactatgtaggacctattaggatattaaaacccccatttcctcctattcctttttttcttgctatttaccttcctatctctaaccctgagccccaaataaacatcaccaccgcagatacaacaatcaccacaaatccccccaccactgcaacagcaaccaccagcacttccacaaaacccacaatgacgatcagctcctcaacagtacctatctcttcaacaccagagcctgccacctccatatcagcagcaacccccgcagcatctactgaaaatactactcaaattctcgccaaccgtcctcacacagtattgctcaatgccactgtccaagttacgacttccaaccaaactatattaagcagcccagcctttaaaagtttttggcaaaaactctttgccatttttggttgaacatgcaataaatgatattttccaaactgctctgatatcttagaagaaataaactgcaatgattttgatggaaccaaccctgatctaaccagcacactaaataaagtatttgagcaataata

SEQ ID NO: 1511 - DNA, 6331 bp, Homo sapiens
ctttcaactggcaagagtcattttgaccagcaggttaatcaactctaagacagatcctcacgcaaaggtatgtacctggaaatattaactgaagaaattttttctcagacttttcatgagctttttataggacattcattatcaccaaaaacataagcaccttcaccttatgtaaaattgtaagtcgttaaacatatcaaatcttgaaaaattatgttattcacatgtcagagtaaagcattcatgttgggcattgaggacaattagtccacccaagtacacaattgacttttccccttgatgttccttaaagttcttgaaacttcataatgatagattattctcagatgtactctaaaagagggaattgttccacagtatatgtttattattagtttttcttttgtttttcaaacttcttataagaacggatcctgggaaaagtaatccttaagggaatagccacacccacatacaattgaatatccagtgaaattttgtccatatgattctttcaaaacttgcgttgttcagacaacacactcaacctatgtgcagagttgactgtcaggaagccatttgtacaatggtgcatggagttgctttcccagaactcaagctatcaggtacttgaaatatttcacaaattgtgagccaactgtgaataaaatatctggactcctccatattctctgacttggtctttgatctaccatatacggatttttggaagcactttgagaccacacatcacagactaaattaatttagtggaatgttgttaaaactaggagatatataatatgactctttttttcttacactacatcaaacagagtgatttctttcttttccttatttttgagatatcccaaggaattacactaacatatgatctagttaatatgttaatatttcaaacccaagcctatagaaatctataaaacaatgtacctgctatttaaaaatgcaaaagtattcaaatgtaaataattgtacatgtcaaagtagttacctctaaaggcaaaaactgtagttacaaaagcttctattgttcaatcatttatgaacaactctttggcattatctccagtatcagtttacaagtcaaaaataaaaactacttccactattttgaagtcaaattttataagcctactaatgttgtcccacagtaatactgaatccaaaataatgttaggcaaatttcctaaaaaggctacagtagtatatctgtactacattatatccatgtgttgagacattttaaatagtactttttaataaaaaacaatcatactgatcacctattgtgcttactttcagaggcaactgaaaggatgaaatcactgacttggatcttgggcctttgggctcttgcagcgtgtttcacagtaagtatcattaatcacgatcacacatctttatactttctcattaaccattacttcagatttctttttacattaatgatgttaccttttcttatatattagtaactattaaccgttgatgaaacactgttctagtggttaaatttaaatttaaaatctaatttaatttaaatagccccatatgtctgatggctacaatactggacagctcaagtctgtaatatcagactgcattaaacagataagtataaatgtaggtccccatactctagcaattacacaataggtaaaactctataaaatgagatagtttaaagtagttgttcctaacatatggagtcacctaactcacttattaaaaatatagtattaaagtcctcatccaagcctgaataataggacctgggaagatgcattttgcagaggatttaggagaatctttgcatgctaaattttgaggaaataataaacatttatagtaacacctaccatatattaaaaactaggttaaggacaactacccttattgtccttaacctagtgtttcagaattttttaatgcatatttttaaaagtaatagaatgatactcaatttcaacagaagggtcaattaattccagtgttacaaagaggagattaattccagagtaacttctcccaaagtaccataaaatctattatatcaaatgggaaaatatgaaagctgattttttagaagactatgacttccacaaagcaggcaacataaaattatatcattctgaaacatgaaacataaaataatacctctttcttctacttttaaaaacttgaataaaaacaggacattctgagatgactgaagtattctgactttggccaccttcctgcatgcattatgggtggacataatttttgataagccaataaaacatattgacatccgttaaatgtcatgtcttaatgacttcatcataaagctgattttcaacattttcacatcctcaaaatacaagagaaaaacattttattcaggcttttattatacaaatagtaactttttacaagataaattagaaaaacagagctttccaataatataagcagtttaaatagaaatgagcctttttccagttgatatgataatgatgattaataattactgaacattggaaatgtgaagggtagcatgtcctttgcatatacatatttgtagatggggtaagtcatcatattcagcctgttaccttttgagtgttttctctgttataggtaattttccaaatgcattacatacattatctcttctttaatcctcaaagcaagtctcactatttttaatctcactaaaatacaaataaatttagattcaaattatgcatgtcttagctggattattgctaaattgaataatgtaggagattaacattaattatagccctttgagaggggagtgtttcttcctaatatagtattttcatcattttcatcattttactttagccagttgtggaaagggagcttatcactgcgattgggttaagagaacaggaaaagaatagatatttactatgaagatttttcattacataatatttagatcaacatcggtatatctttaggaaaaggtactttcagctaattttttaattgtctcaacaataaaaatgtgtgaaatatttttccatactaaggatttgttttcttgacaataaaaaatcaaatcctgaacttccacataacctgactagtccttggattggcagcccttgggtcaaacaccctgcataacaacttgaaccatcactagctagagaagacaaatgcaaggctggtcccacagaagtgccttggaattttttgtttgtttcattggtgatatgaataaaacttttaccggcatgttaagggcaaaagccaggttgaagagcaaatgggaagtgagaagtggggttggcaaatttagaatactctttcatagagctttgctttgcaggaaagaggtgaaaaggaggtcacaacaacaagggtattggtggttgaaactgaatcttttataaacagggaaatatcaatttatatttatttcccaaatgatgtcttcgacctctctgtacgtgttaggtgaaagcggcaagattagaatcaagaggtcaaatcaacgggccctacagtaatttgggtaaaagtaaatgacagatgagaatgaaagcaagaaagatgataagaagtggttagatttagaattcagggagtgggatgaagagctgataggatagggagaaaaaaaattgagttgaacataaatgatagtgtttttctgaagaaaatgagctaattaaatggcagatattacttgcagaaagtaaaagagaagactgacagagccaggtccctcagaaaacaattataaagaaaaagaaactgtctagctatcaatgactccatggttgtgtggccagtaaatcagggaagttcgtttctaattgcctgaaatatcttggtgaagcaggagaaaagccagtttggtgggggtagatgagagctcaggatgaagtggagaatgtttataaaattggcatcaacttggaaaattacaggcctctggggaagtgggaagagataatctaaggtaagatactcaaaaaaggatttcaggcagcactgaaggacgctaactttctgatggtacagtgcttgtgacatcctctagcattgttaagaacctggaactaggaatccaggagaaagatggtttaccgtaatactaaagtttaggattagcaagggtaatggccagacaaataggtgaagggactgagaaccacaagaagtgaatgtagttttgtgccctatataaaccatctgctccaagcaacctggagttcttgccgtcagtagagtggaacttcattcttaccccagagcatttgcatattttccttctatttggcatgctccctccttattttgtattctttaagcctcttttcaataactccttatcacagagacaatcctttatcattttcctatccagaactgatctctttaaatccctaatgtatttgttccttgcactacttttcagctatttttagatttttaatggagatggggtcttattatgttgtccaggttggtcttgaactgctggcctaaagctatctacctacctcagcctcccaaagtgctgggattacaggcatgagccaccatatccagcctcagctattttcatttctaaaaattgtactctatgtaaaccagacctgagataagcaccaccctaggcactttacaggtgatatttcacaatagatgtgacaacaaccgcaggagatgggtacttttatgaacatcattttcctgataagaaaaagagactcaaaaaggattctatactcaccctatctctatgtgccagaaggagagctcaaacactggcatgaaatcccagacactcattccattcatttcacttccctttagatcacatttatccccccctgtattgtaattactcagcctgtggattcatagaagacatgtttgtacccctggcaaactgccaggttgacattcatgacatgaatgaaccagctccttcattagctcattgcacaaaatagttgctcacatgtgtttcacaattaattaatgttcaaagcccagaacaaccctgaactcttgaattagacataaaaagacgtgtctttcccatgctgcaaaggcatttatttccatttagaatttggaatgacagacttcactacaggccaaggataagatttttgctcattatctattttttccagtcaatactatccaagctttcattgagagcctaggtattcagagggcaaaagagaaacatttttctttgatacagaagttcatacatcataacttagatacatttaacaattttctattgctcaataacaaattaccactaattagtagcctttaaaaactcattattatctcagtttctttggccataactctgagcttggcttaggtggcttctctgctcagagtctcacaggctgaaaaggtgtgtccattgctgtattttttttttctgcacctcagtgtccttttttaagcttgcatggttgttggcaggattcagtcccttggttgttggactgaagcccctattttttttgctgcctatgagccaggggccactctcagctcctatagccagtctaccatgtacttccacatggccctcgccacaacacggcatcttgattcaaagcccagaggaaagcatttgctgcagcttcaaatctctctgattccttctcacattgtagaacctgttttaaaagggctcacctgataaggtcaggccagcatgtgccagcagggagtagaaatcttgaggccatctcagagttctgcttaccatagaaaccattcacccttatatttaactgtgaaatatctgatttaaaattatttacttctttgtttccacagcctggtgagagtcaaagaggccccaggggaccatatccacctggaccactggctcctcctcctccaccatgttttccttttggaacaggatttgttccaccaccccatcctccaccctatggtccagggagatttccaccacccctttctccaccctatggtccagggagaatcccaccatcccctcctccaccctatggtccagggagaattcaatcacactctcttcctcctccttatggcccaggttatccacagccaccttcccaaccaagaccctatccacctggacctccatttttccctgtaaattctccaactgatcctgccctccctactcctgcaccctaaatacagacaactgcaacaggtgccaccacccacaaaagacaacactaccctcgtaactactgcttctactacccaaaaataagaatttcaacactacttccaagagactttt

SEQ ID NO: 1512 - DNA, 7167 bp, Homo sapiens
gccaacagaaatccattacaatatataagagctaagatttcttgtcccttttcacctttatttgccgtctttcaactggcaagagtcattttgaccagcagattaatcaactgtaagacagatcctcacacaaaggtaggtacttggaaatataaactgaatatttttactttgaatattgaaatttttctcaaagataacattttcaacgataacattttatgggcttttcatagaacattcattatcagcaaaaacataagtagcttacatgaaattgtaagtcattaaatgcaataaattttgaaaaattctggtttttacaggtcagagtaaaacattcatgttgggcatttgggccaatcggtccatccaagtacacaattgacttttcctcctgatgtaccttaaagttcttgaaacttcataaggatagaatagtctcaggtgtactctaaaagacagaattgctctacagaatatttttattattggtttttcttttgtttttcaaacttaatttaagaatggatataggaaaagtactagttaaaggaatagccacacccacatatatataattgaatatccagtgaaattttgtccataggattctttcaagacttgcattgctcagaccacacactcaacctatgtgcagagttgactaacaggaagccaatttgcaccatggtgtatggagttgctttcccaaaaatcaagctatcatgtacttgaaatatattgtaaaatttgacccaattgagagtagaatacctggacatctccatgttcttgccttggtctctgatatatggatttttggaagcactttgagaccactcatcacagcctaaattaatgtaatagaatgttgttaaaactaggaaatatattatgtgactcttcttttagactatatccaacagggtgattccttttttttttccttatttttaagctcttccaagcaataaaatttgtaacataagatctagttaaaatgttaatatctcaaacccatccatagaaatctataatgtatctactatttttaaaatatcaaaatgttcaaatgaaaataagtatacattttaaagtagttacttctaagggaaaaaccttagtcataaaagcttctattgctcagagcaatgtatgaacaactctttggcattatccccaggatcagtttacaagtcaaaaataaaaactacttccactattttgaagtcaaattttataagcctactaatattgccccacagtaatactgaattcaaaataacattaggcaaattccctaaaaatgctatagtaggatatttgtattacattatatccaagtgttgagacattttaaatagtactttttaataaaaaacaatcatactgatcacctattgtgcttactttcagaggcaactgaaaggatgaaatcactgacttggatcttgggcctttgggctcttgcagcgtgtttcacagtaagtatcattaatcacgatcacacttctttatagtttctcattaaccattacttcagatttctttttacattaatgatgttaccttttcttatatattagtaactattaatcatcaatgaaacactgtttagggcttaaatttaaatttaaaatctaatttaaataaccacacatgtctgatggctgccatactggacagctcaagtctgtggtatcagactgcattaaacagatacgtataaatgttaagttcccatactctagtcagttacacagtaggtaaaactctataaaaatagataatcaaaataaaaccgttttcccagcatgtagtttatggatcatttacaccagagtcacctaactcacttattaaaaatatagtaaagacctcatccaagcttcaataagagtatcagataatgggacctggaaagatgcattttactaaggatctacaagtatctttgcatgctaaattttgggagaatgctaagcatttatatataaacagctactttgtatacaaaaccaggttaaagacaaatgagatactaaatatcatacaaaattacaaaaatgtttttaaaacacacgtatttcaaagtagtagaatcatactcgatttcaaagtagtgttagattaattccagtgacagaaagagaatattaattccagagtaatttccaccaaagtactataaaatctatatcaaattgaaaaatatgaaagctgttttttttagattatgacttccacaaatcaagcaacataaatttacatcattctgaaacatgaaacataaaataattcctttttcatctactttgtttttttttttttttttttttttgaaacagactctcgctctgtcgcccaggctggagtacagtggcgcgatctcggctcactgcaagctccgcctcccgggttcgcgccattctcctgcctcagcctccggtgtagctgggactacaggcgcccgccaccacggccggctaatttttttgtatttttagtagagacggggtttcaccgtgttagccaggatggtctcgatctcctgacctcgtgatccgccagcctcggcctcccaaagtgctgggattacaggcgtgagccaccgtgcccggcctcatctactttcaaaaaggaacaaaatcaggaaattctaaggttactgaggtagtctgaccttggctaaattactgagagcattatatgttgacataatttttaataaaccaataaaatatattgatatattttaaaggtaatatcttaatggcttgattataaagcttattttcaatatttttattccctcagaatacaaaagaaaaacatttataatttcaaagtatcaggcttttattatataaatttttttttataagattaatttgaaaaagataactttctgggccaggcacggtggctcacgcctgcaatcccagaactttgggaggctgaggcaggtggtaacttgaggttaggggttcaaggccagcttggccaacatggtgaaacgctgtctctaccaaaattacaaaaattagctaggcatgatggcatgcacctgtaattccagctactccagaggctgaggcaggagaatcgcttgaacccgggaggtggacattgcagcgagccaagattgtgccactgcactccagcctgggtgacagagtgagactctatctcaaaaaaaaaaaaaaagaaaaaagaaaaagatagttttctgataacataagcagtttaaatggaaatcaacctttccccaacttaattatatgagattcatgatgattaataattattgaatgttggaaatatgaagggtagcatgtcctttacgtgtgtgtgtatatgtacacacacacacacacaaataaagcaagtctaactactattagtcccattaaaatacaaataaatttaggttcaaagtatccgtgtcttagatggactgttcctaaataaagtaatgtaggagattagtgccaattatagtccttcgagagcgtagtgtttcttcttaaaatagtattttcatcatttttctgagttcgttacctttagccagttgcggaaagggagctaatcaatgtgattgggtatacttactatgaagatttttcattacttaatattaagatcaacatcaggatatctttaggaggcgagggcactttcagctaattttttaattgtttcaacaataaaagtgaatggagtattttcccacactaaggatttgttttcttgacaattaaaaatcaagtcctgaacttccatacatcctgactagtctttggcttggcagcacttgggtcaaatgccctccataataccacagaatgtcattagctagagaagacaaacatgaggccagttctacagaagtgccttggtatttttcatttgttgtattagtgatcctaataaaacttttactggcatgttaaaggcagaagccaggttgaagagcaaatgggaaatgagaagtggagttggcaaatctagaataccctttcaaagtttcaaagtttcgctttgaaggaaagaggtgacaagaaaatcaacaacaagggtaccggtggttgaaactgaaccttttataagcagggaaataatataacttgatacttcttttgcaaatgatctatttaaactttctgtatattttaggtgaaagtgtaagagtagaatcaagcagtcaaatcaaggtgtcattacagtaatttgggtaaaaacaaatgacttaggttaaagtggaagtaagagatatgataagaagtggttagacttagaattcaggaagggagatgcaaagccaataggattgtgggggagaagggtgagtggaacataaatgatagttgttttctgaagaaaatgatccagtttataattcctgccatttaactggctcattttcctcagaaaacaaattccaatattatagttacaggaagtaaagggaagactgacagagccaagtccctgagaagacacttgtaaagaaacagaaaattcctagctatcaatgactccatggttgtgtggccagtaaatcagggaagttcatttctaattgcctgaaatatcttggtgaagcaggagaaaagccagtttggtgggggtaaatgatagctcaggatgaggtggagaatgttgataaaactggcatcaacttggaaaattacaggcctctggggaagtgggaagagataatctaagataagacactcaaaaaaggatttcaggcagcactgaaggacgctaactttctgatggtacagtgcttgtgacatcctctaccattgttaagaacctggaattaggaatccaggacagagatgctttgccgtaatactaaagtttagatttaacaagggtaataccagacaaataggtgaagggactgagaaccacaagaagtgaatgtagttttgtgtcctgtgtaaaccatctgctccaagcaacctggacttcttgtcatcagtagagtggaacttcattcttaccccagagcatttgtgtattttcattctgtttggcatgttctctccttattttatattctttaagcctcttttcaaatgacttcttctcactagaacaatccttcatcattttcctatccagaactgatcgctttaactccttaatgtatttgttccttgcactacttttcagctattttttttttattttttaaaatagagacagaattttgctacattgtccaagttggccttgaactgctggcctcaagcaatccacctgcctcagcctcccaaagtgctgggattacaggcatgagccaccatgcccagcctcagctatttttatttctaaaaattgtgctctatgtaaaccatacttgagccaatcatcactctaagcattttacaggtaatatttcacaacaaaaatctgacaataacaacaggaggtgggtccttttattaacgtcatttttctgatgagaaaaaagagactcaaacaggattccacactcacccaacctctacgtgccagaagcagaactcaaaccctcacatgaaatcccagagactcattccactcatttcatttccctttagatcatatttatcctgccttgtattgtaactccttggcctgtagattcatagaagatctgtttgtaaccctggatccccaccacagctcctacattagctcattgcacaaagtaggtgctcatgacgtctctcacaatttattagtgttcaaagtctgaacagccctgaactcttgaattagacataataagacatttttctcatcctggaagggcatttatttccacttacaattgacttaaatgacagattcgactataggcaaaggataagatttttgctcattatatatatttttttagtcaatactatccctgctttcattgagagcctacgtattcagaaagcaaaagagaaactttttttctttgataatagactttcagactatgtgacttagatacaatgtaatggttttctattgctgcataacaaactaccaccaattagtagcattaaaaactcattattatctcagtttctttggccacaactctaaacttggcttagttggcttctctgctcagtctcacaaggctgaaaaggtgtgcccactgctgtatttctttttctgcagctcagtgtccttttttaagcttgtatggttgttggcaggattcagtcccttggttattggactgaagcccctacttccctgctgcttacgagccaggggccactctcggctgctatagccagtctaccatgtacctccacatggccctccccacaacatggcatcttgattcaaagcccagagaaaaacatttactgcagcttcaaatctctctgatttcttctgtctctgacattgtagaaccttttttaaaagggctcacctgataaggtcaggccagcatgtgccagcagggagtagaaatcttggggccatctcagagttctgcttaccacagaaagcattcacccttatatttaactgtgaaatatctgatttgaaattatttacttcttatttccacagcctggtgagagtcaaagaggccccaggggaccatatccacctggaccgctggctcctcctcaaccttttggcccaggatttgttccaccacctcctcctccaccctatggtccagggagaatcccacctcctcctcccgcaccctatggtccagggatatttccaccaccccctcctcaaccctaaggtccaccactccatcctgatgccccaggttatccacagcctccttcccgaccaagaccctatccacctggacctccatttttccctgtaaattctccaactgatcctaccctccctactcctgcaccccaaatatgaacaactgcagcaggtgccaccaccaccacaaaagacaccactacccttgtaactactgcttctactacccaaaatatgaattccaacactgcttccaagagacatttacataaaattgcttccatttttggatgagaatgaaaaattccaaaagtgctgagctttggggagaaataatcttagaaagaaattgtagaaaaaacccatgcagacataacatttataccaatgaggcaaaaataaagaattgagcaccaa

SEQ ID NO: 1513 - DNA, 31449 bp, Homo sapiens
tggggtcatggtatcttcacaggaaagatttctttattacaatattttgctgatttaattataaaaatacaagggaaatggtcatttcttcccccacgaataccaaatttaactatgaaaatttcattgctgattcgaatgtcacctctggaacctttgttgaaatttaattgccattgtaacagtgttgggaggggcctttaaggtcacgattaggtcatgaggactccattctcataaatgtaataacgccttatagagggaatgggcttctgatgaaaggatgtgtttggcttcatttcctctctcttcatcttacgcttttgcttgccttgctgctttgttatcatgcagtaagaaggttctcatcagttacaaggcagatgtcagtgccatgcccttcgccttcccagcctccagaactaggaagaaaataaatttcttttctttttaaattacccagtctgtcgtattctgttatagtagcagaaaattggctaagacattcatatatagaagtacagagaaattgcttggaaaagttcaaggaggtcaaagcagtttgtactttaattattcactaaattctgtagctctggttaagaaggcacattcactctgatctcttcctgtctttgacttgtaaattactttagcaaaaaggttaatctcaccctctcttgtttcaacatgttgcttttattaaaaatgtaaatttaaaattaccttggcatttgggtcattaattggattaattaacctaataatgctcttaaaattacttttaaaaaacatgtatcaacagaaatgttcccttcttagtctcattctctattttaagtagtcaatatagtacaaaaacactctccgaacatacaagtaggttaaaatttagattttttaatttattaaaaggtaaatttctgttaccatgcctgaaaatatgcaaaatagaaaacatttacttggttatcacacaataataaaaagtcatatagatttttattagttcggaaataaagtatcacaggaaggtcttttttgttttttgtttttgctttttaagttttactacaaatgagtgacagctgtatagtcacagtccttagtttctatatctagaaatttcctttaaatggtttaaagcaatttccaaagttttattaataagagaaactgggactggacagattaaagaatttaattgagaaccttatagtaacctattaaaatattcacctgcatgtccggtttgcacatcttgttgaatttagagttgagtttctgttataaagaaaggtcgtaagttcttttccttctccggatactctacttacacaaataactctttcagtggaatgcaagcttcagtgagtgctccgacacagttctactgttagacaaattattttaaatatggcacttatatatatgtaatatttcatattaatgggaaaaccttttgtgttgatttatgcattaaatgataaatgtgtgtgtttgtgtgtgtgtgtgtgtgtgtgtatggcatttctgagcataagctttattagtgtgaacaaaatatagtaatcattcatgtaatattatatcttgcctgttcagcaatgaaggaaatgaatgataggactttagtgtccccttaatttatttaaaacaatgaaaccagactcaaaagtttacaataggaagaaaatctaaacttcatctaggtatttcaagcctttcatttgacagaatcatcattataatacaatagaataggttaagttaatattaaacaaacgtagatgaattcaactaaagttttggatcagaattctcaaacaattctaaaaattatgctaacacacaaaagcaagcattcaaggaaacatttgttctttatcttgaaatattaatgagcagagatttttttccccatcattgagtcactggaactcattataatgaaaattgcattctgaaattgtacaacttaggcaggtatataatttattggagtgtccagtccacatgttaatttttcacttgactgaagtcttatgtcttctttgtgttctttccacatttggtttggtgaacagattctcattgatcacttgtctctagaaggattatagtaaaaaaaatacaagaccgaaatatgagacatagttatgtttaaacacaacaggaaattaatgcacagtatacattttaggattctacattcttgcagagttgttcttgaatgtaattagtaggaaacgaaaggactctccttacatattagctctattgtcaagttttgtgtaaagaaaaatacagaatttcttagaatatctattctaaaagccttaggtaaagaataaatataattgctctgctcctagtttctacagagataagaaacaaacagccaaacttgtatagaggcaaaatataatgtgaagccagtaaatgataagttgaatcacatatgcatgttaaaatttaaggcatgtgtctaagtctgtcatgtctttttaaataatgactttttttttcccccaaggagaagtctgcacaaaagcttatggccaagttcctctctggttctagggtgtaaaagaagggcactgggctagttttctccagtaaacccgatgctccacttttcctggttggaaggttgaatttatgttgctcctagaaactgcatgaaagggagaggggagcccttgctcttccagaagcagagcttttccagccttcttctatttgggcaccacaggaactgtgcatctcaaacattctcctgtgggaaataggctagtgggtcacatatgcatgccacagtggccagctgactcagattcgcttattctcatttttcaccaatcacagatcatgtgcacttttagaaggttaaaacaatttatactctaattactcctttacatcattagttcttgttgagatggtactgtcattttaacctcttatgcctttggcttataaactaatttagagccatattctataaaagtagaaataaagcattttaaataatctttaataatgtgttttcctatgttttctgtgaggtgcagtcagaattcataacttgtctcactaacatactaagacatttaataacttcacttgcacaaatgtggggaaataaagtgagcctaaagtttggttcttctgactttccactgccattacacatatttgagatgtgaacagagaaccaaagcagcaatcctgctaatgtggaaatgcatacaattctttaagtaaacatattctgtcttccatgcttttactcactcaggctgcccttctgctaaaactaccctgccctagctaatatctatctgtcttttaaggctaatcccaggtgatttcatcttcagaagcctttgatacctgtctcagtctctgggacaagtggagctattgcctccactactgtagaacttgttcactgcaatgacattctgttttttccattagtctctcagcttctaaaggacgaagactcatattggtatatctaatgtgagtgtggtgcctaccccactgtatgcatttagcaaatgtttgttgcacttaactgaattaaactacaaggacatcttgatgcactgtggcgtattaaattgtgccaaacatttgagatgcttaaaattgtatgaaaaaaatggcaggggaaactctaaacaataaatttgtctctagaataaataagtagctaaaaatgtatataaatttcagttcgaaaaataggctttaggttgtaattgctccacttgaaaaactacatcaagacttttttgtggaacaaggcagaatgcagataaaatgaatattttacagatacttgttccagctgccagtccaataacaagataaccttagtaaatgaagtgaatctggcatatgactcaaaaacttccgttgtttcaagtatctgcagattggattttattaatccttttagctgagaatcatatctatgccattcatttccacatagcaggaatgtcttaggattataaacttatgtaacaattactcttaagctttaagaattcacatgataatgtgatgtggcaaatcctgcatataacctgtgtagctgtgatggatcttgaaaactctgtgttctgtgactctaaagtctagaaaacctagactggcccagggttaaaatcgaaatccagaagcatacaggacctctgatctgtcatgatttctgaaaattatgggagtaaaatcagttgattttgtagaaggcagaatgaaatctcttttgcttgagaaataaagctcattccagagacttgttcttagtaactatctcccaaaatagatgtcatttgggtttatgcttcaggcaaagtttaatagaaactatatgctttcttagtgagttcataccaggggccacggtgaataaaacaaatgcaattggctagggatttagacagacagtacaggtagcagccactactcagctcttaggaattggtctcatgctggtatgaaggctctcagcattttgggagtttacatttttccccagaggaatagcaatacttgatttttaaaatgtaacaatttccgacttttaaaggttgacaataaatattcttttcaaaaagcactatgtggtttaatactgttctggataaacaaaatatatccatggcctttcacatgttttgtatctgcttagcacctgggagtggagatgaaagcatgtgccagatggcttgccagtgtgcacaggaggtcatttgggaatgacactatattgataacatgctatattgatatagcattgatgtcagtgctatattgataacagctaacaggcatgaggacttatgatggccacaaatggttttaaatgctttaccggttgtagctcatttaattctcattaaactttgtgaggttgatactatcattatccccatattaaaagaggtttagtagcttgctcagggttacacagctaataggtgttggagcatggattcaaatccaagtctgatttcagatctggggctaattcactatgctacaccatactgaccatagagtctcctatacacataactttgcagtttgggaaatacgaagtacacttggttttctcttttgcttttactatttgattgagtttttttttttttgttaaaaaaacaaaacaaaacaaaacactttgtgtccaaaggagaatctcactatgctgcagacatttctaaaaagtcaaagaagtagaattaatgagatagaatagaaatgaatcataactggttccctcctccctcaaatcagaaagaagtaactcactggtttgatttttttttcctaaaaggcaaaaggaactgcaaatattaacaccaacctggattttctatttcaacagaacttaaaggcacgtctgtgtcaggtgaggggagaggttttacatcagatgggcttttctatgaagaaataccataaaatattaataacacaattttctagtcttaagacagtaaaaagtaaaatgcttcagcttaaaaatatttttttctaaaattttttttcttttggttgaaatcccctttgcagagattttgttattgttgttgttactagttactggtataagcattgatttaaacttgtatttgtgttcctctatagtatttggtatttcagtaggagaaatatcacctcaaacactgatacttacatatttccctgctgtaataaatagtgaaagtgaaaataaaaataaaaataaagtgtgtgatctctgcatcatgttgaccaggacaaaattcatccatatacacttagaaaattctctgaactttgccaactaaatatttccttggctttttcaggttttagaacattgacgaagagagaagacaacccactttgccatatatgcccatgtaagaagatgacttttctcttttatactccaggcaaaaaaagctatcttatattaaagtccttacaaaatatctcacacaagagtaggcattttcagttacttttctttgattaacaaaaagtattatttaaggaagatatatttacatggaatactgaaaatcaattataggattggatgatggtagaagttaactgttagaagtagttaaaaaagaaaagaggcaaaggaacttaatgtagatattactatcatatcttctgatggccccacaattgcagtgctgtcacacctctcagcctttttaaaagaattatatagtggttatggtctcaaaaatcacaaagagagattaagaatagaggatgaatgaaaacacaactgtaccaatctcatgtgactaagtacttctgatctaggattacagagacagtgacagcatcataaatacacacacacatattatgtcttaaatatcgtgaatagaaagtgatagcaaaagttatgcacttcgataagctgtgttgtatggatgtaaaaatagcattagtgggctgggcgtggtggctcatgcttgtaatcccagcactttggaggccaagggcagatggatcacttgaggtcaggagtttgaaaccagcctggccaacacagcgaaaccccatctctgctattaaaaaaatacaaaaattagtcaggcatggtgtcccgcacctgtagtcccaactactgcggaggctgaagcacgagaatcacttaaaccagggaggcagaggctgcagtgagcagagattgcaccactttgcactcgagcctgggtgacagagggaaactcttgtctcaaaaaaaaaaaaaaaaattaaaaaaagcattaatgattcaaaaaaaatcactgatgttaagaattcatgggtggaaatttgaaaaatctgtttcagaatatgtgagaattaagaaaggcaaaagttttattttgtttatttttatttatttatttatataattattgagacagggtctcactctgttgcccaggctggagtgcagtagcatgatcacagctcactgcagccttgatttcccaggctcaagcaatcctcccacttcagccccctgagtagctgatactacacatgtgcaccaccacgcctttctaattttcatattttttgtatagactaggtttcacctttttgctcaggctggtctcaaactcctgagctcaagcaatcctcctgccttggcttccctcaaagttttaaacatatgtaaatatattattttaaatattttatacactaatagggtaaatactataagtagaatcttaatatttcctcaatatccatcaaaatatgtgacagcaagttagacaaaaacttagggagatctttcattgggaaaatgggggacagatttatatttagaggttccctttaattgggcaaatgcaaagaaaaattctgctagagaaacacagtgacttctatgtgtccagttgaaaaatatggaattttatgcagttctgtttctcttttgagtttaactgaactcagaggaataaaccctcttagagctgttcacattggtatttacagcaaaattaaaaactgaattctcacctttatcagtcggcgaataccgtaagaaattaagaggatcgttccaataacaccagccatcaccccaaaaataatgagtgttatctctacaggagataaagagagcagcaaaattatgaaagtctgaaataaatgaccatatagcaactgaaaaataagacagataacatcagcataccatcaccttgccttttaatagaaagcacaattaatatactattatgtagattttgtctttttttaaattgtgtgctttacagtaaccttgtgggaaactgggactgtgagtgatcaagtcttttgtccaaggtcgcaaaatagttgatgacagaactaagacctgaagcttctgattccagacccagcgttcttcactagtgtaactgtagataagaactcagtggacgttctcctcagatatggggaaaaaaccacaaattctcccatagtttggaagttatgagagaaaataatgtcttaatgtataaaagagcattgaacagatcatagaatcataattttggaaagaaactggtataaacagtttacaaatgaagaaaagaagctgaataaggttaacttagccttggtcagacaactagttaaaagtagaattataattataatgcaggtcatctatgttctaagctttattccttccatagtattcttatgcatagtctccaatgtagtcactaaaaatgcttgttgagtcatttatatgttgggaatgaaacaattgaaatcaattaagagatatttccatatttatagcatatttgtagtgcttccagttgaagtaaatagaatggaaggctagacataaaggtaaaatggctcatttatttgcctaattaatatttaaaagccctattgttgataaaaagtaaaagtagcatttcctcttgctggtgttgcccagccttcttgaccacttagcttgaatgtatgcgatagtgatgaagttctatgatgtgctttttaccctgtgagccgtggacacagccaagtgtgaagggagggttggaatgcagaatagcaaatgagcacacacagtgatactcaagtgaggggaagggatgtcccttcagcagaggttgtcaagatggtccctaagtggttgcattgggccaaaaatgaatcaaggctgagatttacccttgaaatacagtaccagttaattagatgattttaaatgccttgctttttatatgagggaagttcatttgttttataagctcttatgaggcttttttcaagtactcaggcttggttagaaaggtaaaacatctaacttaagagaaaaactattaccaaattatgtatttctatttccaaaatgtttttatttatttttatttacttatgtatttgtttttgagacagggtcttaccaaggctagagtacagtggcacagtcatagctcactgcagccttaaactcccagactcaggcaatggatccgatcctcccacctcagccagcctcccaagtagctgagactacaggtgcgtgccccatgccagctaatttttgtattttttgtagagatggatttcgccatattgcccaggctgttctcaaattcctgggctcaagcgattagccaggctcagcctcccaaagttctgggattataggcatgagccacggcccctggcccccaaaatgtttttaaaaataagaaatgcctattttaattttaaaaagagaatattttctttgcctttacaattttgtgtgaataaagttaacaacatatgctcttctaagatagacacattttcttaggcatttgaaacaagcaatggatagtttaaaatggaatgacttttattctttgtcaaatattaacatacctggttcagagaaatgatgggcaagttgtaccctttctcctataaagcaaaatttcaatgtaagtccaaataagtaaggcatgtgcaaagaaaaaaatcattttggaatcaaactgttctgtgggtttccttttcttaatcatattttgagagttgttggtcaactttcaacatctagctagtaacatttatgaggtaatatgtcagtcgtaccattagtaatttcagtatctacttttaatgacccaacaagtattcatggatgagaaataagcaaattgtctcataactgagggggaaggaatgagaaagtattggaagaatcacttattgacttccacaagaagcaatgcatttttaaaaaatttaaaaataaggagaagaaaggaggcatatggaaccattactccacacagatgccagtcccatgcaaagagggatcatgcgactatcaattttctgatttatgccacagccactgtctgaatctaaactgttactgtgtctcatttgagcttttgccaatagtctctctggattctatgtcagcagcaattgatagtatggttgccttactgttccacctgtgctaaccttccctctcagtccacatcctacttttgtctctgtctccacttgccattttacatcatgaagctctcttactaccgaagccacacaattttctagagtttaattattacaaattacttagtatatactatgctgtttgatgattgaggattcaggtatattttttcattctttaggctttacgtacaaaggttaattggggcttgccttctctttcttggtcacagttaatagttgtgggtgctatatgggctttggagtaaaagagatgggttttctgtcacgaaagcttgagaactgtcatgagttacagctcgtgtaaatagagttcaatcacaacaatgactccagagcaactatttaaaactaagaacataccggtttcctcttctggagggtaaacagttctaacagaaatttctgaaacttcatgagctctaggagtggctgcatatgtgtcccgtttgtgcgtatctgcatataagagaagttgagaaagggcacaagaatgaggtgactgcgtggacatagagcgtattatgaaagacaaactctcccacatccctcccagcagcggctccagaatttcttcttctcccctgaaaactaacaagagagactgccaccagattactcttatctcagcacccagctttgcttattgtttatcagtcactgagaatgtgtgaggctctgagctaataacttttagatacatcttcttatttagcctttagagaaatgctgtgagataagtactgtgttattggccccattttaaaattaatgggatagaaaccctgcagggcaactcaccctgggtcagcagctggcatagagctgagcccgggtctgagctgaactcagtttgcccacagaccctccgcaccaccgcactattaggtcccctttatctggcccactatttcatggtcacgtgcatcatttctgtgctttgccacattgttttaatttctttaactcacagtattatttctgtgagatatttcagaggcaagaattcctccatagtaggaattgtgtctacttagtaggctgtgtctacttagctcgcatttctcagtgtttgtcagtttctctgcagtgacaggtcccctaaaatgggttacatcacaaaaatgatttcggagccacaatttaaaaataaaaatgaaaacaaaccatttgtctgtgatgagatgtaactctttgtgactgaagaagaagttgaagtgtgcattgccacctcagtggtacttaatgctgatatgctcacaatttctgtataaaatagaagttgagaaagggattaagaacgaggtgactgagcggaccataaagcatattgcaaaagacaaattccctcacatccctccagtccctgagctaagcgctttggtatatatcttacataatgtttagagaattgctatgtggtaagtattgtattattggccttattttaaaattaaggggccagaagcccctccagaatttctgcatagcagaggtttacagataaagcgtgccttggttttctcatctgtacaataataatacttgcctcaaaatgtcattgtgagaacgaaattagtttaaatatgtgtgtgtatgtggtgtgtgtgtatgtaatgtgcatgtgttagtatagtacttggcacataaagagcattacatatatgttgggtattattgttattatgcttataaaggggtaacttgaagttgcattttggaaactgtctatgctaagaaaggtggaagcgcataataattatatagaacaaaacttctgtcccatatctcagtgtctccatctgctagggacaatcttacttcttcaataaaaatggaaacaataataaaacactattacattgtgtgaacccaggaggcaaagcttgcagtgagccgagatcacgccactgcactccagcctgggcgacagagcgagactctgtctcaaaagaaaaaaaaaaccatgcatgcaaacatgaaatcagaatgtagactcacatatatccttttaaaatctcattaaataaattgtgaattatttttgtaattaaacactttttattcttaaatgcaatacatttcaaatttataagttattttataaaattttataaattaaattctttaaattgcaaaagtaatatagattcagtaaagaaaatttgggaactacaagaaagcacaaagaataatataaaattcatctacagtcagcctatgcaaggttgaacatttgacacattttgatatatagccatctgaacttttagttgttatatctaaatatgggatcatggtgtttaaatatacgtgaatatgtatataatgtttacaagtctgactttctacttaatatgccacagatatccctatgctgtcaaatattcttctatgagaagatttttatgactgcagagtattccattgtatgaatgttctgtggtttatatttcaatctcctattctgtgcattcatgtgtttttcactcttctgagagttataaatcattatgataaaagtcagtaccctgaactctgtagatgtacatttgctcatctcttggagatattcaactgaggggaatggcacccaagtgcaatggagtggaggtggaagggcttcttctcagaggcagccaacttggcccctcagctgaatgctcaaagtttcctggagaacccacaaacaacagaaaacatcttctctgacacctctcattagtctacccaactgaagacttctaaaaccttcctctatttatcagctgataggtaatcagtttacctccaaatcatggagaagacatgatctattgttcctaaactgtctattttttctcttctcttttaagttcttttctggccttgctctttaacttggcctgccacctgattccatcatgtatgtataaacgattgccatatgaattcactaaatagcatgcaaaacaattactgaatgtttctaagttgttcagcactcaggtataatggcttttaagataatataaaaaccaatgcttttaaacaataacctggtgatagggattttgaagttcaacaaatattaagattaaaattacagaaagaaacatctttatgagtcaactaaagtacgtaaaaattatttataaagataactaatgaacaaaaataatccatctctcttaataaatgttagatatgagctttggcttatttctagataatggaatatggaccttctattgtatttttgaaaaggcatacaatctgagtaaaataggtttagctatgaaagtgttgtgaaaatagctagtaaaacaacaagccaaaaaaaatcaaaagtgttaatggccagaagccttaaatgggcatgtaacaataaacttgagatcagcctttggctcagcaacatgggaatacaactggaaaatgcagctggagctctcatccttcactcaggtgtgctcgtcacttccatttctaactttcatcctctccaagcttctccctttaatcttccactccttctttacacctttcagttcagtgtaatccacttacatttagggtgcacatttcttagccctgtggataccaaatgggctcttctgaaacataaaacttgttcctaggacttcaatttcccattattttgaatcttctcagcatgagaatagtgctttattcataaaagatgttaaatgaaatgctaattgttataaatgcttggacaaattcttacgtagaaagaattaggtgagtggtatggtttggatctgtggcatcatccaaatctcatggggaaatgtaatccccaatgttggaagtggggactggtgggtggtaattgaatcatggggctggtttctcattgcttaacatcatcccccttgatgctgtctgggagatagtgatttctcataagatctggttgtttaaaagtgtgtggcacctccccactctctcttgctcctgctccaaggctctctctccccactctctctcttgctcttgttccaaccatgtaagacgtgcctactttcccttcgtcttttgccatgattgtttcctgaggcctccccagaagcagaagcactatgcttcttgtatagcctgcagaaccatgaggcaattaaacctcttttattttattttattttattttattttattttattttattttattttattttattattattatactttaagtttttgggtacctgtgcacaatgtgcaggttagttacatatgtatacatgtgccatgctggtgtgctgcacccattaactcgtcatttagcattaggtatatctcctaatgctatccctcccccctccccccaccccacaacagtctccagagtgtgatgttccccttcctgtgtccatgtgttctcactgttcaattcccacctatgagtgagaatatgcggtgtttggttttttgttcttgcgacagtttactgagaatgatgatttccaatttcatccctgttcctacaaaggacatgaactcatcattttttatggctgcatagtattccatggtgtatatttgccacattttcttaatccagtctatcattgttggacatttggattggttccaagtctttgatattatgaatagtgccgcaataaacatacacgtccatgtgtctttatagcagcatgatttatagtcctttgggtatatacccagtaatgggatggctgggtcaaatggaacctcttttctttataaattacccagtatcagttatttctttatagcagtgtgagaacaaatgggttttcagattgcatctgaatgtgaatataataatttaagtaattaataaatttaacttaattataacacataattaattataaattaatcaatttataattaatatatttaattaatacaattgtttaataaattaagcaaaccacatgacaaaatagcacatgcagaatgaatgcaagcatctggaaaaataagcatcattttaagaccaatgaaatattttcaacatttcaatagcgagcatacttttgctaacataagaaaaaaaaaacaaaaagtaaaaaataaaaatacacaaaacgtagtctgtaaatgccatctagtggttttgactatgagtacaaatatacatattcctccaagttgcctaactgttcagcacgatgttagggactacctgctgcaattttctttgtgaacatctgcaagactctgcatggtccagtcctgcttgcctcacatcttcattgcttcgcccttcccttccctcttggggctccagccattctgcacatctgttttctctatgactgcaccatacccttttccgtgtcctaaatcttgtgccatctcctcccttcgtctgaaatatttccctccctatctttgcctaactactggcttttcaagtctcagttcaatgccacttcctttgggaggtcttcgctggcctctctaataagatttagactaaaagctctctgaagtccctggtgcttaacatggtgttgtaaaaccttatgattatttagaatccagatatgcattccttaggccttgatgtttactgggggccttgggtgtttcttaatttgttcaattatttacaaaaggttttttttggggtgggaggtataggctgtgggctatgtactaggaagacaatgataaataatacatggcctttcctttcagggtaattccagtgcagtaagagcgacaattattaatctaagtataataagtattttaggatggtggtggaagtggggacacaaaggagacagcggtcaactctacttggagaggtagaaagacctcatggaggtgtctttgaatttatcttgaaagaagtctaggattttaccaggcaggctgtgtggtaccagcaatgccttggaatttgagacatcattgcacgttacaaaaactgcaggttatctatgtggctgcagcacaaggtgtgagaaggagaggaatagagaaatgggtgaacagcaactgagaggctgaagaggtggtgaggcaccaaatgctgtgggccatgttctagaatttggactttatctttaaggcagtggaaagacaatgaatggtttgaagcagttttttatttagggaaaatcactgtcagtagtatggaggataacttaggggaaaaaaaaacatgccagagctttgcagtagagggtcccatcttgtgttcaagagtggccaagataagcagtccctttgcaaacaagccacttctgctcacagaaggtccttatcacttcttaatattcctttggtggagaaggcctatagcctgaggctttaaagggggcagaaaattacagcaggttgtcaaaagaatatggcaaagaaccaataatgggagctaacatctcttaaaattggcactttaattattttaattttaaatgaagtcagaggaggtgaaaagtattttaaatttataagcaaagtatatgtaacttttttataaaaatgaaaacatgcttagggagagagagcttatttagataagttttgagctttatcaaaacaattgtaacactctagcaaataagtagacttctttcttcttcaacagctactcctcacagtaaaagagcacttggtggaaattttgttctgaagtgaaggctgaaaccccagagatcaaacactgtactcaagtttacaaagctggactcagaccctaacactggctttaaaatttgtcctaagttagaccataatgcctctctttccagctggatctacatgcctccactctggcttttaacaaggctctgaactattgtcagaacttgggaatttctaacattgaaggtaacacattgacacaatttcctcgatgtaaaattgtatacactttatccaagtcccatctgagcatgttatgtcctatttgtacccttacaaaaactgattggtggccaaattgatttgagactgaaagttgccacttatgttcttagaaatacttgctttaattcaccagaatcagttgctctgatacaacttcttatagtcacctaagtcaacatagtaagaaaataaacatataaatgccctaaagataatttgataaaaattgttttttatatcatttcctcaacaatctcatagtggtagctgacctataaaatgacctttttcatagttcatttttcttccatttctggaaaaaagatagcataagtctttcagtaggaattaatacccatgcatgcttagtggtaagaagaaggcacagaggcttgttactggaagtctatagtttacaaaacagtgtcatcttgaaggaacaatagctcccataaaaatgagttttcatattttcttgtattaattaacttttaaataatttcgtagttattccagagtagaatcacatgggggcaatttaaagaatttcatcaataccttcaaattaaataaaccagcatctggttgaaaaaaaaaaaaatcacttacctggaaggagaaaccaaagaaacatcctcaaattctaaagcttcattcaaaattcaaggtaaggaaaccaaatttccacaatatgatcccttaaaatcaccaagaatgttcaaaactacatttgataacaacagctcacacaactacttggctctcctagattcctaagaccctaaccagctaatagacgtctgtggacatattcaattctgcaaagctgcaaaatatctgtgagaagctggtttttgaataggactttttactatagctatatactatttagttcagtaaactgggtagaaagcattgaagcaaactcgtaaccattgaacaacaaactttagtttgccaaaactgcttagggactggattaagggaaggctctcctgttatttttatctctttgcctttggtgctctcagctttctgtagctaaagtagctttcaaaaatctacttgtgtcattcctagattaaaggtcagtttaagtattgtcctgttgaattcagaaggtacatttaagctagaaaaccacttgcagcacatctaatccaaattgccgactttacagatagacatttggtctcataaaaattaaatgactagctcagatcagcatatctggtaagcagcagaactgagacttaattctgctgaccctcaatattagtctcaccttccggatctcgctgactggttgagatcttgtcagcaagatttctctaatgttttagtacattagtcagcaagcattggggcatattgtacatacaaaaaaggacagctaaattcctgagctccctggacatcctaaaagctagaattttagtaaaaaccatgtagtcttcattttgatgatttttccacactaatttattgtattacttagattatatctcttacccctcagtgtccttatactatagccactatgagaaattatgttttgctctagcaatacggagatgagagtcagtttcttaatcccttcacatcttctggcaggaacacatccagtctatacctgcaaaatttcacctctctctccaagtgaagtatatttaccttgtggtgttatgaaagatgtgtccagcatctggctacccaggaatagacagaccttgtgccaacactgcacattttcttagctgcatgggcctctgagaaacatactctgaagaccttaccccatgcctgcttgcaaatgaatcactggatgaaccctgaaggatgggcagagttttaggtgaagatgcagaggaggagggataaagaaatagcatgggcctaacatatggagaaaggggagtataacatgcattgatgtggaggcttaggtcacctagcaggcaagtgttggcaaatctctcagattgataagagtttaatgattaagtggcaaattactgcaaaataaaatataaaggtatgttttgtcatattagtgaggcctcaaactcctactttaaatttatgtttttcagttttcaggcactgaaatggcatttgctatggtacttagtacaaagtaaatctgtgtgacctgaattgaattctgtaatttaggtttgagaagggtggaatgaattggtatactttctagaaaatgaaatattcaatatttgcgtttggatcatctcacagcttatacttgtataacatcggatatgttccagaacatttcacctctcttgtctcttatccccatgtgttgggggagagagcgtggacttctgccacagttcccattgtaccatggaggtggggtgacttgggggcccaagacatgttaggataacgactggaaatagccagcctcctagctctctgctgcatgctttatctaccagaccctcagctttcccaaataattgacatttctaacctggaatgctattagaaacaataaaaataaaatgtgatattgtataagtacgcttcagtttcgctgtatgccaaaacttccagtggctgagctcttgtcaagatgtgataaagtcagctcatgcagctgctgctttgagttttggttcgctcctgacttgcagctgaaagaagccttatcttgcataagcaaactctcacaaggacacacccttcatatgaaatgccttaaatagtttccaagtctgaaaactaaattttctaaatgctacagttttttggcattgcaatgaccatgaaaactacttgataaatgcatctgtggaagttatgctcagctaatttgtggtaaaactgggataaaaactcatatccattgacttccaactcaatgccttttctgcccaatctcattgtcttgaacagaattaatgtataaatgggaatcttgcctgtgctaaaagatgtttgaagaagactgttcccatgaagcaatattttaagggaacgattttgtttggctcttgaaccaaaggattggcaagttcaatcttggtcaagttgtgataatatagttagatacccatactgtctgtggccattcgtttttcttttttggaagtttttattaagccaaagcagccaactacaatttagaaaaattgaacttaaggataaagtgctttgtgtgatagcatctgagcctactgttttgggtagcctattctcaatactttttatttgatctcttcagccaatggctctggagaaaagcatggcctattaacggatgcagttagtgtgctaggtgccaaatggaatgagccagtttctgctcatcttcagactggcatgctttggcagtccccatacagctaattggtcacacttcttcctttcctaacttggtagagaagggtgctttatgtattctatctcgaaggtgttgtggcctaggaggactgcagcttcccttcaggaagcctgaactctttagcctggctctgtactatccagcttctggtcatccacactgtcccaaaccattgctgagacagcagaggtggagaaaaaaagtcggtcagtctgtcattccagccagtgcacattcttcagcctggacagatggaaatcaagacgaatttcttccactgtcccagtgggaaaggagagcagagttctcttcctggctttgccaccaaatggttgggggatctgtgcaagtctctgaaattatctgagcctcagttttatggcctctaagatgagagtagtggaacagatgtctctctttttaaactttaaaaaatgttttgcttttttcttgagatagggtttcaccatattgcccatactagcctcaaactcctaggctcaagcaattctcctgcctcattctactgagcaacttggactataggtgcacaccaccatgcctggcctggaatggatgtcttctaagatgcttcaccattcatgaatcatggaaatctgtatgtctaagataataatatttgtagttaacacttactgcacacttacttcattccacacatctctctaaccatttttaaaacaactagctgagaccctattgttatatgttaattattctttgtggaggaggaaaaaaacatcagaagcattgcctgacttgcttaagttcacacagccaccaagtggcagacctggattttgaattcagacctatgtaactacagaactgtctgccaaggtctactgtgatctatgtagcagaaagagaatgagggaatcaagtaagttgtcattgagagattaaattctcaccaaattataatgcaaccaactctcaagcgagccttcacttcagcaaatcagggctaaatgaagagatataaagataataattcaccttgtttatagcctgagggtaagagtgttgtacctctaacatagcattgtagggtgacctgcagtggcaaatccacattacggaagagcagatggtcctggttattaacagtttgttaacttgaatcttaatttttccagccaagcatattcctatctggtcactcctgcctactaaagaatcctcagaacaaaagaggatttcacatattttacctgtgtccgctttagtctaaggtttggtatttctgtagctgaacttcacacacattaaatttgggcttaaggaagttgggctggatgaaaataattttaattgaaaacaaaaactttatcccaaagttctcacaccactggtacttccttttcactggttgaacaataaaaaaattgcagaaatgaacctagtttgttctcatccttgactgcatggtagaatcatctgtgatatcccaggaattggattctgatgtgcggccagcagtgagaacaactgctccagttggtaatatagattaatatatgtaaacttcatcttcctgagtttcgaggtccactcttacattttctatggttgtagtgtcacctttatctataaagtgaacagctatagtatgtgatattagcctgaacgactttagaaataacatcatttgccatcttaaatgttggtgtttcttagggttttgttttagagccacagtctccctcacttcctccctcaattcgcatttaattttactttaatcactttccaaggataagctcatcagtgtgtgaaacagacagagttgaactgcttggtggaagctggcctgagtgtttggcctgcagcctcacaacctgttcccatctccacctggcagcttcagaaagctccacaggaatttagattggaaatctttagtctaaaacttaagtttttcagattgtctgttgagatcccttagcacaagtattagtaaacttcctatgtaaagggagagagagtaactactttaggatttgtgggccacaactactttaggctttgtggaccatctattacaaatattcaactctgtcactgtgcaaaagcagctacagacaatatgtaaaccaaagcataaataaatgagtatgactatgttccaataatgatttgtgggcagtagaatttgaatttcatataatattcacatattattattattattttgattttttttgtgtctttctttttttttttctttgagacagaggcttgctctgttgcccaggctagagtgaagtggcatgatcttggctcactgcaagctctgcctcccgggttcactccattctcctgcctcagcctcccaagtagctaggactacaggcgcccaccaccaagcctggctaattttttgtatttttaggagagatggggtttcactgtgttagccaggacgatctcgatcctctgacctcgtgatccgcctgcctcagcctcccaaagtgatgggattacaggcttgaaccactgcacccggcctattttggtttttttaagcacttaaaaaagtaaaaatcatttgtaacttgtaaggtatacaaaaccagggggccggccattcacaggctatagtttgcttggcctctgtattagcataactagaatctctggatatgaaacccaatcatcagtgctacatagattccctgagaaaattccaaccttcagtcaagatggtgcattcctctactaatgggttatgaaatcagtccagtgggttgtcactggcactaaaaaattaagttgtattctaggtgtggtggctcatgcctgtaaccccagtgctttgggaggccaaggcaggaggatcgcttgaggccaggagctcgagaccagcctgggcaacatagcaagaccccatatttacaaattaaataaccaaaaaattagtcaggtgtggttgagcacacctgaagtctcagctacttgagaggcagaagctggagaatcacttgaatccagcagttcaagactgaagtaagctatgactgtgccgttgcagtccagcttaggccacagagcaaaatcttttctctaaaaaaaattaagttgtataaaacaggagagaatatatcaaagtacatcacacagaataagggaaggtattattttgtggaattttatttcagacaagtgtgtgtgtgagcctgtgtgctgtgagttgtagtgcacattaactatgtctcaataatacttgattatgttttgagcctgatgaacctggttataccctatctgaatacctggctgccagatcaatagcatatgaaataccagaaatgcactcaccgcctgcacaagccattgaccagtggctcatgcacacctttatccagcttatctagctccagaaagcacttagactttctatgtgtgctgcaccactaaaatgggaattctgagagagaatgctttcaaaaacataaagttagctaatgggacaattacacgtaggctatatactttagaaacacatgaaaggataagggcaaataaaacataatttatatatcaaaagagcagaaacaaggaatcataaaatatgaaataggataacagaaataagatactaaatgtcagttgtgaattaatgaatgcatatggattgtggttttgtattaaaagacagaaacttttagattgagtcaaaagagataggttaggactggtgcaatggctcatgcctgtaatcccaacactttgggaggccgaggcaggtggattgcctgagctcaggagttggagaccagcatgggcaacacagtgaaaccccgtctctactaaaatacaaaaaattaactgggcgcgatggtgtgcgcctgtattctcagctacttgggaggctgaggcaggagaattgcttgaacccgggaggcagaggttgcagtgagccgagatcatgcaactgcactccagcctgggcgacagaacgagactccatcttcaaaataaataaataaatacatataaaactaaacaggaataaccgtattaatcttaggcaaagtagaattaagagcaaagacattacaaacaatgaaaaagatttacttgtgtcattaagcaatatatttcacagtgattcttaagtaattatggaccattatagcccaataatatagcaacgagaaacataaagcagaataagaaattggcaaaaatacaataccattgagaaattttaagttttctccaattgtgatagatcaagaaagcaaaaaaacaaacacagaaaggatctgaaatatatctgcttgcaatcacaaggtattgatttatatgatttttgctaacgaatcaatgaggacagattttattaggcattcccacattcccatacactcattttgaaagaacatttctgtatttcctgatacaatgtttttgaagtctgaatctagcagaatagttcaggaaaggtagcaaggggagaacttttgtggtctttttcctagcaaaatgcaatttcagtgccatgatctctattctcagttgcctcaaatagctgtactattcatgttttatgttttgtatttatttccttctattttggcttttaaaaatatagtgatgactgggaaataagtgataacatcaaaaggaggcctccaggatttaaaaacattttctatagcccatataaaaaggagcaaaaggctaacataacagccacacagttagagttccttagctgcaccacgtgaggaagacagaccgtcaaccttcattaaagtcttcagcttggtgaaagcacaggcagaacactgagtgacaatgttgtaagagtaaaggagccaatcctggaacatcactaggtatggtacaggcaacatgacatattctctaagtgcacagattctgcagtggaactgcctaggctcaaactaattcctctagcaactacctgagaccttgcaaaatttacttaatctctatatttttgttccatcattatacatggattagtctctaccttatagagttattgaacaggttaagttaaaatgcacataattatttttttgcaagaatggaaaacctaatcctaaaatttctatgaaattgttagggatctaaataggcaaaacaatcttgaagaacaaagtttggtgaatcacacttcatgaattaaaaacgtataaccaagtaacagcaataaaaactgtgtgattttgccccaagaacagacatattcttaggatagaattgagactccagaaataaactcatatatccatggccaattaactttcaagaagggtgtcaagaccattcaatgggcaaaggatagtctcttcaacaaatggtgctgggacagctgcaaaataataaaggtggactcttatcatacatcatatagaaaaattaactgataataaaccaaagatctaaatataagagaagaaatacaaaactcttagaagaaaacatagggagaaatttttatgactttaaatttggcaattatttttagatatgatatcaaaagcgtaagcagcaaaagaaaaaaaaataaattggacttgaaaatgaaaaacatttgtgcatcaaaggacactatcaaaagtaaaaacaaaaatctacagaatgaaggaaaagatttgcaaatagtatatctgataagactctttatccagaacatagaaagaactcttacaacttagcaacacaaaaagaaaaatagattgaaaaatgggtgaaggactagtaccaacatttctccaaagatatgcaaaatgcagttaccaacaattacatgagaagattctcagcgtcattagttattaggaaaatgcaagaaaccacagtgaaaaaccatttcataccctctgaaatggctataattaaaaaaatgaaaaagtacaatttctggcaagattgtggagaaattggcacctcatacaccctggtgaaaaggtcaaaaggtgcagctcctgtggaaaagagttgagcagttccttagtaagttaaacataaaattactatgacccagcaattctacccctatacatctttgagtattaaaagtgggttcaaacaaaactagtacaggaatatttatagcagcactattcacaatagccaaaaggtggaaacaacacaaattttaatcaaatgatggatcgataagcaaaatgtgatatgccaacccaaattttaatcaaatgatgggtggataaacaaaatgagatataccaacacaattataaaaggaatgaaatactgatacatgctacaatatggatgaactttaaacacattattttaagtgaaagaggacatacacaaaaggctacctattatatgattccatttatatgaaatatctacaatgggtatatctgtagatgtagaaaacaaattagtggtttccaggggctggaggaattggaagtggctgctaatgggtaagaggtttccttttggagtgatgaaaatgttctggagctacataatggtgatgggtgtgcatcattttgactgcattaaatgctacccattgtacactttaaaatggttcaaatggtaaatttatattatgtgtattttactacaattttaaaaattaagtgtatgtaaattgcttagaacagtgcacggcacaaagtaagtgctattatcagtgttggttattattattcagaacctgcctctgtatggaacctaacctgctgtatataaatctagggatggaaataccaaagttgatcaaatagctgtttatagaactttgtacactacaaacaaagatgacatcatttttcccgtgcttacatataataatttgggttagacagaaattcttaatacatatcacaaataaattgtatagtcatagtctatgaccaacgtacaaaaattaaagacttcttagaaagcagagattgtgtttgttcggtttactttttaaaatatattaaaacttgtcctgattagattatatggttctctttgcagaaaatttagaaagtatttaaaatgagaaaaaaaaaccttgcaatcccaacactcagagataaacctggaattttttttcaacatttttgctttagttttagtttagttcatttatcacagaaaactacacagataggtacttactaaagatgtggatatgataataatggctggaaatctatgatgtaaaaatgtaggtccagcctgattttgtcagcaccatgtaagtaggattgggttttttttgagtaaaagatattacatttgcagttgatgtcaaaatataatctataaagataacttggggaaattccccaaaagtatacttctcaaatagtctcacagatgttttgaataatcttctagaaaccaaggtgaaaagaaatttatcacaagaatgtgaagctaaatttcctaatttaaaatcactacaaagtaagtttgagataccatccctactttcccctctattcagaccttttctgcaaaggagttcacagtgggtgtctgtttctttctaaaaaccctatttcacaccatgctaaagatatttataggtttggcaactagtccagctcatctcaggctgaattttggggattcattggggtttacagttgaaaaatgcttgtagataccatctactcggcgctttattgaataggcacaagaaaactgaggcccacgggtgttaaatgatttttcatggctaaactagtctgccgcagaattctggtcatttgtcatttgtcattttgagtagttgatattgactgcctactatgtggctgacaatgtgtgggacacataagcgaagacacaggttttgcttttaaagaatttatagtcatgtattccctggcatacagttcctgtaactctttcctgtgccaattaaatagcagctagcaaggctctcttcttggatccctgaaaaaaaaaaaaaaaagagatgccttgtttcttcacttaacatgtgcttctcagactgatgtacttgcaggggtatgagtcagatgcacagggtaataatgatctgtctatgcggagcactcactgtgtctaaccagatgaaaacaaatatttcctctttcctttcctcctccccttcctcctgtctcttcccttcccttctctcttctcccttcttgcctccctccctctctccctcctctcttctttccttccctttttccttttctttcttccttcctctccctctctgcttctctctccttctccctcccttcacctccttccttgcttattcaaccaatatgctactataaataccaatcgggaactgtgctagattctggggatacacggatgaataaagtaggcatgatgatatcataccagtgcctttgtttcctccaattaaattagtatattatgacctagaatgcaaattttgtatgaatttttaagtaaacacaaaaagcttttggagactcctggtttatgccataatttcctagtcgaagtgatattgtattgtattttcaaattggttcttagcttcagaatctgattttcagataaaagctccagcttttccttgaaaacactaacttacctgctgtttcagaatttttgctcttgctcttccctctgccttctgtcctcttttcccagaattttcagggttggctccgtctccttgttccacatttagcataaatgtcatctactcagaaaataactccctgctacccttttcttaagcagctttcggcattcatgtttatcatcttacctggttttatatgctttgtattagttttgactgtttttatcttattttaataagatagttgttgttccatttattatctgcgttccctcccatcatccactgcgcctaccctccgtgtatcctccatgggagcccatttttcttcctgctgtgggctcagtgtctggttcacaatctgacatgtaatgactgaatcatcaaatgagtgcaggaattcagggactgggaatcaagtcatattagaaaaaatggattctccatttggaaggagatctctggtaagtttagaattagaaatattggctttattcttaagattcctggagaaagcaaggcaatcatctttttttttatagcaacataaaagaaaaagaaaaagacttcaccatgtttactcttcagctaatcagtatgggggaaaaacttgatcttacacctttctgttatactataaagtagccacatcaagagagtttccttggagggtttctgaagctacaaagatgataacagcttgggtactggagaccattgtagctttcagggtcatcttgccccagtgaccaagtgccatttaaggctttaatacactatctgcttgtgtagttgtagaaatttaaaaaaaaaatcatttctttgccaggaaccctttccaaatttggggcacttgtaagtcacacagagttttcccaaatgctgggcacacccccagtagagtatgcagtgtctaattttgcttgagttacatccagtttggtttgccccatggagcaacacaaagaatacatctttttttctgtgtaatagcacttcaaatatatgaatatatatacaaatattacactacatccctttcatttgttttcttttcttcaaactaaatgttttcatacttttctgcttaaaaaattagagtagctatgtttgttttctgttttctttctgtaattttcttttctctctgacttttcagaaatcaccaatcacatacgtaggtttgttccctagtctgtaactattgatagctactgcttattttaataatatattattaatactttttaatcatgatagttaattctaatcacagaaaatgcatagtaatcttaacattttactttgtttcaggcatcagtaagtgtattccattaaatattttgtttaatctttatgcaattattatgaggtaagtaccaacactgcctgcattttaaagacgaggacacataaaaatgtgggcacataatttgccttaatgttccccagccttgagaagtaaaagtagatttgaacccagttctgtctgttcctcatgcctgtgctcttaactattgcactattttatcctcccctagggtatcttagaaaatgctgatctctcctccctgtgtgctacagagtgctcagtagctccttgatacttgctctcacttgggatacagcaatgtctaatagactcagaatgtttcaagcaactgcctgcccgctgtgtgctgggcactagtattgctaacacataagcactgcacttgagaggatgtttaactataatattctcagaaagaggccaaaatcatgttaatttaagacactaaattaataattaaatttaaactaagttaaattcaaattattgaattaatacaatttaataataaccctatgatatttctttattttaatggatttaaatttctcctaaaattcacaggatacctaagccagtaagagttgtttttgttttttttcttcctatgtgacactttagtaatggacccacagagaagcgaacaactccccacggtttcagtgttcatgcttttggcttctcgccatttggcagaaataggaaattataccttttgaaaactaaaagccatatagctaccaacatcttcgttaataactctttagtttggaaatgaatctccttataactcaaacaaagcaatacatttattcacagagaggtatttctcatagcatttgataaaattattttaattctagctagacttagaattgaagtaagcttctcatactagaaaactggatttggccataaatactgggctcccttgtgccatttcccccacattggtagctgagttccagtaaaatccatccaccagactggaagaggaaatactactcatttattgatttaaataagatagaactaaaatagggtagttcatattttattctatgatctcatacccaatataacagaaccaagatgaaataaaatcacttacctgacaatagtaatacaaagattatttttccatacatcctgagatcatgagctggttcctgaagttagtgcaaaaaaactaccaaagacaactgcaagtgtcagtgtctgaccttagcctgctagctgttatcttccaggcccaccttcctgc

SEQ ID NO: 1514 - DNA, 13982 bp, Homo sapiens
cctggaacgctttttattgggttagtttacacaaattctttcaaagtcttgttctccaactttctggtgtctcgtggtcttggattttacacacagaagattaagggctaacagtagcatcacaagaaggaccatgttgtaagatggtgagggagtctggacttgtgtctccatttgggatacagagggaaaacacaggcctgagagctccttggaaggcgcaatgggagaaattgtaaatgagggacatctcggtcacattgtagaatgatatctgcccgtgttcgcagtcaaggaaaacgccaactgtgtccaacttcttttccaggaagagccttttcagaggggggaagacccagagagtccactcggtccccatcaccgaccccgtgagcaagactttctctccggaagctctggccgtgctgcccttcgcgtctgcagagccgtggtatatgcccacttgccacctggttgccttttccacgtccacctcccagtagtgcctccctgaggtgaagctctccgcagccagcaccatggcactgaaatccaatctttctgggttgccagccccatcctgctgcccatgtctcaatctcatagttctcaggtcctcagatagtgccaggcagggatgagctgtttcaggatccaatgttaaatgtcctatcaggagagaaaaccctcgttaacctaggagttcaccaatgccaatgccagagacatgatttctaacacacctgggcttcccactgagtgggcacaagtcccaggcccagatacgggagaggcaatttgggagggtccaggaaaaggaactgctgaacttcaatatggacctcatggaggaaaaagtccataagatatggaaagggacacagtctacctgagcgggaagaataaaacaaagatgaatgagctaaggaaggtttagaaacaccttcatccaacgtggcgcggtggctcacgaggtcaggagttcaagaccagcctggtcaagatggtgaaaccccatctctactaaaaaaatacaaaaagtagccgagtgtggtggcaggcgcctgtaatcccagctactcatgaggctgaggcagaaaattgcttgaacccaggaggcggagattgcagtgagccgagatcacaccactgcactccagcctgggcgacagagcaagactccatctcaaaacaaacaaacaaacaaacaaacaaacaaaaaacagcttcaccccagagacggtcaaactgtcctggtgccaagttccatccagatatcacttggggcccaaccctggtcttctagatctccaagcctggagcggccacaggagtcggccagcagcaactcattcgtggccctcccgatgccgtactctacacatcttaaatatccccacagggtgacatagaggcctggaaattgctgacaacaggccctggacatcaggcattacatcagataatttatcagcggaggatggaacacctgtgtggaccctccagaaactcacgctgagaacacgcaggctcaatgaattcctcacacctgcatgaatacgtcttcttcctatctctgactgttcctctcatctctttctgcccagcctctaactattgtgatctttcagggcttggtcctgggacttcttctttcaagtagtatattctccttcactgcccccaggtaactgtgcatagcttcagttttaaacatcttctctgtgtttgtgactcgctccataaacagctaaataccagttggaaaaaacacaggaatttcaaacataacacacccaaaatggaacttcaacgccagccctctgcagtctctacttctcagttcacagctccctcattgcttcagttgtctaagccataaacctggaaggcctttatttcctactttctgtaatgtggaatccagcttaatttctattatttgactgaagtaaatttaatgaacttaaatctctgaatttgaagcccaattcacattattagggtggtctcaacagctacacgtcttgaatttttaaaaaattgtctgagactctcagtatttccaggagactggcagaaacaaatgcaaattatctctggaaaaacgcacagctgtggctgggcacggtggctcacgcttgtaatcccagcattttaggaggccgaggaggacggatcacttgaggccaggactttgagaccagcctggcgaaaccccatctctactaaaattacaaaaatcagccaggcctggtggcggcctgtaatcccagctactcaggagggtgaggcaggagcatcgcttgcatctgggaggcagaggttgcagtgagccgagatcatgccactgccctccagcctgagcaacagagcgaggctcatctcaaaaacaaaaacaaaaaaggttgaagaaacaacaggagtatctcaagagaaaaagaacttgataaattcaacattgattcataaaaattcttagtaaaccagaaataaagggggacatcctcaatttgatgaaaggcagccattaaaaaaaactatagctagggccaggtgcggtggctcacgcctttaatcccagcactttgggaacctgaggcaggcagatcacgaggttgggagttcgagaccagcctgaccaacagagtgaaaccccgtatctactaaaaatacaaaaattagctgagtgtggtggcactcagctactcgggaggttgaggcaggagaatcgtttgaatctgggaggaggaggttgcggtgagctgaggcttcgccattgcactccagcctgggtgacagagccagacagcatctcaaaaaacaaaaacaaaaacaaaaacaaaaacaaaaacaaaaaacacaaaacaacaacaaaaagcgctatagctgtatcagaatttagagtgaaaagacttaatgttttctttcttcctaagatcgagaataagcaagtgtccactctcaccacttctgttcaacacactgcaggtctgagccagtataataaggcaagaaaaattcagaaaaggcttacagactggaaaggcagaaataaagctatctatactcatatactgcatgactttgtagaaaatcctgaaggatctatttatagaaatccactgtctaatgagtgagttttgcatagttatagggtacaaatgtcaatatatataaaacaattccatttctatatacttgcaatgaactagaaatgaatgaaatgtcaattagaaattgatattttaaaataccgtttacagtggctgtaaaaaacataaaatacttagggatacatctccaaatacatataacattttatgctgaaagtgacaaaacactgatgagagaaatcgaagacctaaataaatggagatattttgtattcctggactgaaagcaccaaatattgtcaagatgtcaattctccccaaactgatcaacggattcaatgtaatatgaataaaaatcccagcggtccattttgaagaagccaacaagctgatttcaaaatttatgtggaaaagcaaacaacctacagtagccaaaactattctgaaaaagaataaatttggagaatgcacagtacctgctttcaagacttcctacagagttatcaatcaagccagtgtgctattggcaaagggaaagagtcaaccatcaatagacctattagagtcacaaatagacgtgatcgcatataccagttgattttcaacaaaggggccaagtaaattgaatggacaaaggtagtgtttttaacaaatgaaactggaacaaatggatacatgtgagtcaaaaaataaaaatagaaggtggggggaggagagggtttgcaccattctgtgaactgtatacagatattaactctcagtggttcataggccacaatgtaaaaccgaaaaccataaaacttttggaaggaaatctttgttggctttggcaaaatttcttaaataagacacaaaaagcagaagtcataaaagaaaaaacttgataaattgaacttcatcaaaatgcaaaacctctacacttcaaaagacagtattaggaaaatgagaatacaaaccatgctgggaggaaatatttgcaaaatttatctgataaatgaatgctaaacagaacatataaagaaattataaaactcaagagacatacaacccaatttagaaaaggggtttgtacatgtatttcaccaaagttgagatagagggaaaacaaacacatgaaaatatgctcagcatcattagtcattctggaaatgcaaattaaaatgacataccactacccatctatcgggtcggatgtagtaaaacaaactgacaataccaaaccctggtgagaatacagagtaactgaatctttcgcacgttattggtgggaaggcaaaatggcacaggcaatttggaaaacaagtttggcaatcccacccttagacagtcaatcaagaactatgaagctgtgcccacacaaaaatctgctgctaatatttacagcacagagctggaaacaacccatgtccgtagaattgcaaaaggataagtaaattatggtatatttatacaatggaatattatcaacaataaaaaggaacaaactactgatacacgaagcagcctggacgttctatatgtcaactgcagtatgctgtcagcctcgaaaggccacacactgtaggattccatcgataggacattctgggaaaggcaaagctataaggacaggagatataaaccctttgttatacatgctgaatttcttccccagaagttttaaatttttaagcagtggaatctgcctgcaatcatgtttcatggctggggaactggtaaagaatctgcagccaggcgtggtggctcacgcctgtaatcccagcactttgggagcctgaggcgcgtggatcacctgagatcaggagttcaagaccagcctgaccaacatggtaagacctcgtctctaccataaatacaaaaaattagccaggcgtggtggctcacgcctataatcccagcactttgggagcccaaggcgcgtggatcacctgagatcaggagttcaagaccatcctgaccaacatggtaagacctcatctctactatacaaaaaattagccaggtgtggtggtgcatgcctgtaatcccagctacttgggaggccgaggcaggagaatcacttgaacccaggagggggaggttgcagtgagccaagatcgcaccactgcactccagcctgggcaaagtgaaactctgtctcaaaaaaaaaaaaaaaaaaaaaaaaaaaaaagattttgcatgggaagagctttcatatgagatcatacagttatttttttgatccttatctaatatgtataacatattaagctctccagtctcctaaaatttttatttatttattttaagacagagtctcattctgttgcccaggctggggtgcagtggtgtgatctcagctcactgcaatctccacctcctgggttcaagcaattctcccacctcagccactcaagtagcagggactacaggcacacgccaccacaactggctaattttcgtattttttgtagagatgggatttcaccatgttggttaggctggtctcgaactcctggcctcaagcaaaccgcccgccttggcctcccaaagtgctgggattacaggagtgacccactgtgctggcctaaaattgttaaactactggaatttgttttcatttatggcaggatggtcacctgattctcaaatgcagaacagtgccctgtgagtattcacatgtgtcaacttactctggagtactctgaacatgctgctgagtcctcttatgtggcataaactcaggtctgtgatatgagcgggctccagatgctcaagcagcagtgacttgctcctgaagagaaaggacagcctcagtcatctgcacagaccacaggccccttagtctactggatggatcccattacatcctaccagcaaatgcaatctccctatctcaatcaacatcttactggactctgattctcacccaattgtatccaaaatgaaaactcacctttctaaagagtattttgcattctaagggaaagaaaagagaccaggttactactgggtttttgagctgtttttgcaatctgtgcccaggaaaatatcctcttacaatgaactcaatttccatgtcatttcttcaacctcataatgctagttatcagatgaacaaattctaacatggaaacagaaaaagtcagaaaaatgcatgaaatcattttgtcgtagtcccaagggaaaggttttctatccctcaccccaggcatcttactcagagccatcatttctcagtcttcagacgggagcatctatctgctttccatgcagggggtggccagagttcagcaggtgaaggggccactggctgggagggcagtgggagccaggcagagccacacctgcctgcatgctcaagaactgagctgcttcctaaggatttacctacagacgctttccagatgagcgcattcattgcaattataagcccaggagagggatatggacagtcttaaaaagatagtaaggccaggcgcggtggctcatgcctgtaatcccagcactttgggaggccaaggtgggcgtataacctgaggtcgggagtttaagaccagactgaccaacatggtgaaaccccgtttctactaaaaatacaaaaattagctggacatggtggtgggcgcctgtaatcccaactactcaggaggctgaggcaggagaatcgcttgaactggggaggcggaggttacagtgagccgaaattgcgccactgctccagcctgggagatagagcgagactccgtctcggggaaaaaaaaaaaaaaaaaggtaacccactttctgaaaggcaacgtatgttactatacaaaattcaaaatatgcaatacttaccatagactgagtagcttctgcacagcagaaattcatttctcgcagttctggaggccgaatttcaagatcaaggcactggcagattcagtgtccggtgagggctccatccctcctaggtagcctccatctccagcctcacaagctgaaggggtgaggtcttcctcggcctcttttataagagccctaatcccattcacaggggctctgcccccaggccccactcactacccaaaggccccacctcccaataccatcgccttgggggagaggatttcaacatatatattttggagggacacaaacattcagatcatagcagataatctcacccttgtttcaagattatcacagatgactatacatttattaattttttgccagaaagtctgtgaatgttagcaaccacacatgtatatgtgtgtgtatatatacttattatccaaagatcaaacaaaaagcagtctgcatctttctttttcacttaatgagtgcttgaaatactgttagtgcctatagagctgttttattctttatgatcacagaatatttcattgcatggaggtattaaccacattgtgtcacatctcaaccctaacttactgctgataattttaaggtgagaattcatctcatgaagcagctccacactatcccacaaagctatgaccattcctaaagcttttggcagctgaaagaaagtcatgtagccttcttttgtggttgaagatcattggatattgtgttctgacagcaacccctaatgagtactgtccacttctcatttctcaaatactggaatgaattttattttctttttcccagcatcttaccttgagcaatgccaaggtgccttccccacactttttctcaagctccacgatgagctttaggaggctgcggacctgttcagaagccctggcttcactctccttcagtttctccatgttctctctccccacacggcccagtctctgcagaagcatttcttcgttactattcaacaacctcaagttcaggaacaagagttcggtaacttctcctatagattaattcaaccatgtttttaaaaacctgcttttcggttgggcgcagtggctcacgcctgtaatcccagcactttgggtggccaaggccggcggatcatgaggtcagggtttgagaccagcctggccaacatggtgaaacccagtctccactagaagtacaaaaattagccaggcgtggtggcgggtgcctgtaatcccagctactcaggaggctgaggcaggagaatcgcttgaacctgggaggcagacgttgcagtgagccaagatcgtgccactgcactccagcctgaatgacagagcaagactccaaatcaaaaaaaaaaaccaaaaccaaaaccaaaaaaaaaaaaaccctgcttttctgcctgctaccccaggaacagacataattaggcaaggccatgatattcttctgctgaagcaggattcctctcaagagacagttgattctttgccccctgttatgtatgtttaagccaatacagatgtgtgtgcacgcagcccttactcacattaatatgcacctaaaacatttcatgttttttctgtggctgtttgttcagaaggttccctattttttcattaacttgaaatcaattaaaattaaggtatatagattaactaataagaaataaataattacgttactgatatcaattttctttttatccttccaagtatactttacatatactgcgtagtcacatacgcaacttgagtatgttatttagggggaaaaaacataaacataagtgatagtttattatatttgattactaatctgacaacttactttattcttggagaacattccttattcatatacacagagccatgacatcatcttaacatgctgaagagtattcttccatgtatgtatggagcacattttgtgagtcttctattgacaaatacagggtgtttctaacctcttgctatgaatgttataattgtaacatctgctactcatcaactgcttaacatgaacaagacacgatttaataagctttagcagattatctcactcaaatctcacaataattttataaattaggggtcactgttatatccagtttacagctaaaggaaccaagtcaaaggttaagcagcaggtcgtaggccacccaggagccagtaaacagctggctcagataggaactccattcatccggcttcaaaggtgaattctaggccgggcgcggtggctcacgcctgtaatcccagcactttgggaggctgaggcgggtggatcatgaggtcaggagatcgagaccatcctggctaacacggtgaaaccccgtctctactaaatatacaaaaaattagccgggcgtagtggcgggcacctgtaatcccagctacttgggaggctgaggcaggagaatggcgtgaacccgggaggcgaagcttgcagtgagctgagattgcgccactgcactccagcctggagacagagccagactctgtctcaaaaaaaagaaaggtgaattctaaaccatggctctaaactgaaactcagtttcagtgttgccttacccaggtgtctttttctatgtgtgtaagtatgtttgaagcataatacagtaatatgtgtacaaatatatttataggtatattgtgctttatttatgtctttttatatgcatgtcaagataaattcatagaaatggagttgccaggtaggtatataattcatttaatacatgtgtggttgtcactggctatgttattttggaattgacataatgtttagctcttctttttctcatttctcaaatatgaggatgttgttttcaatatctcacctgtagcatttcctggaacatctcctctagctcggtggcaagcttgatcgcttgattcagaagggtttctctcaggttcaagtcagatatgcattcctgctgtctctggagattctgctcacactcttcattcaacaaccggagtctcatactatactcagactcaatcatctttttaaaattttgttcctcttccttcctcatatagacatgatagacttcaggttaaacatgatagattaacaacacacacacacgtcataatagatagatatctatatctatatatagatatatatatcttacactgaccacaatgtattctttccatctctaaccccaatataaagacaaggaaggctgggcgcagtggctcacgcctgcaatcccagcactttgggaggccaaagtgggtggatcacgaggtcaggagatcgagaccatactggccagcatggtgaaaccccatctctactaaaaatacaaaaattagctgggcgtggtggggagcacccataatcccagctactcggaaggctaaggcaggagaatcgcttgaacctgggaggtggaggttgcagtgagcagagattacgccactgcactccagcctggcaacagagctagactctgtctcaaaaaaacaaacaaacaaaaaaagacgaggaaatgtaaagtacagaagaaaaggaataaacccaaaggagaaatagaatttgagtcaacatcagccaagacatcaacacaattttagaacataaaatgcagacgaagaaatgttcatcaatgaattggctgggcgcggtggttcacgcctgtaatcccagcactttgggaggccgaggcaggcggatcacgaggtcaggagatcgagaccatcctggctaacacggtgaaaccccgtctctactaaaaatacaaaaaattagccgggcttggtggcgggcgcctgtagtcccagctactcgggaggctgaggcaggagaatggcgtgaacccgggaggtggagcttgcagtgagccgagatggcgccaccgcactccagcctgggcgacagagggagactccatcttaaaaaaaaaaaaaaaaaaaagaaatgttcatcaataaggaaaaactaaggaagctatagcctctgtcaaacagaggaggagaccaggacattggaaaagggccaatgggatttgctgatgcttgggtaagagttgtggggaaaaaaggagtcatggacgaaagacaccaaaaattttagactaagcaactggaagaatggaattaccaaaatatatagagagaatctatggaaaggctggattccagaagtgaggagtgtgcgttagctcgggatgtgatgaatttgattagtcaattagacatccaagtaaagatagtaagtaggaaattggacatgaagcctactaccatttggaaatctgagctagggatatatatttgaaagtagtcatcttagagatgcttaaatagcatctctattaagctatttaagattcagtgaaattgtccgggctcacgtctgtaatcccagcactttgggaggccaaggcaggtggatcatggggtcagcagttcgagaccagcctgaccaacatggtgaaaccccgtctctactaaaaataaaaaaattagccaggcatgatgacgggcccctgtaatgtcagctacctgggagactaaggcaggagaattgcttgaacccgggaggcggaggttgcagtgagccgagatcgcgtcactgaactctagcctgggtaacaagaacgaaacttcatctcaaaaaaaaaaaaaaaaagattcaatgaaatcaagatttatcaagaacctgactacttctcaccactgctctacctgtcccccagctcaccatcatctctccctaattattgcaagtccctttgcacgtctctccacctctgcttttactctcttggtttttttttttttttttttttttttgagacggagtctcgctctgtcgcccaggctggagtgcagtggcgccatctcggctcactgcaagctccgcctccaaagttcatgccattctcctgcctcagtcacctgagtagctgggactacaggcacctgccaccacacccgattttttagtagagacggggtttcaccgtgttagccaggatggtctcgatctcctgacctcgtgatccgcccgcctcggcctcccaaagtgctgggattacaggcatgagccaccacgaccagcctgcttttactatcttaatgtctattttcatttggcagctagcgtgtttctatgaaaatggaagttaaatcatgtcagccttctgttcgaaaccttccagtggttttgaagcttgtatttcattgaaggctgccaccctaaatgactgaccgccttcttctgatctcatcacctacagcccccgtttccttacacagctccagccacatacacggcagcctccaggcctttcctctgcctagaatattcctccccaagaaaactgcatggcccaatcccccacctccttcagtgccaccttctgaataacaaggttctgatcactttatttacaagctcactccattgcttcctttctcacttaaaaaaaatttttttaaacacttcccaggtaacatactatatattaaacttattttgtttatatccactagaatgcaagttccacgaaagcagagctggttttttttgttttccattggtgagcccctagcaccttgcatagtccctggcaaacagtgggatctcagtatttgctgaacacatggtacttggaactgaaaaagaagggggatcggttgaaaaatccttacctagccaggcaattctcctccactatcttccctaagtaggcatttatttcctttaaaaattgagggagagaaaagacccagaatcggggataccttgcacagaataggattaagtatgaagatacaggctgaaattagaagtgaaatatgcctaacaggtggtgaaccctcaaatctgaatagctattctcaaattgctctttaaagggttttagaatttatgtggcaaccagaagtacaagagatgctcattctcctatgtcattgttataaacggtgtcgttaatctttttgatcattgcaaatagcattgcaaatgccattttactcaccatataatttgtatttctcttaccacgaacaaagttcaaattctttcaatgtatttaaaatatatttactttcttttctgcaaactcttatttgatcgttttttaaaattaaatttctagtcttttccttactgactttttttatttttattttttttgagatggagtcttgctctgtggcctaggctggagtccagtagtgtgatctcggctcactgcaacctctgcctcccagttcaagcgattctcctgcctcagcctcccgagtagctgggattacaggctcgtgcaaccacacccagctaatttttgtatttttagtagagatggggtttcaccatgttggccaggctggtctcaaactcctgacctcaagtgatccgccctcctcagcttcccaaagtgctgggattacaggcgtgagccaccacacccagcttcttactgactttaaagagctttttatacattaagatattagcacttttccttcctatagatttcacatttttcctgctttgtgatttgtcttttgactttgtttatgatacactattttctaacaacattactggtaatttccccccaagaatcaagataagcactcactgacctgaatcatcgccattctttcttgctcatcagtcaatatgcttttagctgcttcaagtttctccctcgatgtgttcaatatttcctggaataacttctatagagaaagcacagaattccaggtgagatcattgatttagaacagttggattcctgaccttaaacagccaacaactctgagtatatattttcttagcctttaggttgaaggttcaacgaacttatctaatattctgtaataaacatcaactaaggtaatggttttggaggaccagaatgtctgtccatttcatccatataggagttggccagagtgttttgggatttgcgtgagtgactcttaccctgtaattctcagcagcctcttgtatcccacacaccatgtgatgtttgtgctcctgggactggaagcatttgct

SEQ ID NO: 1515 - DNA, 146331 bp, Homo sapiens
gatagacatctgggcaagtcaacaggaaggtggatatccaaatctctctcttcgcaatgagtttccagttagatggaggagagagtaataaaacacagtaagtgtggaaaagattaaaatgcatgttgtgatataccacaggaaatcagaggagagaggttcattctaaggggaatggtggaaacgtcagtgagaacataccacctgggtggttcttgtaagatgatgtggaagagaaaaggtaaagattgagcaaaacagtgcatgagcgaaggatgcaatgtgagatggtctgaacagtttaaaagaataacctgggccaggcacggtggctcactcctgtaatcccagcactttgggaagccaaggcgggtggatcccgaggtcaggagttcgagaccatcctggctaacacggtgaaaccccgtctctactaaaaatacaaaaaattagccgggcgtggtggcgtgtgcttgtagtcccagctacttgggaggctgaggcaggagaatcgcttgaacctgggaggtggaggttgcagtgagccgagatcgcgccactgcactccagcctgggcgacagagactgactccctctcaaaagaaaaaaaaaaaaaaagcataagccgagggaatgaaagtactttctgtggctggagcacaggatgtctagacagaagaatttggaaagaaacagaggatactagatttggaacagatcattcaggtcctcaagaccttgaaaataaggctacagtttttaatattattatactgcaggccattgaagataatgcacttgttttgtattgtttttgtttttcagaagacagagtattaacttttttttcaggttgtagaattcatcaattccataaccatttttgaatgagtattacaggtcaaggacttttctaaaaagatggatatggtctcttctgtcatgggtcttacattctgtgggaggagacaagcaataactacatacaatgagcacaataattgaagtgattatgtgggaattaaaggggtgggctattgacaacttcagacaccatggtaattaatggccttcgatttgtaacaggagctgagattcctgacttcacagatccctgaggagatgtttactaaagggaatcttctggtcactgttaccttcctccgtacttacctgcctcatggagtaagcatgacaaaattcttgattacatagggaaaatcacatcttcgattaatactttcctgtttttattcttcattactacttgcatgatattcacataatcttttctcttctcctgcttcctccgtgcaataagctgctcaggcagcctttgctcttaagagcttgtttgtatctgagaacgagttaaggctttacactggtagtaagtttaagtcatgccaaaaaggggtagaatacctgattctcctagtttcaagacaagccaggttttttttgtttgtttgttttttaaaaaagcagaaactttcattgctctctctcatctgaaactagatgaggctatctactctgagtggccaggtcttctgtaatttgtaactgaaatgcaggttacttgctcactgcacgtacagttcagttaacgagggaaatctgatccaaaataagtgaatttattccgaagttagcttgggggaaggggcacaaagcatcccgcctttgaatgtgccgcttctcctctgttgcaaaaagtgggcattttcatagggtaagggaggacatgagcaagggcaggggtcccactgcttctggtcagttacctaccaggcagttgagttggcaccttcctgtgcagagttcagttgtaaaagtagccaagtggtcatgctttcgatgtgctgtcctggtgcgtatgagttcctaggtcacccctggaggatggcagttccgaggcacgcccctggaggtgagagttccatggggacatgctttggtctgtaaatccaccgtcagctctggaggagagacctgtcttggagcacgaagttagaggaacttgctgtgtaggcaatgtcctgtgagggagaggtgagagattatatttgcatttcagcagagctaagcagaaagcagagagccagggaaaggagaaaacagagtgagagggaaaaatataattaaaccacccgtagaaaaatagggagaactgggggccggggcggtggctcacgcctgtaatcccagcacttcgggaggccaaggccgacggatcatgaggtcaggagttcgagagcaggctggccaacatggtgaaaccctgtctctactaaaaatacaaaaattagctgggtgtggcagcaggcgcctgtaatcccaactactcgggaggctgaggcaggagaatcgcttgaacccgggaggtggaggttgcagtgagctgagatcgtgccactgtgctccagcctgggcaacaagagcaaaactccatcttaaaaaacaaaagaaaaaagaaaaagaaaaatggggtacttggttacattttaagaacctaaaaatctagaatttcatgcaaaactcataattttcaagttggtaattaattttcaaatgtaaacatattgtggctcgcaaagaacaataagatcaatcaaccaataaaggcaaaaatagagagtaaggaagaatccacactaagaagcgtgaagacttgattagagacataagccaaagaaaggagatgtgttcagtgtttactgccatgtgccaagcaggggcgggtgaagacaatggcaatgtgaacagctaggaggaaggcaatatctggtaaattagagccgatgacatatgagtccaaaggagaaaagaggacgctgaacccaagcttgatgattgggagaatggtggtcccgtgacttgtcccaccgaagccaaagaaagaacagatctaagggatggtgatctttgagcaagctcgtttccctcacacgttccagcgctgtttcacgccaggctctgggattgaatgatatccctggatcaggttcactggcgtcccctgctggcacagagcagcacaaagacttcgaaactggatacgctgataaatttatgaaatctccacaaactagagaacacgggctaggtgcggtggctcacacctgtaatcccagcactttgggaagccgaggcgggtggatcacgaggtcatgagatcgagaccagcctggccaacatagtgaaaccccatctctactaaaaatacaaaaaattagctgggcatggtggcgggcgcctgtagtcccagctacttgggaggctgaggcaggagaatcgcttgaagcccggaggcggagcttgcagtgaccagagatcactccactgcactccatcctaggcgacacggtgagactctgtctcaaaaaaaaacaaacacaaaaacactagagaacatgttattaaataatagaaagaaagaatgcccatctgataaaggtacaaaactgaccttaaaatgacttagcactggaaagaaaaaaaaaagaggctacaaatttttggttactgaagagccttttaaataagattatattaaaacagtgggtagatctctccaaagcagaataagaaaacccctaatcttcctcctaactaaatgattatatgatttgatgagtgaggattaagttctgcttttaaatataattgctgggtaatatgaatataaaccaaatatgtaaaatttaagatacaaagatcaatattcccaattctataaaatttgtgtcaactaattgtagataataaaatattttatgtattttttagaagaagataataggcataacaactattgtgaaattatccaaatttgtactcttagttgccaattttcagttctttagaaagtgcaattattcttagcagtgagaaacatgagtctcacagaatacatttaagtcttcactttgatttacaacctccagtgttaattaaacaaatgccaactatgctaatagtctggaaatcctttgacaaatactgaaagaaatgacaggtctggcacatacacatatagatggaggcttgcctgatttttaagaggcgttttacagatttggccttataatacttattctataactattcattttatcctggaaaatgttgtctataaagttttggagagaaattgctctgtagaacaaattgacatttcacaggaataagtccactattgctaagaaaaatggtactggggatggagccccaaaatggcagaggcaaacacagccctatcaacctctcccatccccctgtgtacacattagtatagacttagtctgtctttaggaacaacatttttactgacctgctttctaagttgttggtccctcctcttccctgggatctacatatcagggtagtttcataattctctgttgtctcagttacgtgttaaaagtaagcatgttcactgagtgatgattttactttttaaacaacctcatcttttaccgtaccatcagttatattaaatatgacatttaaggttttaaaagtggagttagaaagctacatactgagaggtgaagccaggcgggcttctgactcatgtggggacttggagaacttttctgtctagctggaggattataaacgcaccaatcagcactctgtgtctagctaaaggtttgtaaatgcaccaatcagcactctgtaaaaacggaccaatcagcactctgtaaaatggaccaatcagtgctctgtaaaatggaccaatcaccgctctgtaaaatgggccaatcagcaggacgtgggtggggccaaataagggaataaaagctggccaccagagccaacagtagcaaccggtttgggtacctttccctatgaaagctttctttcacttttcacaataagtcgtgggtgcttctcactctttgggtctgcactacctttatgagctgtaacgttcgtggcgagagtcggtggcttcattcttgaagtcagccagaccaagaacccaccagaaggaataaattccagacacaatacaatatgttgggtgagcagatcatggcacttatgtcaggaaagcttgtgtttaatcctgggtgtgccatttactaagtgtgtgattagttgtattatatatacatacacacacacgtattttttgagacagagtctcgctctggcacccaggctggaatgctgtggtgcaatctcggctcactgcaacctccgcctcccaggttcaagcgattctcctgcctcagcttcccgagtagctggggctgcaggcatgagccaccatatccagcttttttttttttttttttttttttggatttttagtagtgacagggttttgccacattggccaggctggtctcgaactcctgacctcagacgatctgcccacctcagcctcccaaagtgctgggattatagccataggccactgcacccagccgtatcttttaattttaatacccaaatgtattatcaagctaataaatttgaataaaaacaaaatagtaaagctaatataaatattaaactttttacacaaagaattggttctttaaaaaggttagcaaaattgagaaatctttgctagaatgatttaggaagaaagaagactcaactgaaaatcagaagtgaaagaagagacattactaccaattttgcagaaataaaaaggattgtaaaagagtactgtgaacaattgtataccaacaaactgaacatcttaggtgagatggacaaattcctagaaacacacaaatggccaagattgaatcacgaagaatcagaatatctcaagagacttacagtaaggagattaactctgtaataaccccccagcaaagaaaagctaagggctagatgacttcactggataattgtagcaaacatttaaagaacaattaaaacaaatctttctcaaactcttaataaaaagcaaagtggagggagtactgccaaactcaatctacgagaccagatttaccctgataccaaaatcagacaagtatactatgagaaaagaaagtacagaccaatatccctgattaatactgatgcagaaatcctcaagaaaatactagcaatcagaactcacaagacattaaaagaattttacatcatggcaaagtgggctttagtcctagaatgcaagaatggtaaatatatgaaaatcaaagtaatgccctacattcacagaatgaaggacaaaaaccatgtgatgatctcaactgatgcagaaagaaaaaatttgacaagatgctctattacaaaacactcaacaactagtaatagaaggaaacttcgtcaacacagtaaaggccaaatataaacacccagaactaacatcgtactcaatggttaaagactgaatggtctccctctaagatcaagaggagcaagacaaggatgctctctttcaccgtttctgttctacttagtgttagaagtcctacctggagtaattaggtaagaaaaagcaataaaagtcatccacatgagaaaggaagaagtaaatttatatctgttcacagatcacataatcttatgtgtagaaaaccataactattacataaaaatgaattcagcaaagttgcagaattcaaaatcaacacacaaaaatcaattgcatttctgtgtattaatgatgagcaacccaaaggaaattaagaaaacaattcaatttacaatagcattaaaaagaataaaacacttaagaacaaacttaaccactgaggcaaaagacttgtactctgaaaactataaaagaaatatatacataagtggaaagacatcgatattcatgaattagaagacttatattgttaagatagtagtgttccccaaaatgatctacagattcaatgcaatccctatcaaaatctcgaccttttttgcagacatggaaaaattcattgttaaattcaaatggaaattaaaggaatctatgatagccaaaataatcttgaaatagaaaaacaaggttagaggtctcgtacttcatgatttaaaaactcactgcaaagctacagtaatcaaaacagtggttattgtcataaagacaagagtatagaccaacaaaatggaatagagagcctagaaataaaccttcacatacatggtcaaatgatttcaacaagggtgccaagaatattcaatagggaaagggcagtcttttcaaccagtggtcctgagaaaacaagataaccacatgcaaaagagttaagttgaaccattaccatagactatatacaaaaagttaactaaaaatggatcaaagacctaacccataagagttaaaactataaaactcttaaacaaaaatataaggggaaagcttcatgtcactggatttggcattgattatttggatatgacaataaaagcatagataacgaagaaaaataagtaaattggactacaccaaagttaaaaacttctgtgcaaaacaggctataatcaacagagtgaaaaggcaacccataaaatgggaaacatttgcaaataatataactgattagagttattcagaatatataaagaactcttacaactcacacacacacacacacacacacgaaacccaattaaaccattgacaaaagccttgaatagacatctctacaaaaaagatacacacatagctaataagcacatgaagagatgcttgataccactaattgttagagaaatggaagtcaaaaccctgactggcaaaacactgtgacaccacttgatacccattaggattgctactattaaaaaaaaatcagaaaataacaagcattggcaaggatgtggataaactggaaaacttttgcatttttggtgggagataaaatggtgcagccactatggaaaacagtatggtggttactcaaaaaattaaaaatagaattaccatatggtgcagtgatttcacttctgggtatatatcaaaaataattaaaatgaagcacttgtacagatatttttgcacttatgttcataagcagcattactaacaatagtcaaaaggtggaagtaagccaagtgttcattgctggcggaataaacaaactatgacatttacttacaataaaatatttttcagccttaaaatggaaggaaattctgacacatgctacaactgtaggtcattatgttgagtgaaataagccagtcataaaaggataaatactgtatgattctgaaacagaccgaatagtcccattttttaaaaaaaattttgatgaacatagaaattgacccctttggtattaaagtttgaaacttatatttgttttttctgagttccttcttcaggaaatgaccttcaggcctctcaaaaaaaagtattaaagaactgaaactcacccagttaccacatccagacaatgagatgccagacccctcattcatcatgatggcttccttgcccctcactagttcctgtttccttacacattgttacattccttccctgctatataaactcctagttgtagttggtcagagagatggatttgagactgagttcctgtctcctcggctgcagcacccgattaaagccttcttccttggcaatactcattgtctcagttcttggctttctgtgcagccagtagaagaacctagactgaactcctggtgtttcactaatcatcccacttacacagtgtacttagagtagtcacattcatagagacagaaaatagaatgggggttgtcagcagctggtggaaaggcaatggtgagttcttgtttaatggttagagtttcagttttacaagattgaaagggttctggatatggatattgatgacggttgcacaacaatgtaatgatgttcactgaagtgtacttttagaaatgttaggatgataatttatataacttttttttttttttgagatggagtctctgtcacccaggctggagtgaagtggtgccatcttggctcactgcaacccccacctcctgggtcaagagattctcctgcctcagcttcccaagtagctaggattacaggctaccacctgtgtgattacgggccaccatgcctggctaatttttgtatttttagttcgagatggggtttcaccatgttggccaggctgatcttgaactcctgacatcatgatccacccgccttggcctccaaagtgctgggattacaggcatgaggcactgcgcctggcttataacattttttttttttttttgagacagagtctcactctgtcgcctagactggagtgcagtggtgcgatctcagctcactgcaacctctgcatcccgggtgcaagtgattctcctgcctcagcctcccaagtagctgggactacaggcacctgccaccacatctggctaatttttgtatttttagtaaaggcgaggtttcatcattttgcccaggctgttctcaaactcctgacctcagataacttatgtaacttttatataggtatattttatcacacttaaaaatattaacacatcttaagaaattcagccaacccaaattgctgagatggcatggaggtatggaaagagcttttcaagctagaaagacctaagtttgaaatgagacctaagttctactacgttctaatgctatgacctcagagatgtcatagagtcacgttgacactcagcttcctcatattatgcgatgaccacttatagaggcatgatgaagagtaattgagattatgttatttacagtctctggcacagcctgtggctctccacaggtacactgcaatgaatcttcctttgcattttcctcaggtaatagtaaggtgtaattgactacaaataggtctctatgctttaaatgtaaatattaatttcacttagatgatctaattcagtttttacagcatgctatggtttacacaatcctttatatagtattttattttcctaacttttgaggtaagcattacgaattatattttaacaatggatgatctgaatataaaagagattacaggatttgattaagatcatatattgctgtgattcaacaccatattttcttaattcaatttcatcgttatttatatggtacaattaggaaaggaaaaagtaatccaagccctatattaaaccatacctgttgctgagtgtcttcaaaatcattttattttccttcctaagataaaaaaaaaatgatagaatcctacgtgcttgtctgatgattcgtaacttgaagtcagggattagatctcctctgtttcttagttttattctatagcccatgaatatattaagcattcaatagacatttgttgaattaaaatggtataaactattgatctgaaatactgcatttgaagcttggtacttcatgcattttgttcatatcatttatgtactaaattcaactttttttttattttgcatcctgattgtgttttcataaacatttattctaatgctaaaatttaatatcaataaattatatcttggagaaataatttaacaaactcatatttgcttggtgtgattatcaagactgcagaaactttggcaatataacataatggggaaaaaattggacaggaatcagaactaaccttcattatgggttcctggaatagctccaatctattcaagtaccctggagccaaacatttaaatgctccctgcctggatttctgcatttccccaatggagatgataatatttatctggcctacgttgtaagcttcctttttctacaccatgatactcagtatgacatagaggttcaaatcacttactattttcataaccataggcaaacctcttcacacttccatctgtaaagctgcctaataatagtatctgtgttctagtttatcatgaggattaaacgagtgaatatttatgaagcgtgtaaaacagtatttggcacatatgcaaatgttggttaaattttatgtgcataagtgtgtgtgcgcactttgaaaagtataaaaatatatttataatatcaggtcaattaatattttttctctctaaatgctactctagttatgtatatgcacttcaagtacttgacttttagttttctcatctgaaaaattgcattatcttttatttaacttatatttttgatcattaaatgctcttaagtactccatgctcagtaagacagataaatggagaaatctagcatgaagttagaaattaagaaggcatattgtttctataaaaaagaacaattttaacgaggaaagacagaaaacaagaaacataccattgaggccaactggtttataaggtgttgttactcagtcccagattttaaggtgcaattctcacatatgaattttcatagaggcctttgaagaagagaacaaagtctatgaaaatgcagccagtaaaagatcctccccttccttgaactacacccaacctgacttcagatgcaggttgcctttacttggggacgtgtgtggccgagaggcaagaggggtttcccttgagtagaatagaacttaaagagccaacagcagactcctcagatgctagtaacttgccaccagtagcgtacactgtgtccaacacgcagaggcaggtttgagtggaattcccagatagcttgtgatcaaagactggtcgccagtgaagaagacttgggatggatggatggatgggtggatggatgggtggataaatggatgaatttaacattgaggtataatttgcttaacagtaaaatgttcagtttaataagtttaggccaattaatattaattttgattaatctcaaattgtcttgctatcgagtgtttttttaagacagcaccaagtgtaaaggaaaatcttgagatcattatgccaaagacaaattgactccataagattagtccaaattatcaagtatattccatcattttgaatactcataaaacatattttgatttttattattttaagtgaatatttggtgatttcaaataagcaaacccaaattcaagaactttcactgtgcagaaatttccaaagtcaaaaccaaatagcgagtgtgataagttatactcattagacagcaatagagaggccccctgtaatggaatatggggtgactgtgaggatgctgaagaaaaaatggccatgattttttatctaaaggtgtgcttagtaaagtaggaatagaaaataaagacaaatatgcaactccaggagttatgagaatgtattcgggacgtattttgaaaacaaacccaactgctaaaattgagtcgacccagaaaagaattaagctgagatatctcttagtgatactttcacatccagatttacgcttagattcatgatgcattacaactaataaaattgtttaagtatgagaaagagcagaccaaggggccatgaagaaaatataattaaatgcagattaaaggggcagggcttctggtttggcagacacttacacttcaaagactggaacattctctttaataatacctcagttatctaataaaaatgatcatttggaaatcatgctggtcacttctgtctagctcaagtgtcaatgttctggatatactgggtactttattcacactgaattgcttttatacatcgagaaaggtgttaactcttactcttcttaaaatggactgtggtaattaattctgatgcctggaagcaaataagtaaatctttgaaatattcattttatttatacagacttagatatctactttttaggaaaatcacacttaaatacccctttcacttttgtacatatttgacacagtttggtatcaactgttactcggattatatagaaatattttgttgcaatgaatttatccaatttccttaaaggaagaagcaacaatggattatttcaaggagaacattatgtaatagtccatgctaatgaactgttaaaaaaatattattgacacaggcatgttaatagcagtgtgggttttggtaatcagctaacataattagtccagaattatatggactttttaagtaataaaatttactggaaacttaaatgtaattaattaaaagtttggtttagttataaatatgattaaagcatttttctctaattttttttttttttttgagacagagtctcgctctgtcgcccaggctggagtgcagtggccctatctcagctcactgcaagctccgcctcccgggttcacgccatgctcctgcctcagcctcctgagtagctgggactacaggcgcccgccactatgcccggctaatttttggtatttttagtagagacggggtttcaccgtgttagccaagatggtctcgatcttctgacctcgtgatccgcccacctcggcctccaaaagtgctgggattacaggcgcgagctaccgcgcccagcccatttttctctaatttatacttaaatttgcattattatttgcaaaacgtaccaaaatttggacatttaagcatcatttattctgaaaaaagtataagacatagtaaataacataccaatatgggacatgggagataaaaattgatcacccagtagataaagggaaaagctctttcagaaaaaaaaagtaaatttaattggcatataatcagaatatgtatgagcattttggagttcttgttttcttgttaactaaggtagaattttacaggtttgtagaccaaggcttcatctccatgaatgtggccccatgattaagatggcttggggtcagacagactcagtcctgctgtttgttagttgtgtaacatcagacatgctcaaagcctcaacttactcattttggggaaataataataattattaagactggtgagggccagctcggtggctcacgcctgtaatcccagcactttgggaggccgaggcgggtggatcacgaggtcaggagatcgagaccatcctggctaacaccgtgaaaccccgtctctactacaaatacaaaaaattagccgggcgtggtggcgggcgccggtagtcccagctactcgggaggctgaggcgggagaatggcgggaacccgggaggcggagcttgcagtgagccgagatcgcgcccctgcacttcagccccgggggacagagcgagactccatctcagaaaacaaacaaacaaacaaacaaaaaaactggtgagggttataataaatatatgtgaattaaataaaaatgtgttttaaatgtcatcaattgttttatatttcttaataaatttctcttttgtcaatttcattattcagcaaacgcagaaacttaagattttctgctgtttgtagtaatgtagtatatttcatcatatggcaagtgctaccagagagaagtaggattattatttattgtggtttttgcaaaaccagaggcccatgccaggagttttattcagcacggctcctctttgattcctgtcacacctagacacaatgaaggtgatttgcaaaaaagtagaagaaataaaagaaaaacaaaacaaaaactcttcttgccaagatttctaaagtaatgaagaaataacgtcacttgtaaaaggggtttctaaaattacctatctggaacagaagaaagcaagagtccggtacccctatcaaatcaattggtttaacatgttttcccttttaaagtaaaataataatttaaataataaatacacatttttatttatataatgccatttttaatatagtatcatttttctactgggattttatagtttaatagacgttcatcattagtgtgctgtttcaaatcctggccctgctctatattttttggttggtttgtttggatattattaccataaaaacaaaaacaggcttgcaatggctgcagattcacagaagattattagaaataaaagtttattgttaaatattttgtcatagcaaaatatatttttctttaagagaaaaaagtttttatctaaatattatcaaatttattactttcatcacttacgtaagttaaccagttcatatgcatctgtatgtctcagtagagaccaccaacttcaacattaatgtgttttattttctcaaagttggacttcagacaaaaattataaaactggaagatagtaatatttaaggatgccttcctaaaattatcttaagtacatcgaatatttccaaaaaatgtttttcctctgagagtttcctatgctggtaagaaatattttgggaacagaatagacaaggattaagtgaaaaataaatgtccctttttactcttattccagttctcagaggaaacagtttcttgcacggacttccagttattttctatacataggaagtatattatatataacaatataaaatttatcatgaatgaactactctatacacactctgacagttactttttaagttaaacaatatctcgagtgtctcacatatctatactctcacaagtattacatatatattacatacatacttgcctaattagtttttggtgacaatatattgtattattatatgaatgtactataatttttaatagcaagtctctttgcaagtgtagctccagcttctattaggagtgaaatccctggataaaatataacttgtctccaaagctgattctccaaaactgtttcaatttccattcccgcatggtaatatcaatagaataattgcccattgtcccacaacctgtttaacatggtcacacagcgggattctgactttgccaaatggctcacttcaataagcttaatgaatgtttaaatgaatgaatgtcaatttatgaatgaggattaccatcttctcatacacgactactgaatgtatctcactttctgaatgggaatcatcttctcatatactaccacttttttttttttgaaacagggtttcactctgttgcccatgctagagtgcaatggcatgatcatagcccgctgcagccttgaactcctgggctcaagctaccctcccacctcagcctcctgagtagctaggactacaggtgtgaaccaccatgcccagctaatcgtgtgtttgtttgtttgtttgtttgtttgttttagagaacaccaggctggtctcgaactcttgggctcaagtgatcctcctgcctcagcttcccaaagtgctgggaatcaggcatgagccactgtgcccacccttatactaccttttttttttttttttttttttttgagacggagtctcactctgttacccaggctggagtgcagtggtgcaatctcttctgactgcaacctccacctcctgggctcaagcgattctcctgcctagcctcccgagtagcctggattaagggcgtgcaccaccacgcctggctaatttttgtatttttttatagtagagacggggtttcaccatgttggccaggatagttttgaacacctgacctcaaatgatctgcccgcctcggcttcccaaagtgctgggattataggtgtgagccagtgtgcccagcccccttatactacttttatatgtcttgcctggttttttcttctgaccagatttataattaaataactggttttttttcttactgactttcatgaaattttaatttatcaggaaattagttctgttgttaatttatgttgtacatatttactctaatttatctctcttaaaatgttttgttttttggccagacgtggtgggtcatgcctgtaatcccagcaatttgggatcacctgaggtcaggagttcaagaccagcctggccaacatggcaaaaccccatctctgctaaaaacaaaaattagctgggtgtaatggtgcgcacctgtaatcccagctactcgggcggctgaggcagagcaatcgtttgaacccgggaggtggaggttgcagtgagctgagacctcaccactgcactccagcctgggtgacagagcaagaccctgtctcaaaaaaaaaaaaagttttattttttaatatatacatactttagtgggacataagaatgatttagggcacttcaatttgggtctattttttctttcttttattatactttaagttctgggatacatgtgcaagacgtgcaggtttgttacaaaataggtatacatgtgccatggtggtatgctgcactcatcaacccgtcatctacattaggtatttctcctaatgctatccctcccctagtcccccagcttctgacaggccccagtgtgtgatgttcccctccctgtgtccatgtgttctcattgttcagctcccacttatgagtgaatatgtggtgtttggttttctgttcctgtgttagtgtgctgagaatgatggtgtccagcttcatccatgtccctgcagaggacatgaactcatccttttgtatggctgcacagtattccctggtgtatatgtgccacgttttcttgatccagtctgtcagtgatgggcacagccacttgggcctgttttctagggacacgtctctctgcagatggttacagcctccttcggtttgcgcagatcgccctcagacgaaatgtcagcatgtctctcaatgaagctctttaatccacagtcgttttgttttcagctcagttgtttctggtcggtgcaaagctgactgcagtttttcttctcttttcaatgtttgtaacttttcttctctgtgcttgacctctaaattaggatttgtgttgaagtaaagaattgtaataacctgcagagtcacccttaaatctggataccccctctttctctttctctctcagaatggagtactccagagcaatgttctccacttctcccacggcattatcgcacccctaagtctctcttctaactaggatattcttctctgggttctcaggtccctggaggtctcagggacattgatgccatgttcagggtctaaaaggtaaggtttttgtgctttgtacttcttcagtttggcccagatgtccttgtattcgtgagatatttttcacagtgattcctacagtattttaagatcagttctctcacctgtttttactctttttgtctacataggggatatcagagacaggatataaatagtaatattttattctttcaggaagctataaatgtatttagattattacaatttgtacagactctaagcagaaatataatcacatcatttatgatatttatcttcataaatagatatttgaattggcttccaaaatgaccttagagatgtacttacttaatgatggtggccttgatctttttgtgattagataatagcccagcatgtggccacagtagcagaaacacacagtatgtgctggttaattggctctactcgcttcatgcattattacagcttatctgctgcttgtggactggtacatgttgagcttctcaataatcaaagaagaaatcaggtgccaggtcacaatccagacccaagaagtgtctgcttttctgttttccacatgaagtcatcatttagcattcttttcttctttttcaatggtggagaagcctctggtatgtaaaacatgagtaaagttcaaatagggtcaaattccggaaggcagcacagaacttttcctcctagccgtgttactttggccgtacatccttctatcatcccatgcagctgggaatgggggctgccattttcattttgatcaaccattcctcaaaagggcatttagagagtcattagggtctagagtcatgaaatgagtagaataacagaaggtagcatgtcagaagaccatgggcagcccccaggctgtatttgcagtccccgttctgcataatgtgtccagttggtatgtaatgatgcacgcacagaagagaaccaaacactcaaatgttttggctataatcaaaattataccttgagtttcaatgtacttatgtctttgaaaatggtattttaaggaccagaaatgtacacagtgttctgtgttttcaatacacaaaaataaaccttatgcacgtaagtgtaggcctcactgctgggctgtattccttcctaccacggaccctgtaaatactgtagaactatccaaacaacatctaaacttcagatgtaaaattcctaactcctaatattacaaacattcaactattttgatggaaaaaataggaagcatgacaatcatttataagagaaagaaaatatatttctcaatgaacacagattccttgacatggacactttcctgcagcttccgaagacaccagcagtggaaggttatactattcatcgatggccagggctggttgcaggagatattatgatgctttgaaggttgtcctggtcatctttataaaatatatgtcaaccacacctgctgaggctacagagcactgacagagggtaagagactagagaaggaaaagctttgataagatagctgaagataatcagaaaagatggtaactaatcaaataaacatcctcttgcgtgcacaatgtcaggaatgcagctctggaaacaatgcctttgtcagagcactgttagccgtagggtgtgtgccttcctcctcttgtgcttagtgtttggagaatttttgttcgtttgtttgagacagagtctcactctgtcgcccaggctggagtgcaatggcgcaatctcggctcactgcaacctccacctcccgggttcaagcaattctccgcctcagcctcctgaggagctgggactacaggtgcccaccaccatgcctgcctaatttttttgtattgttagtagagttggggtttcgccatcttggccaggctggtcttgaattcctgacctcgtgatccaccctccttgggctcccaaagtggtgggataacaggtgtcagccactgtgcccagcctgagaattttaaaaagaagtagaaaagtgctattcttgattaagcagctgtcatatcagacactggagaatgtggcccaagctcacatggttcatttctgcaacagctcttgcaatctatacattgttgtcaccactctatggggaatcaatgagaatggtggcagaaaagtactctgctgaatggtgaggcagatataaatctggcctaagtgaaacaaaaaactctccatttttaactacactttactggctccaggactggacattttcaggggtagtatagggaaggactaaggatatcgagggttcttggatgaaataatacatagattgttggtcctggctgagtgcagaaacaagggaaaacagcagggcttgaaagcttaggagaaaatggagggaggcaagaggttggaggacttagtggattcatggagaacaaatagaaatacggaagttagaaggagagtgataagaggcaaggcaaagtaggtgatgaaattacccaaagtatgactctgggattgggttgctgaagaagagataataaattctttaaagtaagtaagagtggtgaagtgcttatcccatgtgacttattagagacagaatctgaaatataatttgggtttacattatgaaatttagtgcattatgccataagaatgctgtgtctcctaatccattatgttcgttaaggtggagctttacatgtgtcttgatatctgagtataatcttttgcaataaattacagaagttgtctcatcactaatttggggtgtgctgattttgtttctaagtttataaaatgaaagtcttgatttttgttggttaaatattttgaaaaattgcagttcaagagcaaagttatgttttactcatcagttttttgaatgaaaaattatgtgaacgagataacttttgtatgaatttttaatttttagtaaagttacttaagttatgtttattctccaaaatattatcagtcacatttatttagtgctcaagactaaataagaattttagacagattctcgctctgtcgcccaggctggagtgcagtggcgtgatctcggctcactgcaagctctgcctcctgggttcacgccattctcctgcctcagcctcccaagtagctgcaactacaggcgcccaccaccatgcccggctaattttttcgtattttagtagagacagggtttcaccgtgttagccaggatggtcttgatatcctgacctcgtgatctgcctgcctcggcctcctagagtgctgggattacaggcgtgagccacggtgcctggccaatttttttaaaattatgaaactaggaaacattgttctattaaaaatatttttctctatctattcacagtaacactgaagaatgcagtttacttacatctttttctgtttgacagaagacagttattagtaagtataattattagataaagtatacttattttccatgtttaaaatatgaaaaatatgcaatataggttggtactaagaggggaaatctgcttctgatcaaaattttattttaaatatcatttttatttcttttgtcctaagttatatactttttcttctattacttattgcaaagttactttaaaagaaaacaaaatcaaagaaagcaatcaaccaagattttaaaaataataatagcagaatctctcctcaattctttcctcttctccactccatcttgccttcacagctttttttgtttccaaaggtagtcaaaacattttagatatttatgccaaagggcatggatctgtgataccgtgggtcctgccaagctgaaggttttcctttggccaagataagttactgtggaaggaaagtaactcttccaatccacggttcttagaaaattatacttttatactttttaaattttaaatgaaatgccccacagctttcaatgcatacccagttcagagaatttgaatatcatccaacatgcttccacagtgatcccagtctgagaggactgtgttattatgtaaatgcatagcttgctttctaggtaataaatgataaaactcttcatacaggagaatttggtcttcggtgtatttctatatgtattgaaggtttgctgtgaaatcactctggaatctctcagctggtctgctccacagtatcctactggtcttgggctttgtatattaactttccagaactcatgctcactacagacttgctttagggcctctaaatatttgttgcttttgcatgccaagagttttatccttatttttggagacaggagaggatgtgagtgttgaattgtatttcaggttacccttgggacatcaaaatgaccaaggcagtgtctgctaagtatttgctgagactctgctatgattctttcaagtctaaagacagttatctgaatgatatccccgtgacagtggactcctgcacattcacagtcctggaaggagcctgtccacattggcattctggaagtccataaaagacaaacgcatatgcagtccccgagaaagcattgttgtaaacaaatctgcactagatggaaactctgttatgtggtgccggcatgcatggaagagtaagtccagaactacacctggaagttctttttactaaaagaacacacagttcttttttactttattatattgtattttattttattttgttttattatactttaagttctagggtacatgtgcacacatgcaggtttgttacatatgtatacgtgtgccatgttggtgtgctgcacccatcaactcatcatttacattacgtatatctcctaatgctatccctcccccctccccccatcccacaacaggccccggtgtgtgatgttccccgccctgtgtccaagtgttctcattgttcaattcccaccaatgattgagaacatgcggtgtttggttttctgtccttgtgatagtttgctcagaatgatggcttccagcttcatccatgtccctgcaaaggacatgaactcatcattttttatggctgcatagtattccatggtgtatatgtgccacattttcttaatccagtctatcattgatggacatctgggtttgttccaagtctttgctattgtgaatagtgctagaataaaatacatgtgcatgtgtctttatagtagcgtgatttataatcctttgggtatatacccagtaatgggatggctgggtcaaatggtatttctagttctagatccttgaggaattgccacactgtcttccacaatggttgaactaatttacactcccactaacagtgttaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagcgtctgttcatatcctttgcccactttttaatggggttgtttcatttcttcttgtaaattagtttaagttctttatagattctggatattagccctttgtcagatgggtagattgcaaaaattttctcccattctgtaggttgcctgttcactctgatggtagtttcttttgctgtgcagaagccctttagattaattcgatcccatttgtctattttggcttttgttgccattgcttttggtgttttagtctttgcccatgcctgtgtcctcaatggtattgcctaggttttcttctagggattttttttttttttttttttttgagacggagtctcgctctgtggctcaggctggagtgcagtggcgcgatctcgactcactgcaagctccgcctcctgggttcacgccattctcctgcctcagcctcccgagtagctgggactacaggcgcccgccatcacgcccggctaatttttttgtatttttttagtagagacggggtttctccgtgttagccaggatggtctcgatctcctgacctcgtgatccgcccgcctcggcctcccaaagtgctgggattacaagcgtgagccaccgcgcccggcctcttctagggattttatagttttaggtcttacatttaagtctttaatccatcttgaattaatttttgtataaggtgtaaggaagggatccagtttcagctttctacatatggttacccagttttcccagcaccatttattaaacagggaatcctttccccattccttgtttttgtcaggtttgtcaaagatcagatggttgtagatgtatggtgttatttctgaggcctctgttctgttccattggtctatatatttgttttcgtaccagtaccatgttgttttcgttactgtagccttgtagtatactttgaagttaggtagcatgatagcatcacaattctatacacatttcaggaatgatttttttaaagagacacctcaattcttaatgatttttaaatttttgtaaaataatcaaatgcaaccaatggactgattgaataaatctacttttccctttttgttgatgggccctaaatttccaagtcttctgtgtataaggtgggcttaattttacaaatagtcattttgaagttaaaataacttgttttctgtatacccaattttaaaattcagaatgccatatcagccactttatggataatttctcacatacttctttctctgaatatgagaattttaaaaatttatgcaaaaatgtttcaacttacaatggcatattttaatataacatcttcaatttcaactttttccttttggatatacttttatagaaaggaattcagtatttattaaaccactattttcttcatctattggcagtgtgtttaaggaattcagtttataccttgtgggaatctttttcagataaactgtatatcaagtagttttgtggtgtttgaaggaactttttggcattcagggccatttcttgtgctgtacaaagcagcccttagtgctttctggagagcagactacttaaaattcatatgaacacattcgatgtgatgtgtatgtttagaatcactattgaaatatttctctatttaattggggtggttcatgctaattcacatggcggacattggcagctattttcagtctaccaattttttcttcgggggacatagtaaaatctctgcttccataaatgtttccactttctgaatgcagcagttttcccttcttcttctagctctttcttagtgggcagagagaacaggaaatgctagttgttgcaatgcaagcctggcaggcaagcacacctctcttccccaggaactgagtaagccacgatgctcaactccagtgactgttgaatttcaacagctgcaccctctctttttacccctggtgtcacatagagcatatgctcttggacattcaggaaatcaagtattgcttccattctggccatggtgctagaaatgcagggttttatctctttacctcaaccatttctgtctcctccctcagctcctaggaagctgctgactcacccttttcttgacaagtccttctgggtagtcttcctggatagcatctgagatgaaccccaaactggcacactttctatctctttctgtctgccacatctggaatcacaataaagaggacactactggtaaggacttcaaatgcatgtcaaatggtcagagccatgggctctaggaacaggtgccagcaagtcacaacaaagggttaaatgagaccaatctgcccactccacagtgggcacctctggactctgggtggatctgaggactcttctttggtctgaatatgttggaaacttatttgccagtgaaacagttttgagacatgaaacctttaagaaggcagagccctcataagtggactaacaccattatcgtggaagtgggttcattattaagagagtaggcttgttataaaagcaagttcagcctcctcttgctcttgctcttgacctcttttgccgttccactttctgtcatgacataatgcagcatgaaggcccttgtcagatgtcggcatcatgctcttggacttccagcctccagaaccatgaaccacataaacttctgttcatcataaattacccagtctgtggtactctgttacagcagcataaaacagactaacacagacccatcatctcctgacacagatataaagtgaatccctagcaggcatctttgtccctcagaaaagtcctggaggccaagtagtggaacagcagcataccaatatctttcccacaaaaaacctttctaatttcgtgtccaatatttctaaaagaatggaggcaagtggtcttccgagggtccccaaattattcccagccgcctccttggcaaggtctgctttgatggattcacagattgttctgcaatatgagtagcattgacagttactatctttgggcctcagtcaaaacagagacagagaatacccatttaacaggcactccaacttaggtatccacagaacgtatagttttgttattctctatcatgggcctgctcttgccaatgtttcagcagatagctgcgtagtttagaatttctagttaataatatttcagtttcaactgtctcccttcagtttaatatggggtgtatttaaaataaatacaactccctattagatattaaaggattgttttggaacaactgagtcctttcagataaatcttcaatactctacttttctctcacttctctcactcttttttgtttgtttttttgtttgtttgtttgtttgtttgagacagagtctcactctgtcacccaggctggagtgcaatggtgtgaccttggctcactgcaacctccgcttcttgggtttaagtgattctcatgcctcaatctctggagtagctgggattacaggcatgtgtcaccacacctggctaattttttttggtagtttttgtagagacacagcccaccttggcctcccaaagtgctgaaattacaggtgtaagccactgcgcccagactcactctcctttacttctccaggttggtggctgtgtctatgaggagtaccctttctatgtctgcaggaggagagtgggtccttgcatccacacagcagcctggagtgtcactctggacactctcttgcctcagcctcccgagaagctgggactacaggcatgtgccaccacacccagctaatttttgtatttttagtagagacggggtttcactatgttggccaggatggtcttgatctcttgacctcgtgatctgcctgcctcggcctcccaaagtgctgggattacaggcgtgagccactgtgcctggctgatagtttcttatactgtgaagaagctctttagttcaattagatcccatttgttaatttgtgctttgttgcaattgctttttgtgtttttgttatgaaatctttgccacttcctatgtccagaatggtatttcctaggttattttccagggtttttatagttttgggttttatatttaaggcgttaatccattttgagttgatttttgtgtatgctgtaaagaaggaatccagtttcagtcttctacatgtggctagccagttatcctagcaccatttattgaaataagaagtcttttctccattgcttgtttctgtcatatttgtcaaaggtcagatgatttagatgtctggtcttatttctggattatctatttggttctgttggtctatgtgtctgtttttgtaccagtatcatgctgttttagttactgtagccttgtagtatagtttgaagtccggtaatgtgatgcctccagctttgttatttttgcttaggattgccttggctatttgggctctttttaaattgtgtagttaagtaatgttaagcacattcacctgaataatcttgccaaagtaaaactttataatcattgaacaacaattcccacttttcaactctccccaaccctggtaaccactattctatcttgtgtttcaataaattttgctactttaaataccttgtaaaagtggaatcatacagtatttgcctttttgtaagtgacttatttcatttagcccagagtcttcgaggttcatttatgttatagcatgtgaaataatttcctttgtttttaaggtagaataatatcacactgtgtgcctataccacattttgtttatccactcatctgctgatgaacgtttaggttgcttccaccttttggctgttgtgaatagtacagctatgaacgtaggtgtgaaagacctcaagatgctgtttttaattcttttgggtatatactcagaagtgagattgctagatcatatattcaattttttgaaaaaccactatagcttttgagccaatgtttcaacagatagctgaataagttagaatttacagtgaacaatattacagtttcttccagtttcaactgtctcccttcagtttaaatatggaatctatttaaaatacaccccccattcgattttaaatgattactttggaataactgagtctttttaggtaaatccttaatacttcactttccatagctgttgcaccattttacagtccccacagtgcacaagagtcccgatttctcgacattcttgtcaatagttgtgattttacttatttattttggtagtattcatctgaatgggagtaaggtgatatatcattgcattgcaattggttttgatttgcatttctctgataattagtcactaattattattgagcatcttatacttccgtgatgacgtgggaatttttcttcattgtacaacagatatcattatagtggcgtagttctacactctacacaattttttctaacactacacaaaagcaaacactaaatctaacttccaattgtcaggattactggtctactcctctacccacccataggctgattataaatctttgaaattaattacatctaaaatttttctttcctgtcaagtcactgttgacgaggttcctctgctcacattggcagtctctttctttctcatgattcttcaagtcgtcattttgttagaggccaagctttcactcatggactgaagttatattgtgtgctttttgcctgagtgtttaatcccttaatttacaagcggatgtaggagtgcatacccaggaggtgagggcaaagactcccgttgagtctttggaatctcaaatctgttaccgttttggcttgggacaacaaacatcctgtcagtctcaattgctgtataattgaaaagagaatgataacagttgtcctacatacatcataactctctttgaatcaatgataattaatccatgtgaaaagctttcaaaaacttgtaaaaatccctcataattatatggtgttttacaatttacaaagaactttcacatgcagatttctcacgtgatttttatgttttgagggcagagtgagaaattataaagtatctgtgtatatgccaataatgatgcctaatatcccccactttacatatttaaaagacctttaaaattatggcttttcctagttttcacagcacattaaaaaagccaataccactacacaggtgtgtagtttctggtcttgtgcactgaccatttcctacaccatctttttgtatgctctctagcttccgtagttgttactcgagtagaagagtactgaaaggccacgtagaatatacagcttggtttcatcccactgataaaaatctacttttaacatacatgttaaaataatcaagcctgactaaattatttttgtattttttccattttacctgttatcaactttttaattaagcaatggggccatggtaggcagggtattccctagaacttgtgaatatgttaccctacatgacagaaggactttcagatgtaattaaacttaatgacgttgagttagagagagggtcctgcccagtggaatcacaagggtccttaaaggtataagaaggagtcagaggacagagtcagaaggagacgtgctgatgtgagaatggtcagagagatacaaccttcctgtctttgaagatggaggaaaggggccttgagccaaggattgttgttggcctttagaaactggaaaatgcaagaaaatcaagtctccctaaagcccctagaagggaacacagtccaactaattcatttattttagcccaggagatccctgttgggcttccgacttacagtactggaagataatacattcctggtggtttgtgtcacaaggtctgtagtactttgttccagtatcagtagaaaaccggtagaaggggaattcacgtaaatatcattacacacagaaataattacttattattcttttgttctcaaatcctaccttgtaaacaaaatgaatttttgtttttcggggcttttgtactaattcttatgaatccactgatattttgttttttctgtcgtctccctcaggaacccgaaaggaagaagctatacgactggggacacatgtcttagaagcacactcattagataaagtgtcgcatactctttgataaggtaaggctccctggacgagatgttttacaggtaccatgagctcagtgaattgcttttggaaagacactcagcggagtgggcaccacgaggttaggagaagcagcttctgctcgtcataactttggcaaatgtttacacatcagtaatgaaaaatattctcttggcgatttcaggcttgttactatggatgttgtttgctaacattgactatttttcctaactgcttatagaaactccaggctgtcacccatctgttctctcatcaaagtagttttgggccagcaactatttcagacatttctacagtttcagatgtctcactctgcctatgactgtatgttgtacttgaggactggacgcacagggtaaagtgcaaatagcaagcattcaggtccaactctcctccttctggttaacaatatgaaagaaagaggtagtatcggaattattttagttcaatgtagccattataaaatgtgtatatattttaaaacatcatgtggtacatgataaatatatacaacttttatttttcaataaaaaattataaaaaaagtcatcaaacctgatttctcatactacttttttggtaacactcatcacaccaaagacttattattttaaaatgttatttttcataattaatttcttattaattttataggctagattttaattgttatgtctaaatagtagtgtctggtacgtggtagataatcaatgtgacttgaataaatgaataagtctgttaacgacatacttctcatcactgtaacttatttttggtttaggactgataaaacattttttctctcaccccatattgctaaagatcaaatccttcttctttaagatgctaccataccattgttccattcatcaacgccaaatcattcctcgggcctgagaggagctgccatccttcacttcgtctttgggtcacttccaacctctgttctctgtgtgtctcttctggacttcctgggagaatagcctctctcatgatactcactttcttccacatcttcaatctctgcttcattgatagattatgctactcaatatagaaacaacatcttttttattttttaatgataaacattctccccctcaatcttttaacctactaatgcaggcaatctaatctaaagaatagcctgcaatgcctcctttcatcatttcccatttaatccagctttctggctgagtaattttgcagaaagccctttctcccatgtcacagatggaactttgcagtggcctattctgataaacatgtggcagtttacatgctatttgcatttgaagctgtttatcactccctccttctgagtactttcttcttggtgggcttttatgatagtaattgctatcctactgctgagtttctgaccactgcttgtcagacactttattatgctccctttcctttgcccatacttgcaaagttagatttccacatatgcctttcccgtcttcttattccatgagatttatctaagtgatttcatccattgctatgggttcaactgctgctaatatgttctttactcccaactctctttctacagcttcacatatttaactgccttttagggaatcaccaaaaggcaattccatcttaacatacacaaaactgaacttatgatccttaagtatgaggccagttctttcttatgcattttctaaatcagtgagtgatactatctcttgtcctgttgtcctgggcagaattgcaggaggtgaccgctttctctaccctccctataaaaattaccatctctcgtttaccaacctcccaataccccaatcattagtatctttttaagaaatgattttctgttgtttaacattttttatatgctattacctatatggttttcctcctgaaatgggatattgggtaagagggtaccagatggaggtcacatagacctacagtttattcaaaggggacatctatggagcaaaggcaaaatggagaacccagtgcagccaaacagctactcaaaggtctgagcagagatacagaaatgacacaggagataacagaaagagagagacatatcaagtgggttttgagtgtaggcaaaaccacatttacccgtagctctggagaacccactggcactgttttgagactgttgcagcctgcaagggagggcggacactgagttcagacacacacaccctccgaccagctcccaaatgtctgctgacgtttacaactttgcttcctgctttcctacctggtcttagccttttgatacacaccctcccactgctatcagagtaagatttgagctaagtacataatctggccctgccagattatgacattagttggagaatagataggtcaatgggacctgagatacattttagaaaaatattaatatgtatgccttatgtatagtgtgcagctggcattttaaacacgtggaaaatgatgaaaaatttaataaaccatgagaggaaattggataaatatttccgatacacacacacatcagattcccttttttatgtcacatgcaaaactaaaataatatttgaatggcttaatcagtgaaatatttttctaaattaactaacataccggaaaatatttgacttatctcaaaccaaatatgtatttttattgtatagggttttttcttttttaaaaaatttcagcttgcaatttagatataggaggtacatgggcagatttgttacaatggactattgcatgatgctgtggtttgaagtacgtttcccatcaccctggtagtgagcatagttcctgataggtagtcttttttaacctaacctccctccctccctccctccaccgtctagtagtccacagtgtctattgtgtctcatatttatgtccatacatgctcaatgcttagcttccatttataagtgagaatatgtggtatttggttttctgtttctgcattcatttgcttagatcgccccagctccatctatgttgctgcaaagaatgtgattttattcttttttatggcgtatagtatttcatggtgtttatgtaccacattttctttgtccaatttcctactgatggtcgcctgtgtggattccatgtctttgctattgtgaatagtgatgcagtggacatctgagtgtaaatgtgtttttggcagaatgatttattttcttttgagtgtatacccagtaatgggattgctgagtcaaatggtagctttgttttaagttttgagaaatctccagactgcttcctcagtggattggtctaatttacattcccactaacagcgtataagctttcccttttctctgcaatgttgccagcatctgtttttttgactttttataatagccattctgactggtatgagatggtatctcattgtggttttgatttggatttctctgatgattagcgatgctgagcgttttttcacacatttgatgtatgtcttctttgagaaatgtctgttcatgtctttgcccatcttttaatggggttaattgggttttgtttgttcaactgtttaagttccctatagattctggatattaggcctttgtcaggtgcatactttgcgaatatctcctcccattccctagactgcctgtttactgtgctgatttttactctctgtttattttgctatgtaaaagttctggagtttaattaggtcccacttgtcccgtttttgtttttgttgcaagtgcttttggggacttagctaaaaattatttgccaaggctgatgtccagaagaatgtttcctaggttgccttccagaatttttatagtttgaggtcttacatttaaatctttaatgtattttcagttaatttttgtatgaggtgaaacggaggggtccagtttcattctgctacatatggctagccagttatcccagctgtgtttattgaatagggagttctttcccattgcttgtttttgttggccttgtcaaagatcagatggttgttggtatgtagctttatttgtttgttttctattcttttgcattggtctatgtgtctgtttctgtaacagcaccatgctgttttggttactgtggctttatagtatagtatgaggttggaaagagtgatgcctctggcattgttctttttgcttaggctttctttggctgttcaggctctttttggttcaatacaaattttagagtaattttctaattttagtaaattttctaaagtaaatgttctaatcctgtgaagaatgacgttggtaatttgataggtatagcattgaatctgtaaagtgctttgagcaatacggccatttttacaatagtggttttggtactgaaacaccaggtgctcagtctaggtcctgctgcttgctgcacagaaagccaatgactgagacagcaagtattgccaaggaagaagctttaatccggtgctgcagcagaggaggtgggaactcagtctcaaatccatctctctgacctactaaaaccagggatttatataacaaggaaggaatgtaacattgtgtaagaaaacaggaactagggaggtgtcaggaagcaatcgcgatgaatgaggggtacaacatctcattgtctggatgtgatgatctactgagtttcagttctttgacactttttgtgagaggcctgaaggtcatttcctcaggaaggaactcagataaaacaaatataagtttcaagctttaagaccagaagggtcaatttctatgtttattaaaaagaaaaaaactgttagactgggcgtggtggctcatgcctgtaatcccagcactttgggaggctgaggcgggcagatcacgaggtcaagagattgagaccatcctggccaacatggtgaagcatcatgtctactaaaaatacaaaaattagccaggcatggtggcacatgcctgtaatcccagctacttgggaggctgaggcaggagaattgcttgaacctgggaggcggagggtgcagtgaactgagattgcaccactgcactccagcctggtgacagagcgatactccatctcaaaaacaaaaaccaaaaaccaaaaaaacaaaaaaaaaaccaaacaccagaataaaactgtctatgggacaattgggtcagctttagtttttccaatccttgagcatgggatatttttccatttatttgtgtcgtctcatctcttatttctttcagcagtgttttgtgcttctcgtagagatcgttcatctccttggttagctgtatgcctataggtattttattttctttgtggctgttgtaagtgggactgtgttcttgatttcaccctcagcctggatgctgttggtgaaatatgtatttttaaaaaagaaaagcaaaaaaaaaaaatagatagacttgactaaacaaacattattataaacaagaatgagtgtcaatattcttttccataaggtactcttacaaatcagtgtaaagaattataatttctctatttaaaaaaggagatagcattgccagttcacaaattgtatataagtggcctatgaatgcaaaaacctcaattgcataagtaataaaaaagtctaaataaagtgatattacaaattgtataaaagtggcctataaatgcaaaaaccttaattgcataagtaataaaaaaagtctaaataaagtgatattattttctactgatacaattgatggggagaaaaaccaaaataaagtgaacagaagaaaatggggaaaaagggagccttttagactgctagtgggagggtaactttgtataaactattagaatacaatttgtcaatccgtgttacaatcaaattgttcattcactttgtaacaacagttctatttctaggaaataattatagatggcaactatttctatataaagcttttcattacaatgttaaatatgataaaattggggatactcaagtggtcactaataggagcatgactaaataaactttggtagtgacagtgaatagaataccatgcatctattagaaatgccttttagaaaataaagtcaatggcatggggatacagacataatttgtaaagcagtataactcaaatttgtagaaagaaattacaggacaaagactggtactgattcaaaatggtgcctggctacgacgggcctttgtccccagaattaagcctggagaattgtcctcgaagtaaagcaggtgctctacgtgtagaaagctcctggtgcggatgctggactctgagagaaggctgagcacagccttgggtaatgcagaacttcctcaaaaggcaaggaggcaaaaataaaacaagtgaagagcaactctcttagaagaggaaatgcactcaagcccttgggccacagagaaaagtgctcctgaaactggaaactctatggtctcccagcctccagcctgcctgctcttcagtcagtcaccctacaggtgacaccccctgcattccccactctcattttcagagagctgctgccgggaccctcattctgggaatggactatgaggaaggagacctacatagttgtcaaggaaacctatgccagttacatatgccatacattttaatcgcttagttatcaatgtgacaggtagggagaaaacaccaaatgcttgaggaaaaccaggggtatgaaagagaagcattaagattactttttaatggaaatgtatatattcacctaggctattcttccttacccaagttgaaactgaatagtatgacctaaacgtacatttcgtgtgctgggaagaaaaagcaactgataaccccctttcccgtaggtttcctgtcattaatttgctcaccagtgcaaccccattcaggcccccaagctagtgccatcttgtgtgcacaaggctggggcaattggattcataagaagttttgtccatgaggaattttcagtctaatgccaagtaattgacaatgaaaatgtttcctggtttccatccaaatatttattaatacagcaaaaatgtaggatttgtaggatttatgtatcttccaactatctccactactgcaggacacagacaccatctataaatctcacattgtaaccactaacacttatctttgttattgtcacctggaatcttttatgccaaaataagagtcttaaaagaatgaagccctgcaatttcactgtccaacaacagaggttttacctgataaatcgtcttctcgtctgacagagtgggccacagaaacatctctgacagctgttgcatgatggagtgggagcaaggtcacttcctgcaaatgttagggttcttcagaatccttcaggcgttggaggaataattgaactcaacaggcaatcagtcacgtctgaaacatgtgaaatatacctaaggacccgaggtcagggttgagtgtccaaattcaaccagttattcacacggtctgaaaatgaaaatgtttcatttcagagaagtttatatggagtccttgacagaatgttgaatatgaaatagattttttttctgtcttcctttgaaaatctttgtggataaagcttaacatggtgcattagaatcttaggagtaaaatatccctcacaaaatttgatatcttatctgattagttaatacagacatattacatttttcaactaattttttttcttaagaagaattctttcagaaacggagaagcatgtagtaacatactgattttaaggaacctatgctaacaattttaagtagtaaaacttaaaactaaacttaagaagtaataaaaaggtgataataggataattactatttggcatcctactaagatatttagttggcaatttaattttaaattacctggttttctctgatattcacatattattaaatgcaatttcatttaagctgctctactaagtgttagggaaatatgaaaattgaaagtgtgaccttgttgtccagtaaagtaattttatcgaatttggtagactcttaattgtccctaagtattcattttccctttctttttttttttttattgtagcttttcttttgaaatatgcgttgcctcccagacattgcaaaatggtatagtgagttctggtgtattcttttttttttttttttttttttttttttggagagacggacttgttctgtctctcaggctggagggcagtggtgtgatcatggctcactgttgcctcgacctcccaggaacaagcgatcctcttgcctcaacctcctgagtagctagaactacaatcacccctcaccatgcccagctaatttttaaattttttgtagagatgaggtccgctatgttgcccaggctgatttagaactcctggcctcaagggatcctcctgctttggtttcccaaagcgctgggattcaggcatgagccactgtgcccagacttaattctggcgtattcttaagccagtgtcccctaatgaaaatatcttccaggacctcagtgcatggtccaaatgaggaagctgttaagaggtacaatactattaacacatgtacatacagatttcaacagcatttaagttcagttttttctttctgtcttttgttttgtgtttatagttctttttctgtcttcctttgaaaatctttctggataaagatgtttccacagatttctgtagatgtgttcagccatcaccacccagtcccagttagaatcagggtacagaactgcttcatcagtctcatgagaaggtgtgactgaaaggagcagtgcaaagatgctcctttgtcctttcagtcacgctttctccctgactctgacctttggcaccagctgttaggtcttcacactctaattttacactttaagaaaggtatgtaagggcagggtgcagtggctcacacctgtaatcccagcactttgggaggccaaggtgggcggatcacgaggtcaggagatcgagaccatcctggctaacacggtgaaaccccgtctctactaaaaaaagtacaaaaaattagccaggcatggtggtgggcgcctgtagtcccagctactcgggaggctgaggcaggagaatggcttgaacccaggaggtggagcttgcagtgagctgagatcgcaccactgcactccagcctgggtgacagagtgacactctgtctcaaaaacaaaaaaaaaaaagaatggtacgtaagtagaataatgtaggtagcaccattttgagattgcttttttttcattcatcataaagccctacaaatccacctaagctgttgcctgcattgatagtttgtttctttgttttgtgtcacagtttgtctatttattcacaggttgaaggatgtttgagtggtttcaagtcgtgggctgctacacatgaagcagcaatgaacatctgtgttcacattcctgtgtgactgtgtgtttcacttctgtagcataaatacccaggaggcctggattgcattgcaaatatgtttttaactttgtaggaaacagccataccaccttccacaatggttatgctgttttccatttccatcagcagtgcatgagaaagcctgctgctctgcgtgcttgtcagcacacggtattgtcagtatttttattttagccacttattaggtgtgcattgatgtctcattgtagctttaatttgcatttccctaatggctaatgatggtgaacatctttttatgtgcttatttgctatctctataccttccttgatgaggtgtcaacaaatgttttgcctgttttcttgttgttgaggttgcagcattctttatatggtctggataaaagttctttcttaggtatgtgatttgtaaatatttcttccaggcaatagctaactttttatcctcctaacaagccctacttagaactgaagtttgaaagtttgatgaagtccatattaccaatttttttctttcttagacatgacaactttttgtctaactcttgcacaggaagatttttttcctgtgttttcttctagaaatgttgtagtttcacactttacatttagatctatgatctattttgagttaatttttatagaaagtgtgaagtttaggtctagctttttgtttgtgtgttttcttttttggcctacagtgtttaattttcccaacatcttttgttgcaaattctaatcttcctctatgggattgctttgcattttcattttaaaaaattaagttgactgcacctatgcaggtctatgtccagttcctttatcctgtgccattgatccgttcctctgcccaagccacactgtgaggctgtcttcccaagctcctccctttccaggatctccccggccacagcttctcctttcctcgttttgatcatctagccagaaagctgggcttttagttactcagctctgctgtgcacatcctgcaactgcggctgctccaagcaggagatacagagaaaaagaagccagtcttttcctcaccaccttagaaagagaggtccctgccttgaagctcacgctccccgcacctgctgccttcacagtccttaccctgcagagcgcggcttgagagaggagaggggcgagcttgggatggtggatggccctcccagctctgagctttgggggccagagctaaaagagaggctgctgtctccaagttgccttcaatccaagctggagaattctgcagacaaatagggcgctttcctccactttggtagtacttcaaaatcttgtcttcttcctcaatgcgtcaactaccacccagttttcagagccctccaacctcttttccctgcatttcttcctggcactggatccctaagtactcagtttaatccatacattgcccttatcatttctttttttctttttctttttctttttcttttttttttttttgagacagagtttcactctgtctcttaagctggagtgcaatggtgcaatcttggctcactgcaaactcagcctcccgagttcaagaggttctcctgcctcagcctcccgagtaactgcgattacaggcacctgccaccatgcccagctaacttttttttttttttttgtagttttattagagatggggttttgccacgttggccaggctggtctcgaactcctgaccttaggtgatccatctgcctcggcctcccaaagtgctgggattacaggtgtgagccaccatgcccagcccgcccttgccatttccatcatctgtctttcacactggatcttttttcagttgttccaataaaccaagtggtaaaaatttgaaaagtgaatgtgagtaataggaccaaatttaaaaagttatagaattttagggttggagaggaacgtgaaagagttataatcaccctttcaagccaccaagctgagatgaaatgccttgccctaagtcactcttagccctctgatcttcctacgatgtcatgcgactttcacatagaaactaaaaggacttaccattaatttctcctctttcatttacacatatgaatttttttaaaagtctttctcatatcttgactaagttatactcacaaaacctacccatttttctgctgaatttattcttgaacttgaatacagtctcatgtggaaacagtaataataccaaaattgcaaataatctttatatctgacattgctcttagttaattctgttgctagtttggaaagttttttttttttaaaaaagaatgtttaaacatcattacgtttaaaacattttaaagcctgagtacgagttttaaatcagaatcactgacttccctcccttacacctcattattacaaaccttgatttgaaagccgtatttcctacaaagagtcaaacgagaaaaaacatactcctgtgtgaaaagaaatataccaatgtaccaaatccttatagtttctcttccccaacctgtgaccaatgttcaccctttggtgccagactcatctgttttacacacacacacacacacacgcacacacacacaccccgaaaacttgatgtaaaatgtaaataattcatattagacataataataaggaaaggaaagcaaatagcaaatgtgcctttgttgttaggagtgaagatgcaggttcagaattgtctgtgctgagtaaggataaggtcttaatatctgagaaaaggggtctgaatcctgaggaggatatacagaaagtggccttttgaattagactatttgggcaaatgtgcagaatgatggcgactgactgggcagaactggcgtatggcaccaggttgtagcaatggagatgaaataaaagggcctgatccctaaaagaactttaaaggaagaaacaacaggacccactaacaaatggaaaataagtgatgaaggaagataatcacaataatatgtagtgaatctgagtcttttggccagggaacttgtgacaaatatagaagtaccaaaaaaaaaaaaatagagacattcgaaagatggatatgggatggaaaaaatgaattgttcaggatgtgctgagcttgaaatatcaaggtcatattcaacagaaaaagaaatattgtgaaggggcccagatgtgagggtagggcaaaaaatgatattagtagaaaagtcatttgagtaaagaaagtggatatgttaatagggaaaacagagtgcttggcccagggcagaccctgtaagattcccatgagtaaggatcagcaggtcaaagatttaccagtaagaagacagaggccaatgagacaaagcaagaaagcccagagtccagagagcatgagggagtcctgtttcagaaggggagggtgactagccggaagacttggagaaagtggaagatgaagaaaatcctttgagcgggggagcactgtctggcttggaagatggtcctaggagataggtggggaaatggccagatttggggaggaagaatactggggaatgtgaaaggtctgtgcctagagaacaatgcgtcaggacatggtgatggaatgaagggattggacagcgctgaacattttaggagacagaaggaaaagaagagtgaagtgagacagaaagacatggaggatgtgaaagaaaatgtgaggatttatattcaaaataccaaaaagctttctaattcctagacttgcccccggctagagtgggctatctgggtgaagagtttatacagatatccccatatacactatttattctacttagataacactctagagacactatgtcctgttttcttgaaagactcataccaatggtgacatttcagatcttctaaggaagtttattttagcttcaaaataacacgggtggcacgggggaagtatttttagcctcaaggagcgttttaggccaggcacagtggctcaggcctgtaatcccagcactttgtgaggctgaggtgggaggatcatgaggtcaggagttcgagaccagcctggccaacatagtgaaaccccatctctactaaagatacaaaaattagctgggcttggtcgtgtacacctgtaatcccagctactcaggagactggggcaggagaatcacttgaacccggaaggtggaggttgcagtgatctgagattatgccactgcactccagcctggttgacagagcgagactctgtcaaaaaaaaaaaaaaaaaagagaggactttagtacttctgaaactcctctgtgtagctcttcgttcaagcaatcctaactcagaagtacaagaaggataatattcttgtgtgtgctctgaagctatttagtagcatcagaaaggtggagaataagtagcttataaaacattgacagctcttcaaattggactaacaggaaatctccaggcattttattcataattttggaagaaatgcaataacaaagatttaatgggtcccatattgtgaaacataattgatctagaataagtactattcttattcctatagacaatcatactctgagattttggtcaagtatcagttgattgttaattatctacgtgtttgaaatatatgaaatttaatagagaggccataagtcacatccaagaagtactaagagaaagcaccactgcaaaatcttggtaaattcagaaaataataacaaatctcataatgaaataaatattttattgggattataagacctaccatccaaagaaccattaggaactttacaataactcattaatttatatgggaaatatgacagaaagcaatttctgcttttacttcttttcttctttacttctttcccttagtgtgttttgcatgtgtgtttgtgtttccttgaatcgttgcttaatccaagaagctttcaattgacatcccatgtcagacgggaatgccactgtatcacttattgatttcaacagtggtagtttactcctggaaactaaaaccgttaggtgtttctaaaatgtatgcacacacacacacacacacaaacagagtttaagggttaagtatttatcttcctacctgtatttttcagaagaaagaagaaaaggaggatatgcttctgtactagagactactctttattagaaaagcacaggaacaattctcaacctgaatattttcaataaatgccttggtgaaaattactgaagtggtgctacaaaattgccttgtcttatttttgaggacatgtggaaagcctttctacaacttttagatatatgtaataaagctgaacattcttcacatcatccaaacttattagagagcttaaagtgtaatagtcaaatcgctagcattggttagtttgaatgaatagtccttttaagacttttttttttttttgagatggagtctcgctctgttgcccaggctggagtgcagtggtgcgatcttggctcactgcaagctccacctcccgggttcatgccattctcctgcctcagcctctggagtagctgggaccacaggcacccaccaccatgcctggctaattttttgtatttttagtagagacggggtttcaccgtgttagccaggatggtctcgatctcctgacctcgtgatcctcccgcctccacgtcccaaagtgctgggattacaggcatgagccactgcgcccagccaagactttttaaaatgcttccttcttcatggatctgggctcctgagtgagtgtgctgagtgaatcatgcatggtagcagacacctttcggaatccggcttcagtagacgtgagggtaactccagtgctcagaaaaggtcccttagcagctggacttgctcaaggtgactggatgctcgtcataagatttccaggttgggtctgagttatgtcaagtactagttggaattgatttattgctgtcttgctcacaagccaggagcacacttctgaagttgccaagagtgtgaaaaagcagatatccaaattgtgaagtgagtggtttcctacattaactcgaattgattttgttcttcctaatgctgataaggattattttggagtagaatacagtagccccctcttatccatggggatacattccaagaccctcagtaattgtctgaagtcccggacagtattgaaccctacatatactatgttttttcttatgcatacatgtctttaataaagtttaatttacaaattaggcacagtaggagactcacagtatctaataaattggacgattataaaaaaactgtaataaaattatgtgaatgtggtctccttctctccaagtatactatagtgctgtaatcacctattttcagcccatgctgacttctagtaactgaaacctcaaaaagcaaaactccagataaggggtttcatttactgtaataaaatgaaaattctgtaaacatgtttagttgaaaatatcttacagacatacataattcagtggaagcgatagtgatatgtttcagaaattcagattcaagatttcagaaattcagtttcaaggttcaaggctcctctgacaattgaatgacttagtttttcaaatataatcaagattctgccttgaattatatataatatatattattattatttccatatataatttatggaaaagttataaaattaatataaacatttgaaatactgtcttttggctcactttgaaaagatttccagtttgcttctaaatgaataacaaatttgaaaggccaagtgatttaaggcaggtacatcactacttagcaatacgatttgttcaagcaggtgaaaagtatgcaagaatcaaaatgctctttgcaaaaggagcttcaattttcatcaggaaaacccagtttgtgtcagagggtgaaacttgcttgactagatctgttcactgaagccattgaacaacttccgatgttcttgctctctcccatttacgatgctgaactttacagagacagactgtttgaagccttcctaattattcccattcttagccaagaaggattactaaagctcagcctctattgtaattcttaaacttctcagtgcaaattattaatatatggcaatctaaaatgcctttctctggctttatgacctgattattatttcgagtctctctagcagtgaacttgaggatcatgcaaacatgttctatgggaacatcactgtgtagctgaataatttgttttttagtaagctagctcaaatttatcatcagtcatgaaaatgttttatcaatgctcttccataaagcagacatattattttactagtttcagtttagccctgacagaaacctgatcgggaatactattattaagccacaaatacctgttttaaaatatgttgtcttatgctatttcattgtattgtattaataattcatgtaatatttcctttggttttattgtcttctgtgttataattaaaactgaaataatttgggaaatgtaatgtatatagcacacatctaaagttcagagtgagaataaaactacaactattttatctattgcaatagctcaaatagtagagtttaactataatacttggtatacatatcaaacaaggtatctatacatacattattttaattttactcctccctcattttctctccacgtcccatcacataaatatgcacaaatttaactggccagaggtgacctacattctctacatgcagtgtccatgatgaagatagcaactgtatttgctaaggttttcacagttcataacagtgaaataaaatgtagctatggacattcattgattaatctaatatttattgaaggtgtatttgttagattccgtgatacaatgatgaacaagtcattgtgtaatcatgaagagcttctagccaagtgggtaaaaagataaggaaatcatcccaattagtgagataaactacaagatagggaatcattccgtgtgttaccagcacattctacccacgctgtatttttcagggaaaggtggtgtacattacctgatgtctaaataggaggtaaaagcataaggtgctgggagacaaaggagttgtagattacctgatatccaaataggaggaaatagcataaggtcatggaagagagaggggtgtagattacctgatgtccaaataggaggtaatagcgtaaggtcctgggagacaaaggtgttgtagattacctgatgtccaaataggaggaaatagcataaggtgctggaagagagagggctttagattacccgatgtccagataggaggtagtagcataaggtcctggaagagagagggttgtagattacatgatgtccaaataggaggtaacagcgtaaggtcctggaagacaaaggtgttgtagattacctgatgtccaaataggacgaaatagcataaggtcatggaagagagagcgttgtagattacctgatgtccaaataggagggaataccataaggtcctggaagacaaaggtgttgtagattacctgatgtccagataggaggtaatagcataaggtcctcgaacacaaaggtgttgtagattacctgatgtccaaataggaggtaatagcataaggtcctggaagacaaaggtgttgtaaattacccgatgtccaaataggaggtaatagtataaggtcttggaagacaaaggtgttgtagattgcctgatgtccaaagaggagggaatagcataaagtcctggaagacaaaggtgttattatattacctgatgtccaaataggaggtaatagcataaggtcctagaagacaaaggtattgtagattacctgatgtccaaataggaggtaatagcataaggtcctggaagacaaaggtcttgtagactacctgatgtccaaataggatgtaatcgcataaggttctggaacagagagggttgcatattacctgatgtccaaatagcaggtaagagcataaggtccgggaagagagagggcagtagattacctgatgtccaaataggatttaatagcatacgatcatggaagagagagggctgtagatgacatgatgtccaaataggaggtaatatcataaggtgctggaagagagagggcattacattacctgatgtccaagtaggaggtaatagcataaggtcctggaagagagagggttgtagattacatgatgttcaaataggaggaaatagcataaagtcatggaagagagagggttgtagattacatgatgttctaatagaaggtaacagcataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtattgtagattacctgatgtccaaataggaggcaacagcataaggtcctcaaagacaaacttgttgtagattacctgatgtccaaataggagggaatagcataagctcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatatcataaggtgctggaagagagagggcttaagataacctgatgtccaagtaggaggtaatagcataaggtcctggaagagagagggttgtagattacatgatgttctaatagaaggtaacaggataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtgttgtagattacctgatgtccaaataggaggcaacagcataaggtcctcaaagacaaacttgttgtagattacctgatgtccaaataggagggaatagcataagatcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatagcataaggtccttgtaagagagagggttgtagattacatgatttctaaatagggggtaatagcataatatcctggaagacaaaggtgttgcggattacctgatgtccaaataggaggaaatagcataaggtcctggaagaaagagggtagtacattaccggatgtccaaataggaagtaatagcataaggtcctggaagacaaaggtcttgtagactacctgatgtccaaataggaggtaatcacataaggttctggaacagagagggttgtatactacctgatgtccaaataggaagtaagagcataaggtccgggaagagagagggttgtagattatccggtgtccaagtaggcggtaatcgcataaggtcctggaagacagagggttgcagatgacctgatgtccaaatgggaggtaatagcataaggtcctggaagacaaaggtgttgtagattacctgaagtccaaataggaggtaatagcataaggtcctcgaaaacaaaggtgttggagattacctgatgtccaaatagcaggaaatagcataaggtcctggaagacaaaggtgttgtagattacttgatgtccaaataggaggtaatagcataaggtcctggaagacaaaggtgttgtagattacctgatgtctaaataggaggaaatagcataaggtcctggaggacaaaggtgttgtagattacatgatgtccaaataggacgtaatagcataaggtcctggaagacaaagttgttgtagattacctgatgtccaaataggaggtaatagaataaggtcctggaagagagggctgtaaattacctgatgtccaaataggaggtaatagaatcaggtcctggaggagagggctgtagattacctgatgtccaaataggaggtaatatcataaggtgctggaagagagagggcttaaaataacctgatgtccaagtaggaggtaatagcataaggtcttggaagagagaggtttgtagatatcatgatgttctaatagaaggtaacagcataaggtcctggaaggcaaaggtattgtagattacctgatgtccaaataggaggaaatagcataaagtcatggaagagagagggttgtagattacctgatgtccaaataggaggtaataccgtaaggtcctggaagacacaggtgttgtagattacctgatgtccaaataggaggcaatagcataaggtcctcaaagacaaagttgttgtagattacctgatgtccaaataggagggaatagcataaggtcctggaagatataggttttgttagattacctgatatccaaataggaggtaatagcataaggtcctcgaagacaaaggtgttgtagactacctgatgtccaaataggaggtaatagcataaggtcctggaagacaaaggtgttgtagattacctgatgtccaagtaggaggtaatagcataaggtgctggaagcgagagggctatagattacctgatatccaaataggaggtaataccataaggtcctggaagagagggttgtagattacgtgatgtccaattaggaggtaatagcataaggtccttgaagacaaaggtgttgtagattacgtgatgtccaaataggaggttatagcataaggtccgggaagacaaaggtgttgtagattacctgatgtccaaataggaggtaatagcataaggtgctggaagagagagggctgtagattacctgatatccaaataggaggtaatagcataaggtcctggaagacaaaggtgttgtagattacctgatgtccaaataggaggtaatagcataaggtgctggaagagagagggctgtagattacctgatatccaaataggaggtaatagcataaggtcctggaagagagggttgtagattacttgatgtccaaataggaggtaatagcataaggtcctggaagagagagggttgtagattacccgatgtccaataggaggtaatagcataagatcctgcaagagagagggttgtagatcatctgatgtccaaatattaggtaatagcataaggtcctgggatacaaaggtgttgtagattacctgatatccagataggaggaaatagcataagatcacggaagagagagggcagtagattacctgatgtccaaatagcaggtaatagcataatgtcctggaagagagggctgtagattacctggtgtccaaataggaggtaataggataaggtcattggagagagagggctgtagattacctgatgtccaagtaggaggtaatcacataaggtcctggaagagagagggttttatattacctcatgtccaaataggaggtaagagcataaggcccgggaagagagagggttgtagattatctgatgtgcaagtaggaggtaatcgcataaggtcctggaagagagagggttgtagatgacctgatgtccaaatgggaggtaatagcttaaggtcctggaagacaaaggtgttgtagattacctgaagtccaaacaggtggtaatagcataaggtcctcgaagacaaaggtgttgtagattacctgatttccaaataagaggtcatagcataaggtcctggaagtcaaaggtgttgtagattacctgatgtccaaataggaggtaatagcataaggttctggatgacaaagttgttgtaggttaccggatgtccaaataggaggtaatagaataaggtcctggaagagagggctgtagattacctcatgtccatataggaggtaatatcgtaaggtactggaagagagagggctttagattacccgatgtccaaataggaggtaatagcataaggtcctgaaagagagagggttgtagattacatgatgtccaaagaggaggtaatagcataagatcctggaagacaaaggtgttgtagattacctgatgtccaaataggaggaaatagcataaggccatggaagagagagcgttgtagattacctgatttctaaataggaggtaatactataagctccgggaagatacaggtgttgtagattaccttatgtccaaataggagttaatagcataaggtcctgcaagacaaaggttttgtagattacctgatgtccaaataggaggtaatagtataaggtcctggaagacaaagatgttttagaatacctgatgtccaagtaggaggtaatagcataaggtcctggaagacaaagatgttgtagattacctgatttccaaataggaggtagtagcagaaggtcctggaagacaaaggtgttttagattacctgatgtccaagtaggaggtactagcataaggtcctggaagacaaaggtgttgtagattacctgatttccaaataggaggtaatagcagaaggtcctggaagacaaaggtgttttagattacctgatgtccaagtaggaggtaatagcgtaaggtcctggaagacaaagttgttgtagattacctggtgtccaaataggaggtaatagcataaggtcctggaagacagaagtgttgtagattacctgatgtccaagtaggaggtaatagcataaggtcctggaagacaaaagtgttgtagattacctgatttccaaataggaggtaatagcagaaggtcccggaagacaaaagtgttttagattacctgatgtccaaataggaggtaatagaataaggtcctggaagagagggctgtagtttacctgatgtccaaatgggaggtaatatcataaggtgctggaaaagagagggctgtagattacctgatgtccaataggtggtaatagcataaagtcctggaagagagagggttgtagattacatgatgtccaaataggaggtaatagcataaggtcatggaagacaaaggtgttgtagattacgtgatgtgcaactgggaggtaatagcataaggtcctggaagacagagatgttgtagattacctgatgtccaaataggagctaatagcataaggtcctggaagagagtgtgtgttccagtcagaaggagctattggttcaggatagctgcaacatacatttagtcattatgatggaaaactgataatggagttaggcctgatgttgagatgtataattgaagaagagtgagaggatcacctttcaattcacaaagatcatcatagggccagtataaaagtattttagagacaagtaataatggaattagggaaaccagttcaggtaaaaaatgatgttgttctagattttggaggtgactgaagagaaaaagtacatataattcacttatagctctgcttatcctattacgggtatttctttctaatggagattacagatgttatttttaaaacactttgtgattctgaggaggcatttacttatgggtctagttgtatcattagtaacaatatatattgtgtttatcttaagcacacttctctgcacattatctcaacttcctgggttgcttgatcggataaagcatttatatttgtcttctaaaatatgactaaatactatccccaatcaaagtgacataatattccatagttgtgcaaatgtttagtttttttttttttgtgccgaaagataagtcacaggctggggtatttgatttttcttttaaaaatgataaagcagaaggagagagaaagagaccaagaaaataaaattgtatacagtgaaacacagatgttatctgaaaaatggattttttaagagaaatataggtataaaaggcattcatgagaaatacaagaagagagaaagagaagtgaataaattaaactcttttaattattgcaacagctcaaatagtagattttaactataatatttgatagacatgtgaggtctttatacatatactattttaattctctctctatatatataatgaaatgttattccaaaatgcaatataatcccgtggaaaatttattcagtcggaaaaaggagaaaataaggttctaatactgattttagtgcctcaggcaagacacataactttttgggcatcaatttctatatctgtaaaatgaaaacacacgccctactatgtatatcatatgtaaatgtctaaaatgagataatagtattgaaaatggctttgaaaaaaaatacaagggattgagtcactctaaggaatgactgttttttaggagtcaacaagaggcaaaggaaataaaatttattccaactaaatgaaaaagtgttactgaaatgttagccttttttttttttttttttttttgagacggagtctcgctctgtcgcccaggctggagtgcaggggcgcgatctcggctcactgcaagctctgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaatgttagccttttaagaatacaaaaaaatctaattatatatgaatacaatacctgaacccatgaaacttctgtagaatacatgaatctgtaaagttatgtattctaaacatttgtagccagaataactttcttcatattttccacattcttggtacacttacgtgtcacacatgttccctgtttttcaaacaaggtcaatgttttcattatatacatttacattgttattgtaactattttccaggtctgtcagtaaaatttagtctcacacattgataccacattcttgcaattatattgtaattctcacatagtaattcaagcctttttgaatatacaaatcatctgaatttattatatcactgctatgacacctcatacacatgttgagaccatttatgccagaaaagattagatttagtattcaaagagccaaatgtaaataattctggattgcttatccaaatggggaactcagagaacttctatagtttaaatatgcaaatattcaaaagtaatttttttgtgaccataccctcctgctactgaatgtttccttgagctggtgtcagaagcagggtttacaatgttgtgctctatttcctgtttaacctattgccaagatgttaattcagagtgaaataataagaacttagtgagaactgggggtgataaacaaagtgtcctcacagcggagaaactggaaaatgtatccttgaaagcgtgtgaatcgggtgagcgtacaacgggtaacatcagtattggtgttctcactgctgggtcagcactgaccagcagagtctggtgggagccagcaggaccagaaacatgtcctcagtttgggccaatttaaagaagttgggaagctttctagagcccggccgtgtgtctctgcccttgctacaactcctccctctgtctcacagccagagatgcacccatgatgacattcatgtaggctattaagggcgagcatttctcggaaggtgaagcaagatatggtagtcattccaagaaaccttccttctcagctgcgatttgtcaagaggaaagaagtggagttttcagtggaaagcagatgtgaatttggagcagtggggcacttccagagaatgagcccgggtcaattttcataggcaattggcaacatgaatgcataggcactgggaagaatgtaaatggcaagtccaggaagcaagtagtagctaacaaatgcgtgaaagagtagaggagtaaaataacgatttcatcctctgaatgctgcccagagtcaatcccactgtaccccgtgcagagaaagtgactccaggagtgtgtgcccagtctagaagaaacaacaacactccttccatgtagagccaaaatcgtgtgtgtccctcggcctgaggagctggaagaatcctgaatcttctccatttagggcaggagttttagtggcatgtcaaatgtgcaacatcctccaagcctagaacctagaggtggttctagaacacttttcttccttgcttccacatctgtccaattacccacctcaattaatagttaccagaatattcccagagaatcataccagcacactctttgcaccaggaaggggtacagatatgttacaagaagagaggtggctgtcagagtggaccacatgtctttttatagtttggtgctttgtctttcacaataccagcttgccgtctagcaggggatgtctagcgtctcctacaaacatactgattatctaggaacatcatagcaccaaagaggccttctgccctcttccattcccacattgttaagaaaaaaaaaaactggttacgtaaattacagcatattcatttaatacttggaatataaaaaggggtggaaacattgttaaggcccctgtctgtgtaaggatatagaaagcagccaagatatatctgtaggtaactaaaatgcagatgtgcacaatgctgccatgcctgtagaaaacaaggccgggtgcggtggctcacgcctgtaatcccagtgcctgtagaaaacaaggccgggcgcggtggctcacgcctgtaatcccagtgcctataaaaaacaaggccagacgcggtggctcacgcctgtaatcccagcactttgggaggccgagatgggcagatcacagggtcaggggatggagaacatcttggccaacatggtgaaatcccgtgtctgctaaaaatacagaaattagctgggcgtgcctgtagttctagctacttgggaggctgaggcaggagaacctcttgaacctgggaggcagaggttatagtacgctgagatggcactattgcacactccagcctgggcaacagagcaagactccatctcagggaaaaaaaaaaacacaacaagcaagtacacaaaaacgccaaacacacaaaactatacagaacatatgatttttgccaatattccagggtaaaaacatctcaagagttgatagattccagagtctttgagtgagcacactcggttcctatccttgatcccctgccctccggaaggcctgtttctgtcttctccctcacactcaccacctgctatcaggactctctgctccctactgtcaagactagacgtgcctcagacacagattcctcccttcttcagcaggagttcccagggccgagttatttattctagaaggtgcccctggtgatagtggtggggaaagcttctacaggtcatctgcagttacttctggtcctgtgtgtcactccgaagaccacttgtcatgtggggcggcggcttcacagaagcatctaggttagccagagacacttaaagcctgtttctctttgagaatgatggtaagcagaagacctttctctttatcttgtatttattagtaactattaaatatatatttttatacacacagacatataccaaagatgaacattgatccttatcttacggattctctagactcaaatgcttactgaagtcaggcagataaaacaaaaaaaattcaacaacagcaaaccagcaaacagaaactcactgaggtagtgaagtgtaagcaggaagctgtgtggccaggtgtgaggaactgtgtagaactctgggaggaatgagagtagccccttcagcttcactgcttgctggtatgtgggagggagggccagggttccaaaacttccagttcttaaatagaagcctgcagtcctcattggaattgcttgtatgttgactcaaaaggttaaatattgtgcagatcaaacaaataatttctgtgaggaggatttagtcaatgggtaaggagtttgtgaccttttgtctaaacacatgaaaaggaaggggaccatttgcctgactgctctctactttgctacgttctttctacacctgagttagtgctggtggaagagtgtttcttctccttcatccagctgctttcagtcatgtacccccccgtgaccccctcactctggttcaaacgcaaacacaaactgagaataggaaaataatccactgctgaggcatgaacatagcaccaaaggatgcagtactctagttgcaaagaactctggctgaaatttcccccacctcacctgctttctccttttatcttactcaaggctcatctctcttccagttcctctctggggaaacaggagggagattcttcttgtcacataaatgtgtcctgaaaggattctctcctccttatatctactcctttaatctgagttcaagtcatcaacacctctcacctggcccacttgccaacttccataccgtctgtctccatcctctaaaacaaactttccatgtggacaaagctgtcctttctcatgcctcagacgccactgagggcacaccaaggccattggcggcgtggccgtggacttacacaaactttccatgtggacaaagctgtcctttctcatgcctcagatgccactgtgggcccaccaaggccgtttgcggcgtggccgtggactttccttatggtcaccaacctgcagccttaagctttcactcaccctctttgtctgtccccagacttaaatcttttcttcatgttgacccttgaaatacgtgtattcatgaagacctgttcaatcacactctggattttcaaagttgaaaataacaggaagttactacggcaatgatgatttagtgaaaaatatgaaggaatcagtgactcaacaatttttgggccccattttttttttccttcaccagaggataatgttaatatgaagaggttggttgtcaatattacaactttagaaagaggaatacatgtatgtatgtattcttttatatttatgggagttaccttctgaaacctttgaacatcaccaatattgcggataaccatatgttttgataagctcttgggtttatctcgcattgcgatcaagaattgttttcactgcatatcctccaactacattaaatgccttttcaacattctttacaattttctacgtggcaaaagataccataaacaaaactaaagacaaataacagactggagaaaatattgtttgctttgagtataacgtggtaagttacgaaggaaatgacaggacactaaatatgggaaaatgagtaaatataccaagagcaaattcagaaagacctgtgcaatgagacacaaaattatttttaaaattataaaaataagcttaatctcactaataatctgaggactacatgttaaaatggcaatggaatttctttgatgaccaaatatcgttgtttgatcatgtcaagggcaagtgggcagggagaaatgtgtactcctcaactgcagataaaaagagaattgataaaacctcttaaaaaaatggattagatttagaagaatgaactatgtatacactctatgactcagttccatctgtgaacatgagtgtcagagaaaagtgtggcacatcttccagtggccaggtacacagtgttgtgcatgaccctgtgtgggaggaccacaaatacattttagttaagcacgttatggaagactatgtagtatttagaaagatgggaaggatctatatgtactgacatgaagtcataaaaattataaaaatcaaggtgcaaaatctgatgatttgatgccatgtgtgcaaaacattcttttatatgcatttcacaaaaaacaatattatgtatttctcattatccctaaaacaattctagaggattcatgacatgctgttacttgtctcaggtggacaaggattagaaatggtgaataaaaaaggttattttggcggggcacagtgacttatgcctgtaatcccagcactttgggaggccgaggtgggtggatcactggaggtcaggagttcgagaccagcctgaccaacatggtgaaaccccgtctctactaaaaatacaaaaaactagccaggcatggtggtgcgtgcctgtaatctagcgactcgggaggctgaggcaagagaattgcttgaacccgggaggcggaggttgcagtgttgcagtgagccgagattgcatcattgcattccagcgtgggcaacaagagtgaaactctgtctcaaaaaaaaaaaagaggttacttttgccaggcacagtggctcacacccgtaatcccagcactttcggaggacgaggtgggtagatcacttgaggtcaggagtttgagaccagcctggccaacatggtgaaaccccatctctactaaaagtacaaaaattagccaggtgtggtggcgtgcgcctgtaattccagttacttgggaggctgaggcaggagaattgcttgagccctagaggcggaggttgcagtgagccgagatcaagacactgcactccaggcccagagacagagagagaccccgtctcaaaaaaaaaaaaaagttatttttcacatggtagttcattaaaattttttaagtattaagctttatttatcaactgattaatattttttcctaatgaaacaaaattttactttttttaaaaagtctctttgtactattcaaatactgaatatacaaacattagctagtgaaggaatgaatactgagctgatagccaggcttacttgctagctgggtgactatctcacggaagtctagcaggatttgagatttcaatgagaaatattctgcaaaactttagagttgctgacaaaaggtaaaaaaaaaatgtgcttattaataaaataaggccaagtaatgaaaaatgtatttattaaatgaaggccagggaacactgtgtgaggcttcgtgggtgtgagtacttgctactggactgtcatttctcagttatacagagtgaaccagaggtagatagggaatagttattgtcagcaggatctatagaaatagcaacagtggtgaggagtagaaggatgttggatcaaataagatagtgcagataacaccatagaatgctagagccaaaaggatttaacacatacttttcttgataagaaataggagacaaataaaagttcaatgatttgctggaggtcacactgatatttagtggaagaacaaagacctagggcccttcaagagtagaaaatgttatacaaatgtcaaccgctaagcattgggggtatttattgatctttataatttagaggtaatgggctctgagcatcagaccatctgataactttagttcatcagattctcaaagtgttcatcactagaagaagctaaataactgcgttactctgaaaataaaaaatgaatattgagtctgttatacattctttgattttaggatgtaaaattccttttctacttctcacaggcagcactgagatctatgttgcaaagtaaattgggatagtattaaaaccatttgcctcaagggtttttttaataagtttcttgtgataatgtatgtgaatgccccaagtatatgtgacccatgggctggtctgtaggtgggacccactacatcggtgaatcatgctaagctcttaatgactcattgtaggtctctaaaataatggtatttacaaattcaagacacatctttcatgaatagcaaacgcttaccatacaatagcaaaatgaagataacaccaactgaactctctattttctgtttctgtttaacaccaactcaattgttcatttccccacgtggttgagagaggaacattaaataagtagcaatgttgggctggctggtggttctaaggatcacctagaaaatggaatgccagagattgtttagaaacagatctgagatactagataagatgaaaataacaatataagcacagtagtcttcgtaaccaagtcttatgtgattcagaaatcaataatctaaattacagagatcagtacctattacaggaaacagtcgatatcctctggggcagggttttacctctggtgtagcctcatataagtgaaaaagaaaggctaaacgtctttgacccccaattcccattcccttcacagaaaactagctaaatatctaaattgctaccattaaatcacattaaatattgctcttctgcactttctggtctggtgttgtaaaaagcagttggttgtgcatataagaatgagggaaatggaggctatcattgggacacaacgtatatcataacagtacgtgaagtgggtggagcgctaacctcagtgtttctgcaagggagtctggactgcccagagtgcatccgtgtcatcctgcatttggacatcatcaccaatttctttccaaggacccttgtgcccaaacaaaacttgcacacatcagatacatgctgccaatcctgaaaagtgaacatttaaaaccttaaaactgaatttgaatgtacctgatcaatgtaatcacgtttattctgttctcagctctgtgatgtgttctgtctaccaaaaggaagctctattgcagccattcaatggtaatcctgcttgtactcacagagtactactattctaagagcttggtaatatactgcacatttttctcttctcttttctcttctcttctcttcttctcttctctttctttttcttttgacggagtcttgctctgtcgcccaggctggagtgcagtggcaccatcttggctcattgcaacctccacctgccaggttcaagcaattctcctgcctcagccacctgagtagctgggattataggcacatgccaccatgcccagctaacttttgtatttttttttttttagtagagatggggtttcaccacattggccaggctggtcttgaactcccaaccttgtgatctgcccaccttggcctcccaaagtgctgggattacaagcgtgagccactgtgcctagcctgtactgcagattttctaaaatagtatagcctatgttaaaacttgtcctaatagacattataagattacttagacattgttttactttaaagactgtgtatggctttctcacaaccccagggccattactagtaagataagattttcatggaagacattaaaaatcatgttacactttaatagtgatattgtttcaatctttcatcacattaggtcatttccatttagaaaatttgatattcatatggaacctttttgtatcaaaaattatccacatgtgcttcaattttagaacttaactactttcatgcaagtagtttctcttaagtcagctaaggtaatcatgcatcttccttgattctttaagactcccctgccctgaaatatctcccctaaaagtctgacacaattatagaacaaaggatactatgtcttattaagaagtttaatctcatcgttattaataagtaaatatgtgatatggtttggctctgtgtcccctcccaaatctcatcttgtagctcccataattccacgtgttgtgggcaggacccggtgggagatgattgaatcatggggtgggtctttcctatgctgttcttgtgatagtgaatgggtttctgatggttttaaaatggggagttcccctgcacaagctctctctttgcctgttgccatccatgtaagatgtgacttgctcctccttgccttccactgtgattgtgaggcctccccagccatgtggaactgtaaggccaataagcttctttcttttgaaaattgcccagtctcggttatgtctttatcagcaatgtgaaaacagactaatacaatacgcatttttcttgagtatagaattaacctgttatatttttcctaacatagaggaggtagtctggagagatttgaaagaaacacagaggtacaattaatttattagccaagttcttcaggatctcctaagagagaaacagagagagaggtagtgcagtaaagcttccatctgatgcatagctagtgtgaggacacgtgcctagaggcagaaccagggaactgggaaataggaacatctgtattaattttgctgatgatctaccctgaacacatgctttatgttatgggttggctgtgtccccacccaaatctcttcttgaatgaattcccacgcattgtgggagggacctggtgggaggtgattggatcatgggggcaggtcttacctgtgctgttctcatgatagtgaatgagtctctcgagatctgatggttttaaaagggggagtttccccgcacaagctctctctttgcctgccaccatccatgtaagatgtgacttgctcttccttgccttctgccatgattgtgaggcctccccagccatgtggaactgtgagtccattaaacctctttttcttcccagtctcgggtatgtctttatcagcagtgtgaaaatggactaatacagtaaattggtaccagtagagtagggtgctgctgaaatacccaaaaatgtggaagcgactttggaactgggtaacaggcagaggttggaaaaatttggagggctcagaagaagacaggaaagtgtgggaaagtttggaactccctagagatttgttgaatggctttgccccaaatgctgatagcgatatagacaatgaagtccaggttgaggtggtcccagattaaatgaggaacttgtaggaactggagcaaaggtgactcttgttatgttttagcaaagacactggtgacattttgccccttccctagagatttgttgaactttgaacttgagagagatgatttagggtatctggcagaagaaatttctaagcagcaaagcattcaagaggtgacttaagtactgtcgaggcattcagttttaaaagggaagcagagcataaaagttcagaaaatttgtagcctgacaaaacaatagaaaagaaaaccctggttgggcatggtggctcacgcctgtaatccagcactttggaaggccgaggtggatggatcacgaggtcaggcattcgagaccagccctggccaacataatgaaaccccgtttctactaaaaatgcaaaaaattagccaggcgtggtggcaggtgcctgtaatcccagctactcaggaggctgaggcaggagaattgcttgaacacaggaggcagaggttacagtgagccgagatagcgccactgcactccagcccgggcaatggtgtgagactaggtctcaaaaaaaaaaaaaaaaattcccattttctgaggagaaattcaagctggctgcagaaatttcataagtaacgaggagccaaatgttaatccccaagacaatggggaatatatctccagggcatatcagaggtcttcatggcagaccctctcatcactggccaggaggcctaggaggaaaaagtggttttgtggaccagacccaggatccctgtgttgtgtgcagtctagggacttggtgccctgcttcccagatgctccagctgtgactgaaaggggccaaggtacagcttgggctattgcttcagatggtgaaagccccaagccctggcagcttccatgcggtgttgagccttcgggttcacagaagtcaagcattgaggtttgggaacttctacctagatttcaaagcatgtatggaaatacctggttgtccaggcagaagttggctgcaggggtggggctctcatgaagaacctctgctagggcaatgtgaaagggcaatgtggggtcggagcccccacacagagtccctactggggcactgcctagtggagctgtgaaaagagggccaccgtcctccagacctcagaatggtagatccactgacagcttgcactgtgcacctggaaaaaccacagacattcaacaccagcccatgaaaggagccaggagggaggctgtatcctgaagagccacagagccaggagggaggctgtatcctgaagagccacagggtgaagctgcccaaggccatgggaacctacctcttacgttaccgtgacctggatgtgagccatagactcaaaggaggtcattttggagcttaaagatctgagtgccctgctggattttggacttgcatggggcctgtagcccctttattttggctaatttctcccatttggaaaggctgtatttacccaatgcctgaacccctttgtatctaggaagtaactaacttgcttttgattttacaggctcataggtggaagggacttgccttgtcttgaatgagactttggactgtggacttttgaattaatgctgaaatgagttacaactttgggggactgctgggaaggcatgattggttttgaaatgtgaggacatgagatttgggaggggccagaggcagaatgatatggtttggctgtgtctccacctaaatctcattttgaattcccccatgttgtggcagggatctggtgggaggtgactggatcatggaggcaggtcttacctgtgctgttctcatgatagtgaatgagtctctcaagatctgatggttttaaaagggggagtttccctgcacaagctctctctttgcctgccaccatccatgtaagatgtgacctgctcctccttgccttcaccatgattgtgaggcctccccagccatgtggaactgtgagtccattaaacctctttttcttcccagttttgggtatgtctttatcagcagtgtgaaaacagagtaatacactttattacattttccttctacaaaatttacattttttataacaatagttttcatttgtatttctttttggatgacaaagacattttacagacattttatcattgaactctacaatattaagtgttagagcaagttttagctatttaacaataaggaaatggagcttcagcgacctgttgtagttaacatacataataagctgaataactgggtcatgtattctatgctatgttttcctgagttatgtaggtatcctgtataagaaaaaaaatctgtttcatgattctatgaaagtattttgataacttttgatatataagacttattagtatgggtatgcatcaaattttctttcagtatacaacaaaataaatttagtaaagtaagtataatgtaattcaaattcctataaacaacatttagtaaatatctaaaaggaagtatcagaaatactactaaagttaatacacacacctgcctacactcacacacggcacacattttcaaagatataaaagcacataattgaaaagtatgttttctggggccgggcgcagtgactcacgcctgtaatcccagcactttgggaggccgaggcaggcggatcacaaggtcaggagatcaagaccatcctggctaacacggtgaaactaaaaatacaaaaaattagccgggcgtggtggcgggcgcctgtagtcccagctacttgggaggctgaagcaggagaatggcatgaacctgggaggcggagcttgcagtgagctgagatcgagccatcgcactccaggctgggtgacagagtgagactccgtctcaaaaaaaaagtttgttttccacttgtgtgtggtagccaggtgaacagtccagccaaacagtgacacccctagagaagatattgagcatgatttctttctgttttccttttctttttttaacacaaatgatttcatcctacaggttggtttcagcctttcttttatcacttatctattcacacaaagataagcacatgtgcatgcacacacacttttttcttctctctctttattccacagcagcacagaaagagttaccatcgtctttttaatggccataaaaatatatcataattgatttgaccggttgaacatttaaagtatttgcaagtgaatcttgctgtgcagacatcatttagagtgtgtgtagtatgtccataggataaattcctagaagcaaaattattaggcaaaagaaatcatgcatttttaattttaagaaatattcctaaattgcttcagtggatagtatataaatctatatttccactagtaatgcatgactgcatgttttcctcacagtgccacccacacactgtgtcatcaacatttgtgaactgtattaacctgagagataaaatatgttatgtaattaagttttaatttgtaacttttcctttataagtgagattgaggtttcccccactttcatatggtcttcccgtttgttcaccagactattagtcttttcccagatgattcatgaaaactggacatgttaagaatatgaaccccttagctattaaaatggttgtaattttttccaagttttttttgtattgtttatggaattattttatatatagattttaatttttatgcaattaaacatgtttattttatatattggagcattttgtcatattacaaaatccttctccaattccaaactttaaaattcttttttcccaatttattttagccttatatcctgtatttaacatctgtaatttattttagggtaaagtgtgaggtatgtatctcactttatttcttttccagatggtaatttatttattacaatctatcttataaaataaatcacctcctctactgatttgaaatgccacttttattgtataataaatttctgcacattagcaatattttactgtttatcaaaactacatcataattcctatttgtatattgctctattgttctttctagttattgtcagtctaatattttgaactgttctctaaacatacccattacagaaatatagtcctgtttatttacatatgcatgtttgcacttatttatgatgtatgtactacataagagttggggatcaatatataccaaaataaattacattgttcctgtccacatcacaaagtttaagataaattaaaaagttaaagtatatatgaaactatatatgccttttgagtaaaaacaaggaaattctttttcaaaaagcaaataaacaagtttattattttagattcatttattgtagttaataccttatttcactccaagttttctaataacgaatgtaaagacgaaacatgttgacatctactgtgataaagaaagttcatttcctagcagttaattctaagtaggatgctgggcctatgcaagtggtgatgaatagcataaataagttagcttttccaaaaaattaaatgtttagaagtatcttcaggccaggcatggtggctcacacctgtaatcccagcactttgggaggtcgaggaggatggatcacgaggtgaggagatcaaggccatcctgactaacacagtgaaagcccatctctattaaaaacacaaaaaattagccaggcgtggtggcgggcgcctgtagtcccagctactcaggaggctgaggcaggagaatggcgtgaacccgggaggcagagcttgcagtgagctgagatcgtgccactgcattccagcctgggcgagagagtgagactctgtctcaaaaacaaacaaacagacaaacaaacaaacaaacgtatcttcaaatggacatttcaaatgtttcttctttttataagttgagaaagtaacacagaagcatcagtaaaatgtcttcaggcaacaacgtagcatcatgttggtatgtcacttactggaaagaagattatatatcttttagactcttcccaaaattaaaaaaaatgcacctgtcaaatatgaaatactggtaaagttcaaagaatccgtaatgtttgtggatgattaaaaatgtgaaaactgtgacagattctttctcagtcagagtaatttgatttctgcagagcgggctatagaccggtcttcgggtactttctcaaagattaactgaattttcttaaacaaatatttaatttgattaccagaatatgaaagaaaaaaattttgtctaacaactctttctgaagtttgccaatagctttcttttactgccaatacgacttttctgaagcatttcattatcagttgatctttgtcttcttaagtcagttaatgatacgacacgaacaaaatatattatcatgcaggtaaataaaaactgtcctgttggaaaacttagtgtttcctatttaaatttcagaaaaattcagctttttttgtggttgatattcaatgcacaggcattagaaaaagggtctattgtgtctgaggttttttctggttttaagtgataaagccatctttggcatgaaggatacttggttctcattttcagtagaaagtggcatgcatcccagttacccaatagttatcctaaagcactgaactaaacttaagacataaaaaatgtaagtacattcttttgaacgtgattgagaattggaattttatttgtcaaaatattttacatatgcttattctggctgccatattatgatgcttactgtgtaaaagcttttgtggtattgtatcttactgagatagtatagttttttgatagatgatttctattcgtggactcaaagcctcataattatattatatatgttaggaaggattttccttattttcctggtgacatgaaaaatctatgtaagtgatttataaggagatatctgcacagagatctgtatgttcctttataaattattaatatagagatttaatttaaacattattatgacagttagccaatagtgatattttgagggaatattctatagactcatgagtttgttattctgtgacaataggttttcaccttttaaaataaaaaactatactcacattcccctctgagagaactctataggccgggtgcggtggctcatgcctgtaatcccagcactttggcagcccgaggtgggcggatcataaggtcaagagatcgagaccatgctggccaacatggtgaaacactgcttctactaaaaatacaaaaatgagctgggcatggtggcaggcgcctgtagtcccagctactcgggaggcggaggcaggagaatcacttgaacctgggaggtggacggtgcagtcagccaagattgtgccactgcacttcagcctggctacagggtgagactttgaaaaaaaacaaacaaaaaaaaaaccaaaagaaagaaagaaagtgagagagagagagagaaagaaagaaaggaaagggaaagaaaagaaaggaaagaaaagagaaagaaagaactctatctgtgcagttaaatgagagaaagaacacatagtttagaggacttttatagagaaagaacacatagtttagaggacttttatagagaaagaacacatagtttagaggacttttatagagaaagaacacatagtttagaggacttttatagagaaagaacacataggttagaggacttttatagagaaagaacacatagtttagaggacttttataggacagacccccaaatattcttgcagtgctaggcctcttgggagatattggtaaaatgaaataattatttaaaatctatgaaataaatgtaaatctttaggataagttgaagcatgtaaataagtcttgacatagagtaaaagagaggagtgagatttgtatgtgaatataagattcagatttttaaaattttaatttagtcatctaaatggtctcctgtactgattatactcagctacttaaaatgagtaattctacccgcaaaggtagctagtctctataattgacttaaatgatgtacttttaatcaatatttcaatttcatttgatgcccttgaaatgatgtggaaaataaaaggaaaactagaacattaagtccacatggagcaatataggaaaaaccaaataaaagatttcgaatgcccttttatgtaattaattgctttcaaagaagcaaattccaaatgtcagagatatataaatggatattcaagataatgtttatttttgttcctatttttatgtattacaaatagaggtaatatttaaaacaacaaaaggggtaaaatttaaaaatttagaaaaatatagactactgaagagtaactgccaatggcatgtcttattaatgagaattcttccctagggcttttaatttgaggtggagagagcagaagcagcgggcacggggcagcttctctctaaggtcacatgctgtggtgcaacactgatttaaagttgtctgcctcagatccacatcaagatggttagctactagtacagaggaactttactaggtaggattttctttctttctttctttctttttttttttttagaaaaagtttccttcttgttgcccaggctagagtgcaatggtgcaatctcggctcactgcaacctcagcctcccaggttcaagcaattctcctgcctcaccctccctagtagctgggattaccagtgtgcaccaccatgcccatgtaatttttgtatttttagtagacagggtttcggcatgttggccaggctggtctcaaactcctgaccttgtgacccacccgccttggcctcccaaagtgctgggattagaggtgtaagccacggcaccaggcctactaggtaggattttcttagccatgatatgaagcatctttcccctgcttcctggtcacatgcttctgtaagcacaaggcctctgacctttctccaaaggtgcagctagtagcccccgcttgctgccaagcgagtccacaggctctatttgacgtccagttagatctgatctttgaaataaaataagtaagctattggaaatcagtaaaaatatcaactagagtctgggcgcagtggctcatgcctgtaatcccagcactttgggaggccgaggcaggcggatcacgaggtcaggagatcgagaccatcctggctaacatggtgaaacctgtctctactaaaaatacaaaaaaaatagccaggcatggtggtgggcgcctgtagtcccagctactcgggaggctgaggcaggagaatggcgtgaacccgggaggtggagcttgcagtgagccaagattgcaccactgcactccggcctgggagacagagtgagactccgtcagaaaaaaaaaaaaaaaaaagaaaagaaagaaaacataaaagtagtaaatatccctaaaactttaattatactttgaatatgaatatttgggcatagttttttaaaaactgcaaatctgtccaagtaaaagattgtttttctgggtgatttagggataattaccttttttaaaatcatggtctgttttatgtgtttccaagagcatgcactttggtaattaaatgtggtagtagggatgtttgaatggaaaccagaaagatattttcataattaataattagtttataaaaatcactagcattcctgtacaccaccgacaaccaaactgagagccacatcagaaagataatttgccaccacacagaaaaaataaaataaaataaaataaaataaaataaaataaaataaaaaagacctgggaatgcagctaaccaaggaggggaaagatgtctacaatgagaattatgaaacactgctcaaagaagttagagaagacacaaacaaatggagaaacattccatgctcgtggataggaagattcaatataaataaaatagctatgctggacaaagcaatttacagattcaatgctattcctatcaaactatcagcgacatacttcacagaactagaaaaaattatttaaagatttatatggaaccaaaaaagagcccaaagagccaaggcaattctaagcaaaaagaataaagctggagaaatcatgttacctgacttcaaactatactacaaggctgcagtggccaaagcagaatggtactggtacaaaaacaggcacatagaccaatggaaccgaatagaaaccccagaaatacagccacacacctatgaccatctgacctttgacaaagctgacaaaaataagcaatagggaaaagactcccttttcaataaatggtgctgggataacttactagccatatgcagaaaattgaagctggactctttctttacaaaaatcagctcaagatggattaaagatctaaaactataaaaaccctgggaaacaacctaggtaataccatcctggacataggaacgggcaaagatttcataacaaagacaccaaaagcaatcacaacaaaagtaaaaattgactaacgggatctaattaaacgtaagagtttctgcacagcaaaataaatgatcaacagtgtaaacagacaacttacagaatgggagaaaatatttgtaaattatgcatctgacaaaggtctgatatccaccatctataagtaacttaaacacatttacaggagaaaaatcaaacaacctgattcaacagagggcaaaggacaggaacagacatacatgcagccaacaagcatgtgaaaaaaagctcagtatcactgaccattaaagaaatgcaaaacaaaaccccaatgagtaccatctcgcaccagtctgaatggctgttattagaaagtcaaaaaataacagctggtgaggttgtgaaggaaagggaacacttaaacactgttggtggaagtgtaaattagttcggccattgtagaagacagtgtggcgattcctcaaagacccgaagtcagaaataccattagacccagcaatcccattactgggtgtgtacccagaggagtgtaaagcattctacctaaaattcacatgcacgtgaatgctcattgcagcactattcacaatagcaaagacaaggaatcaacctcaatgcccaccagtgacagactggatcgagaaaatgtggtacatatagactatggaatactatgcagccagaaaaagaatgaggccatttcttttgtgagaacgttatggagctggaggctatcatccttagcaaactaatacatgaatagaaaatgaagtccaggtgcggtggctcacgcttgtaatcccagaactttgggaggacgaggcgggcagatcacttgaggtcaggagtttgagaccagcctggccaacatggtgaaaccccatctctactaaaaataaaaaaaaaaaaaaattagccaggcgtggtggtgcatgcctgtagtcccagctactcgggaggctgaggcaggagaattgcttgaatccaggaggcagaggttgtagtgagctgagattgcaccactgcactccagcaggggtgacagagcgagattccgtctcagaaaaaaaaaaattagaaaaccaaataccacatgttctcacttataagtgggagctacgtgataagaacttatgaacacgaaggaaacaacagatactggggactgcttgaggggggagggtgagaggagggagaggagcagaaaagatcactgttgggtattgagcttaatacctgggtgatgtaataatatgtacaacaaacccccatgtcacatgtttatctatgtaacaaaccttcatatgtacccccaaacctaaaataaaaactatgaaaagaaaaaataaaaaaataaaatctggggaatttgagttggcaaagcctctgaagttttagctattgtgctctagtctgtttcactacaccccacaaataaaaatttaatttgcaatactggaaaaagtcttttatgtaaaggatagatatgttagattttttaaatatgctaaattaagttctcctcttattccagttcaccttgctattgtaaatctatgtttaaataaaagtcatcttcaaacaatattaaccaagttgcctgaagtccaccccttaataatctgagctaattaatcattcttcttggtcacttcctgaaatctctatttcaagacatgtacattctagatgaaatgtattaaaaagacacacggaagtgaaatgctttgaaagcaggtacattttgcttccccagcctgtaagatgtcagagattatgtgttatttctatgtatactttgtcctgatgaaaataaaattttatttgtacctagtattttataatttgaataaaggattataatcaatattcttctcttctttgcttctcttagctgatggccctttttttcagcagttaattaaagtttgaatagctgtcacttgtgactaacttctgtggcgtttcctttgcctgcacctcagacatcatctccttccattcatttcttctcaaattgcgtacacaagtgctctacaaaatcatctacagtcaaatcccagagaagtagtaataagagccattgtagacaggaggaagtgtgttaggaaacaagaaggtagatctggagccagtatagactgcagccaggaccgcatgttccttagggcaatggaaagaagaggagataaatgctgtaagaagatgatatagaaaatttaaaaactgttatacactgttcaaatctcatcaaaggcatcaaagaggatcccattaaaaacactcttgagagcagctgagcgctgacgctttgctgcttagaatgcagggccaagggagatatgaggtcgggagggtttaggtgtgcacctgagcattcagagtaaagagaaatgagcactgggaaaagctaaaaggaggcagcctgagggggccagcaggaggccggccggccggccgggatggcaggccaccttcagcaggtcagccttcaccctggcaggcagatctaacgcggatttgggaaaaagagacactctcagtccctccagattctgggatggtttggtctctggctctgaggttcccaggtgaaactgatgctgctgcaccttgccgtgatgcagtgttactcatggccaagagcagaacttcagatgggagagggctgactctggcttctgctattcacagccatagtgtatgggaaagtcaaagaggcttcatcattcagtaacaaaaacaaatttcagtcacgtgaggaaaactaaactgagctttatgaactttcctttcccctgtcttactttgatgtcattttgtcttgtaatgcaaatatagatatgtttaatccatatttacctttctaattaataaacagctagttttatatagataaaagctttcaaattttattcaaaggaggttttctcagagtgctgattttcattgttcatcaggcaggtacatcatttagtggaaaccaagtaaaattgtatccatgagtccaagcacagtcctccagtattttgtaggattcatctaaagacttaagtttaacattcatgtaattccctctaggatgtacagttcctcagtctcacagaattagcccagtacctgctcttctgggtgctaggatgccatagacaccctgtagttcctttatccaaatcccattacacttcaggtttgggattctaattcattaaggaactgaggccttttcatgtagtatttgtataaatgctgagctctcaatatggaagaagaaacaggaaaggaagaaagaggggtggggaggaaaaggaataggaggaggagaagaaggaataggaggaggatgagaattaggaggaataggaacggggggcggggcgaggaataggaggaggattaggaagaggaggaaatttgcatatggctttaagtcccttaagcttctggttaagtggctcatctacacaaaccccatctcatgatcccgtgacataggagctatttcctctcatcactactgattgtcctccatgttccctttgacttatctttcatggccacatgaccccatccccaccctctaaatccaatccagtggacctccacactctgctgcccagccctcttggtgatttctgagctcttttgctgtaaacacaagtggacagtcatctgaggcagcgttctttactatctgcactctccagagcacagttgagcctgagttccaccccagcacatctcaacctcagttgatttcagaacctttcaatcatttctgtgacatttctgaatttcctgacttcaccaatgccaggaggataaccctccgaatcaaatcgaagatcatttcattgtaaagttcctcctatattgacatttctggggaactatgacaaactcaaggcctcggagggccctagactccatttcattaaatacaatttttgaatgggtatcagggaccttgacctcaggaaataacttgggcaccatttatgtcaacataggggtcatcaacgttgctatgatgtttcctttgggttcatttaaccctatttaaccacatatttcaacaacagaaagatttaaactcagagcaaggtggtcaacagcacacatctattatgtaccatttacagactcctgaagacctgttgttctctctctaccatttggtctcttgccatatttcttcaggtttattagtgatttatctctttttgttaggtattttcctggtccaacattattttataattcaaatattagggcacagaaacaaaaatagaatgtgggtttgaatacacatgaaatacctacatctatgtcatacatatacacatacactaaaatagtttgcaatgggtatagaaattagaagggggataatataaagtaaacttaaacagcttcagaattttgccagaaaccagccctgaacttaacgataaccccatctcagtagaaagaagagaggctgagtaaaggcatgtttactcggaaatgagttccccagcgtgaaactcaagagtgaggagagagaacttttagaatttgccacacacctgctttctgttgcatattaaccacacggtgcactttccactggctgcttgaacaggcacgtcatgtgtgaatgaagtgggtcaaggtcagaaaaatagcgattgttggtgtatgtgataaattgatgtgtacttgccctgggtcagtcactactcacctgcagaagattcctgccttataggaagtaaaatctgtattgctgaatctcacacatttccagaaaaagccaggaagtgtggctactacaggaaatttcctaatttttaaatatgaaatgattcaaacatactgtagaaaaaaactatacaatgtacagtaaccacgcaatagaaatacatctgatgaatggatttggctcatgggccgccagcttgtgacttctgatcaatgttttgaaattatccctgggagacatggggaagaaagattcaatctgtaaggagccacatgcagttttgtgagacaatttgcagacttcaaagtgactgagtcagagtatgtacataaaacgtggcccaagggagaacagaaatctaaaatgaaacacattaaggttaatactggccgggcgcagtggctcatgcctgtaatcccagcactttggggaccgagtcaggaggattacttgaagacaggagatcgagaccaacctgggcaacatcatgagacccatttctacaaaacaaatggaaaaatagttactacccataggaatgaaaagtcactcatttgctatcacacagacatacacatgtatgatagccaactaccggattaaatcaggcagtcagaaagagaaaacaaaaagaaaaggaggcaaaaatacaacagaaaaacatgaaatttaatctttcaatttcgaactttttatcagacaaggactagaaacccaatgaagatgacaaaaaaaaaaaagacaaaattgctttcctatgtatcaagctcaggtgtaattatagttccacactaaactgcaggcttcatacaaggacttgccacaactcttagttttagtaccggctgtaatttatgttgtgtttagataaattcctgagctctctgtacctaattttttttaattagtgaaaaaacacagaaatagcttacatgcttgctttaagaaatagataaatagaatattatatttttaaacctcattatgcctaagtatttaatatctactggtgattttattcttggcgagcatagcaggggccatatgagaaatgtaaatatggttattgacctgttgtgctggtgacaagatgagtcttttctctaggagactggattagcttggctgaaaatattcgttgcataccaaattagactatacattgtatttctgtcactgaatgttttccttagttgttttgtgagtaaaataaattggatgtatgttcaatgtatataattcaggcaccttatttcaaaagtaattaatgtcttactcacttgagaccagataattacagttaatgtcatcttaaaggagcccccaggactgttagccattggtaaacgcataagaattggaataaattgactttcatgatcactgaagcttcgttgggagaactaggagcagagaaaagaatgataaatcaaaaattcgtctcctaagactgatgaagataacatatatattttttcatttactcttagacaacccttacaagatttttgcccagcgaaagtggcacgtggaacatggaatgacatttcataaagataaatccagagattagtgctgaagactacacccctgtgtagtcccacacaggctaccccagaccagcctggcgggctctgcactaggcctcccatcaggcgagagccaacgctcctcagcccggctccacctcattcagaagaaagtgtgtctcccggcctcacattgcgctgaatgcaaggataccgagataaaccaggctttccttcgctcagagtacagttgcagacttggtaatgactgagccaagccagactgactgtgataagataataaattaactaccagtcaggagctaagtcagcagatgtgcgaacattttagaggtaacatcataaactagaacagaggagctcttgggaagaaaaagggcttggaaattatacctggaaagataccgctaataatgatcaagaagaaaaaacaaatccagtttggaagtgagcaatcatttatgatgtaaaatatttcttagaaatggaatctagataatgcttggaatatgctttaaactacctatatttaatttgtttttcttgtgatttttgtattgtttggtgtaaaataatcttaatctttccaggtggtgtctaattaaggcacatttactgatatgagtcattttctaaatatactttatctaagaaaatttaaaatttttggatcaactaaaaactctctcaattattttagagttaactcttccaaattctaaaatgtattcataaattatatacaactattttaatggtcactgtgggcccaacttctgtatataaatttaccttcttattttacaggtgctaatgtttaaagatacttaaatatgccaatttctttcctctatgtagaagtttgaaatacattctatgccctgagagaaccctttgaaatttgaacacatagagtattgttatgtgctttcaaaactttgtgttgtataggaccctcttttagctgaatatttttcaagcagtaagcctgtcctgcatcgcacatgtactgggacacccatggacaaaatcataagactctgtcttcctgacagatttccctcctctcctggggaattctctaatgatgtcactctttttttgtgccctgtatggtttttttttttcagtttcttctgtgtgatgcacgtgatgctgttacactgcagggtagcgtttttaaaaaatctgatttacagtttgtcctactattatatattttgcttataaaaaccttgtgttttttcaaaaattcctaacagacttatttaggtctaactgacctaaaataaaccacacatggtacagtgtacagtttgatgggcttcgacataagcacatataatgggttgaattatgtccctcacgagatatgttaaagtcctaaaccctgtttctcatttgcgaatagggcctttatttggaaatagggtcattgcaggtataattagctaagatgaggttgtagtggagtggagtgggcccttaatccccttaatcctaaatgaggggtgtcatcataagaaagacactggcaaacagatacagacacagagggaagaacgccacatgacaaggaggcagggggtggagtgatgctgccacacgtcaagaagaacctgcggccaccagagttagaagaggcaagaaaggattctctcgtggaggcctcggactggcatcgccttgccaacaacgctgatggtgggcttccagcctccagaattgtaaggcaataaattcatgttgttttaagccaaccagtttgtggtgaaatagccccaggaaacggatccaatctacaatcatgaaaccatctgaaaataaaaatagcaaacatatccctcacctcaacaagtttcctgaaggccctcccatcacacagtcccaagtcccacctccttcctcaggaaaccactgaactcttttgtcactatagaccgtattttgtagaattaatataaattttacataaatttatataaatccccaaattatagaaaatatatttactgtatacatgcggtatatactggctgctttcagcataattatttggaggtttattcatcattcttttgaacattcatttttttgctcctttgtttagctaagtagtactcccttgatatatcacaatttgtttatccattcacctgtttatggacattttagttgtttccaacttttggctatcacgaatgcatctgctgtatgtgcacatatacatgtacaactatttgaacagagatacacttttgtttctcttggtagacacctaattgtggaacagctgagtcctgtaacaggcatatgtttaacttttaaagaaactgccaaaccactttctaaagtaaacatactatgtacaatctcactagcagaatataggagttccagttcctccacatcttcatcaacagttcgtatgattacgctttgaaattttttcctttctaataggtatgtagtagtgtctcattgtggttttttatttacatttccctaatgactaataatactaaatgtctttcataggcttatttgtcatggcatgcctctggcataccatctgttcagatcttttgtctattgtctaatttttatgggtttgatcttatcaatttttgaagattattctggatacaatgaatttgttagatatatgattcctatttttcatggtctgtggtttatcttttctttctcttaacgatattcttgaagagcaggtgttcttatttttacgaaatttcttttatcactattttcttctatggattgtgtttttctatgaagcaacctttctaacccaaagtaataaagtttctgttatacagcttattctagaagtttgatagttttaggctttaccttggttctatagtcctttctgaattaactttcacatgttatgttaggtataaagtctttttggtttgtttgcttttgcttttgtatattggtatccagttgttctagtactagttaaaaatactatttttctttattaagctgcctttgtacatttataaaagatgaattgatcatatatgtgtaggtctgtttctaaactttctcttctattttattgatgtatttgttggtcttgaggcaaatatcacattgtcttgattattgtacctttataatgattattgattgctatacgtgcaagatcctcaactttgttgttttgcaaagttgttttgactaccttgggaactttgcatttttctagtaaccctgttttgatatagattattttgaatagggaatgttttgacttaaaaataatatcaaacttttataattaagatataagtagtgtgaaaggagagaaacatcttcattctatcattcagcccctttcaggaacctcatccaacctcaccactctaggctatcagagttagcacattacatctctatacagacatgcattcgttaatgatgaggatatgttctgagaaatgcattattaggcaattttgttggtgaacatcacagagtgtacttacacagacctagctggtgtagcccatcagttaccttggcaatatggtatagacgattgttcctgggctgcaaacatgtacagcaggttactgcactgaataccgcaggcaattgtaatacaatgataagtatttgtgtatttaaacgtagaaaaggtacagtacaaatttgatataaaagattaaaaaacagaagacctgcttaagcccattctgttacaatcttatgggaccagcattgtatatgcagagtccatcgtggaccgaaatgtcactgtgtggagcacaactgtatctccatccatactgacacacacacgccttctgaaacccatgcctacaaccatattggtatctgtatattggtgctttatagtataaaatataccctcttgaggctgagcctcagtaaatactcatgcttagccactgtcagcctgcttcttcctctaatctccaaaatgaagtaagttcattgacagcactggagatgcctgcattgctggatttacactctattttattattaaagaaagggtttttttctccctaaagatatccctatttctattaatcttttctggctcattatttttctttgataggcatagagggcagtatggtggaagtattctgcctgtctgtgagtattttaaaaaatggaaaatgttggaaatcaatttcttgtgcatttactttttcttaaatactattactgtttcctttccaatcttagactgctgaattctgaataaatctctcacctttgtggttttcttgaagtagaccttaatttgaattttttttttttttttttgacagagtctcacactgttgcccaggcgggagtgcagtggcacaatctcggctcactgaaacctccacctcccaggttcaagcgattctcctgcctcagcctcttgagtaactgggattacaggtgcccgccaccatgcccggctaattttttgtatttttagtagagatggggtttcactatgttggccaggctggtctcgaacacctgacctcatgatccatctgcctcagctcccaaagtgctgggattacaggtgtgagccactgcacccagccgaaatattttcttttctttttctttctttccttctttttaaaaaaattctgtagctgatccctgatggcttttaatttgaataaaactttatttaaagaaagtgtttattcattgatacgaatcacacagagtataatttcaagcccattaccatgaagatattttcctatgttttactccagaatttttaattattttatctttcaaatttagatctatattccagctagaattgtgtgtgtgtgtgtgtgtgtgtgtgatgtgaaggtcaaagtttatttttctttttttacatataaatatgtaattgatccagcaccacttaatgaaaagactactcttttcagccactctcaggtggtacctacgtcgtgacccaagtgactgagtatcgagtcggtctggttttcaactttctattcagttcggttgctctgtagttccccccttgatggtttacattgtctgtgaatattgacagttatagttcttactttaccattcttttaaggaatcatttgaaaaattcacatattggtgaagccatacaggcttagagttttctttgtggcaagtttcctaatgacagatttaatttctttaatagatacaatatattccaaatagatttttttcaatgagttttggtaagctatatttttctaggaatttgacaatttcttctaaattttgaaatatattggtatataggtcaaaaaattgtatgtctttatctttttaatatatgtaatgtctgttgggatgtacctttttaaaaatttcttatattattcatttctcttttctggcctgatcctagcaattgttatagggagtttataaaaattattcgtctttttagggaaataaatttttgctttttaatttttctactatatgtttgttacttcatcaaatttaaattaaatttttttggattaacctacatttccttcttcccatttttattaggattagtttgttcttatttttccaactactttagaacattctttagcttttcctctttgctaatatgtagatatacatttgtttctttcttcctttcttttttttgagacggagtctggctctgtcacccaggctggagtgcagtggtgggatctcagctcactgcaagctccgcctcccaggttcacgccattctcctgcctcagcctcctgagtagcttggactacaggcgcccaccaccacgcctggataatattttttgtatttttagtagagacaggggtttcaccctgttagccaggatggtcttgatcccctgaccttgtgatccacccaccttggcctcccgaagtgctgggattacaggcgtgagccaccgtgcccgggcccccatatagatatacatttctctaagcagttttacctgcctctctaaaattttgagatgtatttttattaaattcagtttaaaagattttctgatttttcattgagttgtctttctttactagtgcgttatttttaaatacattgcttaattttcaaacatattgacatattccaatcactttttcattattgctttccagtgtaactacaccatggtcaggagaacagattccaaattattgtagtatttcaaacttgttgagacttgctttatagctaagtttaaaatacattttggaaaatgctccgtgtaaatttcaatagaatctgagtgtgcttctatgctgtactatagtacttcccaggcatccttcaggtcaggtttctcctcaacctaatggatcttctgtatacttactggtctatatgattgcagaattttttctatttggtctactaattatgaaaaatgtgttttaaaatctattattatacatacattcatttctccttttacttttgtcattctgttttgtatatacagtcatgctccaaataacatttctttcaacaacagactgcatattcaacggtggcctcctaaggttacagtggagctgaacaactcctatagcctattgctgtctgagccttcataatgtcagagtgcggtgcattttaccttttctatgtttagctatgatcagatacacaaatacttactgttgcattacagttgcctagagcaggggtgtacaatcttttggcttccctgggacacattggaagaagaattgtcttgggccacacataagatacgccagcactaacaacagctgatgagctaaaaaaaaaattgcaaaaaattctaataacattataagaaagtttatgaatttgtgttgggctgcattcaaagtcatcttaggctgggtcacgggttggacaagcttggcctagggtagtcagtggagtagcatgctttctaggtgttgcctaggaatagtaggctgtaccatttagcccaggtgtgtagtaggttatgccatctaggtttgtgtcagtgcactctgtgatgtttgcacaacaatacatgtgcctgatgatgcatctcacaggatatgttcccactgttaagccaaacaccactgtatttgaaagttttgttgttaggtgtatacaagtttagaatttttctttctgaagaattgactctttcagtaggaaatgtctctttctagctctgatgattcttcttgccttaaaatctgtcttgtttggtcttgtcataatgcacaaaaattcttttggatagtacttaaacaaaatttttctcatctttaatttttagcactttaatggttttctatgtttatgtctgggattattttgcttctacttaaaggactccctcctttagtatttattttaatgcagatctagtggtggtgaatactctttattttaatttttttaggagtatctttatttaacctttgaaagggtttcactgaacacagaattttctatgggtaattatgttgtttaaagaagtcattgccatttcttccatttctgtggagaattcaactatcagtcttactgtaagtcttttggattgcagctgagaaaacctgttgttatttatatgatcactcacttgactaccaagatataacaaaactactgaaaggaaggaaaagtttgaagtgagaagaaaataaaagatgaataaaattacattacaataagcttagctacaattatggagagaaaaactagaatacagctgataaaacaagtaagtggcaccctattttgggtaaagttagtagtccaactgaaatctgattattagctgacaaaacaggtaatactccactgtcacttaatttgccataatattttagaaaatgccctttagtagaaagttatcatttcatgtttgcattagttgccacagatatataaacatgatattaggtaagactgcctaaaatcttctcccctgtatttttatggtaattatataatatagagcatgtgatgctctctgaccatatattgtgaatggtttttgctcttatagcagaatttaaagccagcacaaggacatatttggtgtaagaaatgtaataagacttgtggtcaaagttatgaatatttaaatgacattatatatacaaagaaaattatgctgttatttggtttcagtaaaatccagcataaaaattaattttgactcacacccaaatcctaaaatgtaaggggaactatttttaataatatgtatatttgggaaaataattgatttattaattggccaaatatttattgtgacaagccattttctttcattatagtttatttggtaagatgttttcttaaagagcctatgatgaatatttataatataactcaataaaaatgaacattagtttgtcttgcagggaagctatgacacgtatggatattacacaaaaatacaagccttaaggaaataggggatttggtccaccttgttctctgtggtatctctagcattcagattaaggcttatctcatagttaatgttcagacatacatgttaagtaaatgaattattatttttttaaatttgattttgtaacatctgaagtatgaagattataataatcagcattaaaatctggtttggagagacctgtattagaggtgtgtaaacattggtctcctttatttgctattaacatgtatatagtcagtgttgaatttaaaatgatgtaaatcttgagtgttcgctgaggttgactaccagtattttcaggagatcaccatgtggtatgatctgagatgtcttcagacctactttgctctaaaaagttatttacactttgcaatgtttgttaaactaccaagatctgtatattttcactatgtttgtgaagatgacagtttgaaaataagaagatgaaaaacaatatattacatatgtatgtttgggagacaaagataaccccaagtttagaaatgtgaggcaggcctatatttctctccaatagtattttatgattgtctccaattcctgcttggtttgaagtcccttaacgcagaataatttggtcagcagaatgatttagttagacagtaatgacactcttactccagacatatttaataaatgccatgtcttctactgtcttggcacaatatgagaatgtctgagtggtataaggtgcataaagtagtctgtttttatggggatcacaattttgttttctgcaaggaaaaatgaaagatatccacacttggttaaaaatgtattagaaatctgactctgaaaccacacagcaggattatgtgcttcggatccatatcttgacctactttcctaaaaatgtccaagttggtaaaactagatagttctgttatcttgtgaggctttcctgacgcactagttttgggttaagataatgatattactgttggaaaagagaagagtgattttttttttcctcttagaaattgtttttcattttatgtgttagctttctctctctattgggtgaaatgtccttgaggacagtgataaaggtttactctgtttataaaaccagtagtcaggcagctatgactgtgcgaaactctggacaggttattcaccagcttcagaagtggacttgtcctcccacctgatgattgatattggttaatctgtatccatctgtctgttggtctctctatccattcatccattccaggcattctataccataatatagatagataccatataccatgtaccataataccataccaaaatatagatagaaatgtaccataatataccataatatagatagaaatgtacttcaacatttctggatttattgttaaatttggtatgttattccttgaatactctgaacaaaataatagtaggttttatataaatagtagagactcattattatagctcattagataaataaaccttttaggttctattataaaataaatgtttcagtttctattcacaatgattaattcattcaaataaattataaagaaaaagatgagtttcttttacaaacacagttagaatcaaaattcaagtgctaagctgataacattctcattaatagcaataaagcctacagcacttattcaacccgaaaaataattgacttatcccagaaaggcttttatttgtagagtttaaatgtctcttctcataaccagcaacttgtacctcatataattactcagataaagaggctttcgattttcttgtataaaagaaaacactacagactatttaaaacaaacaagtggccgggcacagtggctcactcctgtaatcccagtcctttaggaggctgaggcaggttgatcacaaggtcaggagtttgagaccagcctggccaatatggtgaaaccccatctctactaaaaatacaaaaattagccaggcatggtggcacacacctgtagtcccagctacttgggaggctgaggcaggagaattgcttgaacccaggagtcagaggtcacagtgagctgaaatcacaccactgactccagcctgggcgacagagcaagactctgtctcaaaaaacaaaacaaaacaaagcaaacaagtaccaccaatataatactttatagtgaggatttcaaggcagcctatgttcctaatgatatagagttccagggagggaaataaatccaaggtctttacatataaccatggaatgaggatgtgcaagagaacacctgaaagaaaatcagatttcctataactgaaaacaacaacgacaagaacaacaatacccagcttctcaaatggttaattcacgtatggtaaagagcagagaatggaaaggtgctgatcacaaaacagttactaacactcccctcaccctccaaaaaaggtggtaatttatatttatcaggcagttatggaagtttcttaaaaagcaaggttatttttccttgcattatttacactgcaatatattttttaaatttatggaatgatgaatctgtttacaaaaaatgttttttatcacacgtaggatatttatagtgaaatgaaaatgaataaatcttgatagaattgagacactaaagatattttaaaaatcaataaatttctaagagataattatgtggtttgtatgataacataacctttaattattctcattttttctttttttttcagaccactcaatctctggctactccttaaacatgtgtctgtatctacagttttgctgatatagtactgtcagcctgcattttccaccatgtagtttattctaatacatacaagtgcccagtggctttcattacttctgttccatgtactctcaaattcaacatgtttaaaattgagctcactctgcctctggctatgcttccccagaggtggatggcaacagattccatccattcatccaaacttggaacctgagatttacctttgatctcaaattatacctgtttccccttatccaaacactaacccagtgtacacagatttttacctccttagtttttcttaacttttctttctttccatcattactgctgctttgctaatacaggccctcactaaatctagcattctgcctctagtcttattttctccaaatccattttccaaagaagtcttatgtatcaattcagtctcatgatatgactctgaagtgttttttttcaatggctctagattttcttcaaaattaacttccaatcttccttacctcgtgtgtgagagaagaaactggcacacccctttccttatctgcaagcaaaggtggggacgggaagaagttttaactttaaatcaaacaggaaattttgattatgttatatcatttgaataattaactgaaagaactgactgggaaaatcaggaggtctatctgagtttcagttatccccagaggaagaactaggcccaccaggtaaatgtgaggactcatgagcagtgaagaggctgtgtgatactttcatcccaagtgtggctggttcaatatgccagttacgtttgtgattttctatactcaatactgtttctgtacttcaggttcacagggtcctgtttgtgttgtttattctaatgctctctccttaatttcgaatgtgtcatctcattctcctgccttaattggataatcactcttcatcctttaacacagaaatagtcacctcactagttcagatcttggtttgtattctgcgtctttgtttgtctcatgtcttttgactgatgcttgccatcttacttacaatactgggttttagtcatgtttttcagtctgactgtcccatggtccatgaatgccttaaactcagggaatgtgtctcattcatctttgttattttcagagctgagaactgggtctgaaatgttagataatctgtaaacaaaatgaatgaaatgatgttgcagaggagagacatgtgggatagtcatcaacagtaacagagaggtggtcatgattattttccagatggctggggagctccaccttggaaggtccatctctaatggcaaaagactttttaacagggcttcctgaggacataaagagcccaattgttgttgaaatcgcatggaaagttcagcaagtgtagtatcgttgggatgctttgaattgcactctttgtctgttagaagctgaactgggcatccaggagttacaaagaacaaaaatatggcacctgtgctttggaacaactttgtagccacctgtcacttttggggaataatcgtcttctgagaagatatgttttattcctgagatacagagaacacagggaattctctcaattgcttaataataaaactaaaacaaaagtcttcttactctcaaccagactcatttggtctaagggaaagaaaatgactctcccgtgcttcatatgtgataaaatagcactgagttaactgttgtattgattcaatacacaaatagaaaatagaatgatttggctacagacaattcaagtatgaagattgcagttcctcttataaaggaagatgtcttgatactggttttaagtatttcttttaagaaaactctataaaaaccctgttttttggccaatattaaaaaaaggaaaaatactataaaattagtagcatatgtttcttttttcttttgaaaagctaccccagactagaagatgacttttagtaacactgtggctgtatatttatgtgtgtgtgtgtatgcacacatttttctatcaagaactatctctttacttttctattttcttatgctaccctttatttagttacttattttgaactttataagactacctgaagttttaagaatttcttttgttgaaaaaactcgggtttatcaccctagttattccaataaaaatgaagaagaaagcaaggcatcttagaaacagactataataaccattatataaccactagaagggaaatggagtaagaaactattttatagaattaacagtgcttaactactgtttcatgttatactaaaagcactcaacgtaaaataaaattaaatgacccaaccagcataaacatgccaccaaggttgagtaacaaggtgtaagggtcagactggttagggctgccttgagtcttaagagttcatctccaaagccgttgtctcgcccacctcagctttgcggtgacatcccagtgtgcagtgctcactcacggcaccgtcatctctctgagtgatttatgggctcagaagtcatcagcaaggaaactgcaggaagcccctgctgagaaccacgagcactgaaggaaaacagctgcacacatccgagcagattatttctttaacactcgtgtgaaacaaggcatcacgctggacataccgagtcttcctctttttcttttttttaaatggaaatatccttatctgggtgggtgaaggatggatatgacttcttaagtgaaaaacaaccgtttttgtggagctgctgaaaagattaaaacacactcatatacacactcagtttctcttcctcatcaaaaaatgagcaacaaaatagcttactgaatgtgcatgttcacacatgtacatatatttgcatatttaacttatttcgttgaaatcttttctctttctaaaagcaaagctgcactggaaaggaagactacattttatgagcaaagataaaacactctttgaatagtaaattgtttttaacaaaagaagaattcaggctaaaatgagaagaataatcagtttttgggaattttgccttttgtttaagttttttagtttatttaaatctttactgaactagaaaacaaggtaaattattctccaggttttctgcttagcatgccaggaagttctgggacattatttgaggatgttttgacaaacaaaatcatcccgatatggaataaagtcaacattcagtaacgcataattgaattttattttcgtggatgttagaataatgatatctatgtgttaaaccacaagcttcttgagggctttataatgtgtggttaggggactttccagctgccacagatcctgccagatgcttcagcattttggtttgttccacagttgaggaatgaagaaacttattccacagaagtgctgtcgccatgttctgacggctttccacagctgtgtcctcacatgcggtgtgtccataggagctctgtcaatcatgcacttgggcttgggttttaaaatactgatcacaacaacagactagaatagctacttttagttacatgaattagtaccatttggttgtgttttgagatttttttgatatggctatttatataaaattgtctcacacagctatcaaatgcacaggattaaaaatataagaccaaaataatatttaagtaagatgtaaaacatagcaaaaccacaaagttgtaaactcgtttccaaaagtcacgatagaatactgatctcattaacttcaaatggtgctagttatataaagatatgtatgcatgatcaaagcttaggcccgggtgcggtggctcatgcctgtaatcccagcactttgggaggccaaggcgggcagatcatgaggtcaacagatggagaccatcctggccaacatggtgaaaccccatctctactaaaaatacatatcagctggacgtggtagcacgtgtctgtaatcccagctactcgggaggctggggcaggagaattgcttgaaccatggagtcggagcttgcagtgagccgagaatgcgccactgcactccagcctggcaacagaacaagactccatctcaataaaaaaaaatatagcttagatatctctgccatgaacatatgtaatccaaataatcttttcggcaaatgtgtgcacagggaatatttaaaaactcataatgctcgtcaagaggaaattaatttccacttgaactaagccaacgtaaaagtcaaaaatgccctttggaaatttaaacacaaaacaaaagattgtgcgtaaggagtgaatctgtatatataagaataatcttcaacatggtctaaacgttctcttaatacagcccggtttagtgaataacttagctgcgtgaccttgggtaagtcatttagtttcaatgttttcacataaataactgaattgtgagggtatattgaggcatgcatttcgtagtactttaaaaaataatgcaaatttatgatacattattttaaacgttattataaatgcttacattatatacatatgcgttatatatgtatatagatataacagctgcatatctaatgatgattatactcttctatttctacattaaatatatttttatgtgttcttttgaaaagttcgattactagaactaacaatatttcttcattttatgagatggttctcacattaaaggaagaaaaatgccacgacgtctttctcttcagtagtaggaacaagtgagagaattaattgttttaaaatgactgttgaagaatgatgagaggctctctgtacaataaacaagccaaactcaaatatatggctagagttctgggttgttaatgcacacactataaacttttatgttgggaaatcaagctagtgatgtccaaaaatcatttcttttttagatttccagaaattcatgaccaagaatggtttagctcatgtgcatattacctttggacacagatcaagcaaacaaatataaaaaaccaagtgaaaaatgtttgtcaggctttgttaaacggtgaaacaggatacagtcttattttaagagcagacgaaaatttgcattttatttcaatttgccaaaccaatttttgtagaacctcatcatagcaacattcttgtggcaagtaaagtcagcatgttgttcctatcagtagagggggaatcagaaacagattctggacatattccaatttcaaggggttcagaaagaaaattaaaattaaacttcaaagctgaagtgctcaagactaaactagactaataatacataaagtggaaaattaagtaattctaaatgtcatgggcatgtgaatatcactgactcatctttaattttatagaataagttagtgttataagtgacgagattaattcaagctgactaacacaggttgatcattttgttatttatgcttttgtttccctcttttatttttgttaacaagcttagtgcttggcaataataaatgggtagctcaaatattatcttctctaaaaaactttgttgatcttttctaaaaatacatacttggtttattcacacttctatgacaacccttttaactctgctttaaagtttggattatatgtctatttctctgtggttttttggagtgcaaagaccatgttccctgttggattttccttttctacacaaagtatggtatttggcatataaacatgttaaaagtggtgaacaagcatttcacaaaagaattaatgagtgaagcagtaagtgggttcatagcaaccctcagttgttgacgggatcaactagattattacaagcaaatcctgttgtttcattcattcattctacaaatattgatcaagttcttggtataaataaaatacctggatccatagctgttcatcagcccttcatttaaggtgtcatccatgggagtgaagatgagagacaagaaagtggtgcctgaaagctcagcagttagggaatttgaggccattctaggttctaaaaacactgtggtgaccttagcgcttaaactttctggttttcagtttcctcatttgtaatacgaagggatggccttaatggtctttacattccctgtaagtttaacattttattatgatgattgatagtagtactgctgaggcacaagctctgcagggtcctcatcacatacagcctgaggcaggggtatagaatcattataaggatatcagcactgagagactataattctaaagtcatgcgggacgcaaaatacagcagaggtggcacagaggcagagaggaggcacgtggaggtggtggggtgtgtgtgtgtttgtgtgagagagagagagagaaagagagagagatggagagaaagtgtgactgttcaggggaagaatttgtaaaacatgacactgaaactcagtttttaaggatgaattctgcaggggcacagccagggggtgggtgattccaaatgtcagaaacagcatgcacaaaagcatcgagtttagaaacagtggggcataaagaaaattggaagcacttaggttttgttggagaatgaatgtgtttgacaggttgacaggttggagactggaactgtaggtaagaggctgacctaaaggctctggattccaggcctgagggtacagactgcagtctatactcagagagagatgacagatgctggtttcaaaagctcgtggcagctgctgtggaaggcggaactcaaggcagtaaaactaggagcagtgggccttttgagagcaaactgaggtgagaggtgagatccaggtgagagagggaggggtaagagacgggtaagctggagcttgggcagtggcatgtaaaagagttcctagtgaaggacatttaggaggaagaaccaatcgatagcatttggtaatagactagcatcaatcatcagggaagaataggaacttttttaggttgtccaagtgaggggagatgattttcttaacagataccagccacatggaagcataaatatacctgtggtagaaagatgatgaatttggttttggatagattgaatttgaagtgcctttggggcattcagaaggactagcccattgcgtttagaataacatccagaagccttactagcctggccctgaaagcccactgctgctgctcagccctcatctcctgccgcgccccttcatcctgcccctggccactccaccgttcctgcaccccccgatcccctaaaactagcccgcccctgagttttgcacttgccgtttgctccactggcaacaatgtctcctcaaacatctacagggctggtttatgtgtgttcagcctgtttatggagtctccgaagatcatcttgacagagtccccttcggagaccatcccaagctgcatggccctgggcatttctgtcgcgccgtgttttattttccgcaaagcttatacaactatttacggtgatcatggttattttcgtattcgcttgctctctacttgagggaaaagctctgtgagaacagagaattggtttcgcttgccgttgcgaccccgcacctagcacagtgcctgatgtgcactaaccgcgctgacggttgagtaactgtgcacctgcccgtggaactgtggagagagccggcggatacgcaggtgcagcagagcaggacggacggaggagcgcatggacttgcttccattgttcaagcgccttcatgtagtcagatattgctacaaaataagatattttaaccacaactggttttttcactctgacttcccctcttccactcatctcatgttagttgatatgaaaaagtgtattggggacacagctaatgagacattgaattagaatacattagatttggttctaataggatgtatttgtacaatttgcgacatacataatcataaatgccaaattacatagagaaatgcatatttatttagaacgagaagagaaataataatactagcttttgaaaaactaacaaatatctaatcttcacaaagtctagaaaatcacgtgtttttatgttgttttgccggatattgttccatagtccttcttttcctatgtttttggctgaatagtatttaatctcctcttccaatggcagcgcttttgtaatgtcactttctataaaaaggaaagataattctatttttctactagtatggttgatttattttaaacagtgtttagaaaagtatttttagcattataacttgttaatgaaacataaaaatttcaaggattgttttcaaatttaggaaaaacttgttttttcttttttttgttgctgttgttgttttcgagacggagtctcgctttgtcacccaggttggagtgcagtggtgcgatcttggctcactgcaacctctgcctctggggttcaagcgattctcctgctgggactataggtgcccccgccactaggtccggctaatttttgtatttttagtagaaactggtttcaccatgttgtccagggtggtcttgaactcctgacttcaggtgatccctcctcctcagcctcccaaagtgctgggattacaggcgtgagcccccatgcccggctgatctcgtttttcacacagggtttgttacttacatgcttgctgtttttggagctgcttcagatttgtgccctacacatgcagtaattctgataaattctattttatgaaattttccaccaaagttaatgtactgatttctgtatatgctttattatatcatatatttttgaaaagagagaatttccattacttgagagaaaattttcaattcatactttattcattcaatttttaattatgtacatttcaaaatgtatttcttttccattccttgcatgcgtccggtgacaggtcccccaggacattctgtcttggccttgcccctttgtcacagtggaatacaattcagctgagaaaaggagaaagtcctgtcagtcacaaaaccatagatgatcctggaggacattattctaagataaataagccaggcatagaaacacaatactgtatgatcccacttaaatgtgggatgtaaacaagtcgaacccatagaagcagaaagtagaatggtatgagaatgtgtcggtcgaagtgtacaaagtttcagttaggagaactatattctggagatctatttggcggatgtagtaacaataatgtactctacccttgaaaattgctgaaagtaggttttaaatgttcccacaacacaaaaataagtatgtgtgatatgttaattagcttgatttaattatttcagaatgtacacatatgtcaaaacatcatgttgtatcccataagcatgtacaataaaaaataatttaaaacaatgacaaaaatccagaacacacaaaatacctataaaatataaataaaaatataatagccaggcatggtggcatgcctgtgatcccagctactctggaggctgaggcaggagttttgcttaagcccaggagttcaaggctgcagtgagctgtgatcatacaactgcattccaggctgggtgacagggcaagactctatctcaaatatatatatatatcatatcattatatatgtgatataaccataaactataaaatatacatttaaaatattatatatgtaaatatacatttatgaattacatttgagttcttgctgcccttttttttaatggcagcatctaaaagactggaatttgtccaagtagaaaatcctacttttgttaaccattacttggctgaatgtcaataaatgcccatggtatgagaacatggttgtttataagaaatcatcaacagataactgtatatttataaacagttaacccttaaacaacatgggtttgaattgcatggtccactcataagcagattttttccctctctgccacccctgagacagcaagaccaagccctcttcttcctcctcttctgctcaatgtgaagaagatgagaattaagacccttgtgatgatccacttccacttaatagtaaatttatttcctctgtctctctctttttttttttttttagttgtggggggtctctctattttgccgaggctggcctcaaactcctgggctcaaatgatcctcctgcctcagcctcccaagtagctgggatgttgaagcaggtcacaggacatcatgcctggcttccttgtgatgtttcaaaataacattttcttttctctagtctcaggttttttgtaaaagtatagtgagtatagtatgtaatacatataacatgcaaaatatgcattagtcaactatgttatcagtaaggctacaggtcaacagtagactattagtagttaagtttttttttttttgtcttttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactaagaatgatgatttccaatttcatccatgtccctgcaaaggacatgaactcatcctttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgtgtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtcaatttgtttgagttcatcgtagattctggatattagccctttgtcagatgagtaagttgtgaaaattttctcccattttgtaggttgcctgttcactctgatggtagtttcttttgctgtgcagaagctctttagtttaattagatcccttttgtcaattttgtcttttgttgccatttcttttggtgttttagacatgaagtccttgcccatgcctatgtcctgaatggtaatgcctaggttttcttctagggtttttatggttttaggtctaacgtttaagcctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagcttcgttcttttggcgtaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatcttgattcttcctacccatgagcatagaatgttcttccatttgtttgtatcctcttttatttccttgagcagtggtttgtagttctcctcgaagaggtccttcacatcccttgtaagttggattcctaagtattttattctctttgaagcaattgtgaatgggagttcactcacgatttggctgtttgtctgttgttggtgtataagaatgcttgtgatttttgtacattgattttgtatcctgaaactttgctgaagttgcttatcagcttaaggagattttaggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgctgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttggttggtaaactattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctatgggatcggtggtgacatcccctttatcattttttattgtgtctatttgattcttctctctttttttctttattagtcttgctagcggtctatcaattttgttgatcctttcaaaaaaccagctcctggtttcattaattttttgaaggtttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgcgtctttgttctcgttgatttcaaagaacatctttatttctgccttcatttcgttacgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggagagttagctcttcttgttgaattgatccctttaccattatgtaatggccttctttgtctcttttgatctttgttggtttaaagtctgttttatcagagattaggattgcaaccctttttttgttttccattggcttggtagatcttcctccatccttttattttgagcctatgtgtgtctctgcacgtgagatgggtttcctgaatacaacacactgatgggtcttggctctttatccaatttgccagtctgtgtcttttaattggatcatttagtccatttacatttaaagttaatattgttatgtgtgaatttgatcctgtcattgtgatgttagctggttattttgctctttagttgatgcagtttcttcctagtctcgatggtctttacattttggcatgattttgcagcggctggtaccggtcgttcctttccatgtttagtgcttccttcaggagctcttgtaaggcaggcctggtggtgacaaaatctctcagcatttgcttgtctgtaaagttttttatttctccttcacttatgaagcttagtttggctggatatgaaattctgggttgaaaattcttttctttaagaatgttgaatatcggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcaaggagtatctttgtggcattctctgtatttcctgaatctgaacgttggcctgcctttctacattggggaagttctcctggataatatcctgcagagtgttttccaacttggttccattctccccatcactttcaggtacaccaatcagatgtagatttggtctcttcacatagtcccatatttcttggaggctctgctcatttctttttattctttttctctaaacttcccttctcacttcatttcattcatttcatcttccatcactgataccctttcttccagttgatcacattggcttctgaggcttctgcattcttcacgtatttctcgagccttggttttcagctccatcagctcctttaagcacttctctgtattggttattctagttatacattcttctaaattttttttcaaagttttcaacttctttgcctttggtttgaatgtcctcccgtagctcagagtaatttgatcgtctgaagccttcttctctcagctcgtcaaagtcattctccatccagctttgttccattgctggtgacgaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgagatgtcagtgtgcccctgctggggggtgcctcccagttaggctactcaggggtcaggggtcagggacccatttgaggaggctgtctgcccgttctcagatctccagctgcgtgctgggagaaccactgctctcttcaaagctgtcagacagggacatttaagtctgcagcggttactgctgtctttttgtttgtctgtgccctgcccccagaggtggagcctacagaggcaggcaggcctccttgagctgtggtgggctccacccagttcgagcttcctggctgctttgtttacctaatcaagcctgggcaatggtgggcgcccctcccccagcctcgctgccgccttgcagtttgatctcagactgctgtgctagcaatcagcgagactccgtgggcgtaggaccctccaagccaggtgcaggatataatctcctggtgtgccattttttaagcccgtcggaaaagtgcagtattcgggtgggagtgacctgattttccaggtgccgtcggtcacccctttctttgactcagaaagggaactccctgaccccttgcgcttcccaagtgaggcaatgcctcgccctgcttccgctcgcacacggtgcgcgcacccactgacctgagcccactgtctggcactgcctagtgagatgaacccagtacctcagatggaaatgcagaaatcaccgtcttctgcgtcgctcacgctgggagctgtagaccggagctgttcctattcggccatctttgctcctccccccttagtagttaagtttttgaggagtcaaaaatttcaactctgagtcagtaacccccatgttgttcaaggatcaaatgtatatatttccatatgtgtgtttagatacatgtatgtgtgtgtgtatatattcatgcatgtgagcctatgtgcgtgtagactattctctaaaactcaaaatcagagaaaaataacctttgtgtaaagtaaaatatatcaatgaccataatcagatatgaatcataattctaatatgtagttgacgtatagaaaaaagcataagaatttgtattgatatgtttatttaaattaaattataaaattgcatagagttagaaaaagcaaaattagtttattgcaattattattttctcaacttgatattaataaagttatttttataataatggcacatattaaaaagcaattttactctgtccttcagagcatttgctccacattggagctatttccattgtagatttttttgtaaggctataattctatcacatgggcagattgtgctaaaacaagcagaaagggtcacaaccttctgtctaacctttgctatttagaatgaacgcccagggctttcgagaatgtaaattgtcctggcctgttctctgacaaaataagaacatacagttgaagaattattttttgtaaaacctaaatttgccttttttcctcacactaagctcttctcaagtgttaagtttaaagacagttaattatcagctattctttagagcacgggaaaaacagtttagtactcagtaaagtgagcatgcaatctaccttattcctgtttttttcgatggatgaatgtgaagaatttacacagtcatgcaagagaggcaacgatagtgttctcttaagaagacaaaattataagattggaggttaacacttgctcaacccagtaaaaaggcatttggtagatatttctgatctttccctgactgatgaaaagtgctgatatttctaagaaactggtaggaaactttaaaaaaaaaaaactccccgaagcctaccaccaggcatgccatgaactttcagatgacacatcgtgctactaatttttagtgacctttgctaaatttatcaaaaaatgctctcactaaatccatttctgtagaaataaagaaaatatccgtgatgtgcaaactcacagtacaaatctgtgcggcttctgactgcaaaagatcctgcatatttcatcaaagcctcagggttgtggttattgatgtttcccagaacgtggagtgaaaccccacacaaacagattgccaaaggggagaaaactatgatttgtgaaattcaacattatctcttgaatgcctttgctttttattttgaacatactttattttttagaccagttttaggatcacagcaaaattaagcagaggtatagagatttcctatatatccactgcccccatacaggcatagcctcccccattatcaaaagcccccacaagagtggtaaatgtgttacaactgattaacctccattgacacatcattctcaccccaaatttaccttaggtgttagacattctgtgggcttggagaaatgtataatgatgtgtacacacaattacggcattatacagggtaggtttcttgtcctaaacgttctctgtgctccacctattcagtctccctctctcttaagtctgggcaaccattgattatttttactgtctccatagtttgcctttaaaaaaatgtcatatagtggctcacgcctgtaattccagcactttgggaggccgaggcaggcagatcaacgaggtcaggagttcgagaccatcctggccaacatggtgaaaccctgtctctaacaaaaatacaaaaattagctgggtgtggtgatgcttgcctgtaatcccagctactcagagggctgaggcaggagaatcacttgaaccagggagttgacgttgcagtgagccgagattgcgccactgcactccagcctggcgagagagcgagactctgtctaaaaaaaaaaaaaaaaagtcatatagttggaatcgtgtattatgtagccttttcaatttggcttttttcacttggtaatatgcatttaagtttcttccacatgattttatggcttgaaagcttatttctttttaacgctgagaaaatttccattgtctggatgtacaacggcttattccttcgcctattctaggctatctaaatttcttctaagttttagcaattatgaatagaaatgctctaagtgcaagtttttatgtagacatgttttcatcttctttgggtaaataccaaggagagtgattatagtatcatataataaaagaatgtttagtttggtaagaaacggtcaaactctcttccaaagtgactgccattttgcattcccatcagcaacgaaagagaattcattgttctttaacctcactagcatttggtgttggatctggagcttggccattacaataagtgagtagtaatatctcattgttttaatttgcatttccctgaggacgtatggtatggagcatctttcacgtgcttatttgccatctgtatattttctttggttgggtgtctatttaggtctttggaccattttttaattaagttttttttttttatcgtttagatttaagggattctttctatattttgaatagcagtcccttatcagatatggcctcccacatgagaatgtaattcttctgacagtgcctctcatggagcagaactttttaattgtaatgaagttcagtttatcaattgtttctctcagagattatgcttttggtatatctaaaaagtcattgccaaactcttgctaatctagatttttctcctatgttatcttctaggagttttataattttgtgttttagaatccactttgagttaatttttgtgaagagtataaggtctgtgtctaggtttatttatttttgcatgtggatgttcagttgttatagtactatttgtagaaaagactgtttttgctccatcgtctttgctcctttgtcaaagatcagttggctctatttatgtaggtctacttctgggctcctcattctgtttctttgacatgtttgtctgttgttttaccaataccacactgtcttgattactgtagctttatagtaagtcttgaaatctggtaatatctgtcctccagctttgttattctccttcaatattgtgatggttattgtgagtcttttgcctttccatagaatcagtttgtcaatatacactaaaataacttgctggaattttgattggggttgcatttaatgtatagattcagatgggaagaactgccagtatttagcctctctatccatgaacatgagatgtctctatttatttagttctttgatttttttcatcagagttttgtcattttcctcctataaatcttgtacatattttcttagatttatatcttcggtatttcattttgggtgtgctcatgtaaatggtattatgcttataatttaaaattgtacttgttcattgctggtatataggaaagcaatagggtttcgtatattaactttatgttttgccaccttatgataagttagtttcaggaggttttgttggtgttattaagttattgttgttgattatttttgattttctacataaataatcatgtcaactgcaaacaaagacagcttttttactctattggtgtgttttatttatttattatttatttatttacttatttatttattttctcattgcattagttagggcttccagtgtgctgttgaaaagaagtggtgagaggtaatatccttgccttgtttttcatcttagcacaaaagtttccactttctcaccattaaatgtaatgttagctgtatgtttttgtaaatatcacttgttagtctgaaaatgtctttttattattattattatactttaagttttagggtacatgtgcacaacgtgcaggtttgttacatatgtatacatgtgccatgttggtgtgctgcacccattaactcgtcatttacattaggtatatctcctaatgctatccctccccactccctcccaccccacaacaggccccgctgtgtgatgttccccttcctgtgtccatgtgttctcattgttcagttcccacctatgagtgagaacatgcctgcaggttctgtccatttgtggtagagggacattaaagtgttcaactataatagtgaatttgtttctctttgtggttctatcagtgtttgtctcatagctctaatgtctgctctgaattcacataactactcctgctttctcttgactaatgttagtatggtgtatttttctctatttatttacttttgatctataggtatctttatatttaaattggatttcttgcaaacaatatatagttgagtcttgttttttgatccactctgccaatttctgactttcaattggtgcatttagaccattgatactccaagcgattactgatatagttggattactgtctataatattttttattcttttctatttgttgccctttgcttctatttttgaattctacttctttctgcttttttgtagcttgagtttgttttttattgaacagaatgaacaagaagttgttggctcctcaaaatcaattattatttttatatcaaactggaaaattaaaactaaacttcaagttttatcagcttgttatttgacaagtacttttttttcccaggcactgccctttacatctaagccaatgggttttctatctatctgtttcctactttctagtttaggttttaatagtttttaaatctttgtggttattattgatattctcaatttttactattaaaatgaagcattatggatagtaaagcatattttgaagaatttctacggtgattaaaaatttttctattttgtaatatggtgttatttttacatagaaaaacacctgatacttttgagacctcagttatctctcacataaactctcactgaatttatctgtacccaagtcatggtgttaagaagtcttgctgtgaaatgtagaggtcagtcacatacatgttgaaatacaacagaatgtgtgtgggttgcttccgggctcttctgcttaccagctgtgtgtccttgcacaagttaactaaattcttgcctgtcagcttctcatcagtaaactagggagtataaagacaatccatagtattattgtggatgttagctaaaatattttaatgcaaagtatcaattaaaattttttgaaatataatagatgtcccaaaatgctggcttaccattcattattattttaatctttgcatttcagtcttttgtgatactttctccaacatacaacagtctagaatggaaatatgggctatatttttgaatttctaagcattttacctggctattagtatgaattcaagaagcatttgttgaaagaaaaataagattctcaaattgtaagcattagtgcaaacatttacttggccactaagaaaatttaataattaattaatatactttagaatttgtttcaaaactctaaatgtttatgataaaactaaactttctggtatttggatttattcttaataacttcttttcctacattgcctttgtgaagttttctctctaataagccacctttaaagtttgaaactgcagaatcacaaagtgtacacttgctgcatactgtagagtccttttggttgcaccaaatcctgttgagagttttaccattttaataggcatcagtcagcgtctgcaaaaactttgcacacatgtaaagctgttgctgaaatcttttattatctggagaaggaaaagcactaattttttcatgccataaaattcctaaaaatgatgctctgatggtaacataatgccctatatgtgagtaccatggttatagatttaatctaaaatatgaaatcatcaatactatacagccaatatcaaaaacatgttgatcaatccataaaagatatgttgatcaataatgatcaaagcttaccgataccaccgtgtccagtgttcattctaacagcacagcacaatggttccagacaattacctagtcttgttctccatatcaagtggagttattagccaatgggtgaaaattttctgttaagcaagatgaataaattctagacatcttctgtatagcattccacctataggcaaccatattgcactgtacattgaaaattttgttaagaagatagatcttacgttaagcgttcttaccacaatttaaaatagttttttaaattagctagtaaaccttttttatggtctagatactaatttccaaatataaagatggataatttaattgtctttaaaatttaagcccaggtgaagtgtcaagaatgtcagcatttatttctgtgttgacaaatcagaacataaacataaacaaatcaaaacatcaactacattcaggtctccaactttaatatcaactatctgttaattgattttaggtccacatctttgtccacaatggcacatttctaaacgcatcatctggaattaaaactacttacctactctctatacagttgccacttaacgggaatttcctggttgggtcaggaatgtgtttattcttatgcattctttgcaggctgcattgcccagagttcaatctggtttcatattgtgaagcacaggggagagtgggaagaggtaaatattccctacaccttcccacccatccaccctgaccctatcctcttccccactgtctgagggctttagacagtggctacatttttccatggctccgtccagaaaggtccactgttacttcagttttaaccaaataatccctgcccctgagctctggtaaatgcctcttctctttgctactctggcctcggagaaataattccttactgggattcatgatatctgggttttctctcagtgatttcactggtgtctcagcccttccattacccttgcagccagtccccaactcgaaattattgttgtccagggaactcaaacaactcaacaagaaaaaacacaggtagccccattgaatagtgggcaaatgacatgaacacatatttttccaaagaagacatgcaaatagtcaacaagcatatgaaaaactgctaaatatcactaatcagagaaaaatcaaattaaagccataataagataatatcttacagcattaaaaaatatggtggtgaggatgtggagacaagggaatgctttgtacactgttggtgggagtgcaaattagtgcaacctctatggaaaacagtatggagatttttcaaagaactaaaaatagatgtaccatttgacccagtcatcccagtactgtgtatctacgcagaagaaaagtaatcattacaccaaaatatacctgcactcatatgtgtactactcaaagcagcaaagatatggaatcaacctgagtgtccatcaaaggatgattggataaagaaaatgtgttattatatatatatacacatatataaaaacacattttcgtgatatatatatatatatatataccatgaaaaaatactcagctataaaaaagaatgaaattatgtctttttcagaaacataagtggaactggaggcctttatcttaagtaaagtaactcagaaacgaaagtcaaatacggcatattctcacttataagtgggagctaaacaatgtgtacacatgaacatagagagtggaataatagacattggaggcttggaaaggtgggagggtgggagtggggtgaaggatgagcaattacctctcgggtacaatgtgcactatttgggtgatgattacactaaaagctcaggcttcaccagcacataatatatccatgtaacaaaactgcacttgtaccttctaaatctgtaaaaataaaaattaaattgtccttatttcaaatgcagtaggtggtttctgttttgtttttgtgtttttgctttttgacaaaattgcgatatatatgcgctgtataatgatatcctaggagtcacgtttctggatctactttttcagggtcatttctaagcattgtggattatgtatctgttttagattgaaaatactgaaccatatagctttcatgggatttgagaatgaaatcatgttttccctaagaaatgatatcttttcttctaaaaacacaaagcagtctaactttgataattaattctaatatgcattgggaacacatgcataggtagatggaaagtttgatgaaatgctaccatgtgatatatgattttcatatatatctcatttattcttgcaaccactcaacagggatattatgtaacataacttgctgttgtgaaatctgtaaaatagctacaaaccaaatccaaggctgtctgagtccaaagcctagaccatttctactctgtaaaactatttcttcttcagagaaaatatttaaaacaacagtgacagactatgaatgttcaatatgtataatatggaaatttgtctcttttttctttatttttcttgctgtattagaaaaactccttgcagcgttttaagattaatgttcctttccctctaggaaagaggatagagcaaaacaagttttgttttattaatgatttcagtcctggatttaataaattttaaacctacactatgaaattaaaagggatgatgcattttgggatgaggatgagttagaggtagaatgacataaagataaagaagtgaaggaagtttatcaggcgtgaaacagaagcctggggcacgatgatggggaaggtttccaagtgggaggagctactgattagtgagtccagagggtagttcccaggaaggagcaacgtacatcaataaggaggttcaaaaacaaattgtctgtacctggtaaggacagaagtacaaattcattggtctgtgttaaaagtcttgttccttatcaaaatgcaatctatagagaacttcgttaatctggatattaggcaggcatcatgctgattcactaaatgatgacatcatctttatgagccttgataaaataaagtacaaataatccaaaatgtcctggaaatatacatgcatcatggaagatggtaggtaaacttcatggagaatcaggggcttgacaaattgatgttcttagaggattgaggtatgccacaggtagggaagaaacggttgcatgttgcacctccagttactaaggcagaagcccagatcttcatggattttggaggtagcattatttattgggtgatatggtttggctgtgtccccacccaaatctcatgttgaagtgtagctcccataattcccacgtgttgtgggagggacctatgggaggtaattgaatcacgggggcagttttcccccatactgttctcgcggtagtgaataagtctcatgagatctgagggttttataaggggttttccctttctcttggctctcattctctcctacctgctgccatgtaagatgtgcctttcaccttccaccatgattatgaggcctccccagccacgtggaactgtgagtccattaaacctctttttctttataaattacccagtctccagtatgtctttatcagcagcatgaaaacagagtaatacattgggaacttggaaactatcagttttaagtggaatccagagaaacagagggctgtgtagcacaatctgttctgcctcttaagccacatgactcagtaaatccagagatgctagatgtatctgtaatagataatgaagctacatggagtctctgacaagcccaaatataagggttgcagaacagacccatagggttttagataaaagccatgccttccttagcgtgcaactggaccccagcagactgagcaccgtaatgcgggatatgaagtgattttccaatcattctttcctcatgagttggatatgttcagatctgtcaatttatgacactgagggtttgcaacatcaatatattatacaatatttgatgggaaaagtattgtactgatgtttgtagttgtgtaacaaatcaccataaatttagcatcttaaacaacacgcatgtattatttcacagattctatggatgaagagtgtgggcacagattaactgggtcttctgcttagggtttcaatggctgagaaatcaaggtgttgactagactgttttctcatctagagtttactggagaaaatccacttccaagttggaaaaattcatttccttgcagtcacagggttaaggtctccagcttcttgacagctggggctgggagccaccttcagcttctggaggctgccagtagttctgagaagccaccggcaattcctgccaatggccacttatacttcatcaagccaataaggagaatctctgtgacaagccagcctgcaaaacagggtaatatactgtaactatcatgtgagtgacatctcatcacattcaccaaattctatcgattagaagcaagtcaaggtcccattgacattccaggggatggaatgaggcacaaggcattcagcaccaagaggtggagatcatgggggcatcttagagtctgcctgctacagataaattcagagttaggcctgaaaaggtccagaagacacaagtaagttgtagccatgagtagcccaggtgcaatatcatatacctcagtagcaccagtgtcttctcctcagctaaggaaggtgtcaagagagacatcttatgatcaacctatggaggaagaaaaaatttgtggtattttgcatgtcggctcagggcaaagagtgcattttagaataaaggaggtgtggcaacgtgtgtgcatggccgtcagatgcacagggctaagaagcaactgctagaaaggtcaaatagctgtaataggttcagctcatgtggaacttgggacactgctctgtatgtttgagactctctcctccagaaaacagaatatttactgagccagcagtcaatacatggtgctgagactgacatgtctagaaaacacaggtctcaggaccacagggtgaaagagttgccccctcaccatcacacgtgagtatccacttgaagaatcactgtgttttccagtctcacaacattaggctctcctggattagggataatggttcccaagaaagaactgcttctatagggaatatagaaagaattccacataatataaagttacttcaagttagaactgctgtctgattactttgggtttctcatactaacgtactcagaggcaaagaaagaagatactcagctaaggaggtaattagtccaggttattatgagagacagtgacaaatgtagaatccaaaaagactaatatggccatctcctgttatttatctgttcagtaagaacaatgaacgggcacttatagcagtcatggtccagtaagaggaagaaagtatggattcaactctgtaggggtgatggtttgagtcaacgcaacagaccagcaacccagaccaaacaaagagatctgtcattcttcctgtgagtgacaccggaactgctctcgttaaccttacactgttcgtctctgacttcctgttccagacttctctgttggcacattgagagtaatgtcatggtgagctgctgtgcgctcaagaatgtgctacctggaggtttgggaagttaaacctttagagaaatcttttgaccaaaggaacttgggagaaaatggatacacattttcctataacttctccagaaagtcttgagacatagtccatagacttccgtaggagatcaacgaaatgaaggaagcagctgtcgatagttgtggctaacgtaaaaatgtatctctatattcagcctcccttctcccctgttttgttcccctgcttcctggattccactcctcgataaaatacttgcccttaagcctttgccttagctctggtgtctgaggaattagagctaagatactgctcattatgagaatgtcaacacccacgccaagtctactaattccagatgatctaaaattttaagacccttagggatccagttcactggaggattctactcaaaggtatagagaaaggcctttgttcaagctgcacatcacattttgttaattaggcatggaagtcactctcctcgtacccaaggtctcacatgtgctctcctaacgtactgattagcatccaagcaaaaccacaacccatcatataccactttaagcttctcttcccccagtggtattattgctctgtcctaattacgtgacaacaaccccacggatttgaattcaaatggcagcaagcggccaaaatgccaatttcttcatctactaatctgtacttctatagtttctctccgaatgttttcttcctccattttaaagttatatttctgtacatgaataactccattatacagttaatatggtaaaggaaacaaactctttcttatgtcaatgacacctttaatactttttttatcattcctctattttaaaatcttactacattttcctttttgaaggtattattttcccatatgcctacagaaaatatgcccattggcaaaataatgcaaaatgatgaagataataaaacaaaataaagaaaataaaaatccacagtgttcttgtttttgagccatttctttgaatggatacttagcctttgctattacgttattatgactttaacaccatcattgaaatttgcctggctgggcggggtagctcactcctgtaattccagcactttttgaggccaaagcatgtggatcacctgaggtcaggagttcaagaccagcctggcaaacatggtgaaaacccatctctacaaaaaaatacaaaaaattagctggccgtcgtggtgggtacctgcaatcccagcgactcaggaggctgaggcaggagaatcatttgaactcagcaggcggaggttgcagtgagccgagatccatgccactgcactccagcctcggcgacagagagacactccatctcaaaaataaaaaataaaaaaagaagaagaaagaaaagaaatttgcctatcactgagaacagttaatttcatacagggtcataacacgctagatgattgcactgttattattataggtagataacagaaggccaggacattagtctgttttgcattgctataaaggaatatctaaggctggtagtttattttttgtcttggctcatggttctgcagactatccaggaagcatagtgccagtgtctgcttctgtgaaagcctcaggaagcttacaatcatgacagagggcagagggggagcaggtgcatcacatggtgagacagggagcaagagaggggggaggtgccaggctcttctaaacaaccaggtctcgggaagtaagaactcataactgcagggagggcacgaagccattcgtgaggggtctgcccccatgacccaaacccctcccaccaggccccacctccaacgtcagggatcacatttcaacatgagatttgcaggggacaaacatccaaactacatcagcaagttctggactaaagtaagacacatttggtttgacgcccttccattttatttttaatataccctcttccaacctaacagacatcaacccaggtctcgttttttcctgatcagattggggttttattttaaaccaagcccatgttaacagccagttttttttccaaggaaaatatccccattattagctatggccaggattttctgaattctctttcctatttgcactttgcatttttactggggcttctctgcccttcataagaggcgcgcatccttagtggggcactgttaaagcagccgcgtctccctcagccctggctacaggcagcaggtgtttcttccatcttatgcccatactccgcctccttaggctttctacacaagggaccttaagtggaagcccacactcttcttgcaatcaaagctttctctttttcctgaggttcactgatgttgttgattctataatcttttgtggggttttaatttgtgataatgtaaagtgttaggagtcccccaaagcatttatattatgagaggttgttcccaaatatggaaacgtgttcaactcacagtatgcatttctaatggtagaatttacccccctttagtaggtgggtgctgtcaaaggggagtacatgtgtgtctatatggctctgtgtctgtccttgtctacctcacttctctacttattatctatccatttaccacccattctaaatagatctgatggtaatgccagagaagagacattatcatattttactgaataaaataatgagaaaaagcggggttgaagtcacatcacagaccgagaaaaacttctagagtattactgtgcagaaaatgcagtggactagaggaaatttagccagtacttctttctttatgatcctattattttcactacacagaagccagttttctccctgctttttcacttggtaggatttggccagtgtctgttagaaatttggttaaagctcaaacaagtcggattttcaaaagcaacctgaaggtcagctgtttagttttatgcatttccttcttctctgaccaaatactgcaagttctgccaataggcaaaggcaaagataatgtattttgtatggcctagttttgtatccatatgaaatactatagacttgtttgaggttacagtttgaatattaacaaaaatcaataaagctaagatgtactagataacattcaaagtccctttgaaataagaagaaatgctcaggaaaatctaaaagtaaaatatttatttttctcaattgatatttccataagtcatttttattttttgctcttaataaagaaaccataataatgtgagaataaagtgaaatcagtggtaccattattgaatacttatttaataccccctcactacaacaccaccccaagtcccattgctcaaagacaaccacttttgtttctctctctggtatttgggaacacatttattaataatataggtataatgtaattttctattgagtaatttacatgtttaaccattacaggcattttgctttcctgttccaatggataaaaattcaactctcctgatagaaatttcaaagacagaccaggcttggtggcttatccctgtgatcccagcactttgggaggttgaggcaggcggatcacaaggtcaggagtttgagaccagcctggccaacatggtgaaaccctatctctactaaaatacaaaaaattagccgggtgtggttgcaggcacctgtagtcccagctactcaggaggctgagacaagaatcacttgaacctgggaggcggagcttgcagtgagccgagattgtgccactgcactccagcctgggtgacagagtgagactccatctcaaaaaaaaaaaaaagagaaatttcaaagagaaaaagacaaatcacctagccatgagttagatttgttacatcataacatttcagtgttagattggattttccattgtgtctagttcacccagccatctaatgcttgaagtttttctaatcactcttttctttctcagaggacgttgacttctgcacgaatccctccaggttctgtgaaatatttctcaaggttgtcagttgcccatttcataaccctacagctaggatttctctccctgtctcactatctctctcctccacctcaagcctcagatcaaaaatctgtattcttgggacttctcccttttgagctagaattccacatggaatcactactgttctacctgagagatctataaatattttaaagacaatattagtttctgtccttagttttttctcttcaatgttaatattataaattctgaacatgaatatatgtcaagttctctttccatctttaatgctatacgtaaatgttttaagtttcatggccaggcgcagtggctcacgcctgtaatcccagcactttgggaggccaaggcaggtggatcacaaggtcaggagtttgagatcagcctggccaagatggtgaaaccatgtctctactaaaaacacaaaaattagccgggcgtggtggcacacgcctgtagtcccagctactcgggaggctgaggcaggagaatcgctggaacccaggaggcagaggttgcagtgagccaggatcgcaccactgcactccagcctgtgtgacagagtgaaactctgtctcaaaaaaaaaaaaaaaaaaaaaaaaaaaaaggacaggcacagtagctcacgcctgtaatcctagcactttgggaggccaaggtgggtggatcacttgaggtcaggtgttccagaccagcctggccaacatcatgaaaccccgtctccactaaaaatacaaaaattagctgggcatgatggcacatgcctgtaatcccagctactcaggaggctgaggcaggaggatcacttgaatccgggaggcagaggttgcagtgagcagagattgtgccactgcactccagcctgggcgacagagccagactctgtctcaaaaaaaaaaaaaaaaaaagtttcttgtttctcgatgccgcctttaaagtgtagtgtttggagtggccgtgccagggagtgtctccacctctctttcctcacccacagatggttctggggaagctgcatcacagccgtcacttgtattgagctcacgtgcaaccaaaaccctttatagagttgggtttttagctgtgtctagacgcttttatgctgaattcttgaacacacatagactcagctggactcttttacgctgaattcatagacacagctagactcttttatgctgaattctaaattcttgaatttaagaatcttaaaattcttgaattttagacccaaaacagtgccaaatattttatctttgtcacattttctttctagtcagagctgacaggttgttaaatttaagaattttttgaatactggttcttttctattttctatttctgggtatgtccatatctgtatcaactaaaaatgtcccaagcctgccattactaccagtcccttagccattaataaagacatgcaaccagaaatgattgaggacagacctgctgggcatctcctgtccaggttgacactgattatttgatcaataattttgaaagatggattgtgtataagttacaatatatttgatattttgtaaaaaaaaaaaaaaaaagactcagtaagcccaagaatctaagaaaattaatactaaataactttcccaaatgttgacataagaaaaaattatacctgagaaaagcattattaatgtatttttaaaataatttatttaaaaaaattattgtggttttcttacataactagcaattatctataggctttgagaaaaatgagtcaaagcggaacacatactcacattactatagatgttttaattcagctgtaaacctttggaggataatgaccttgttttgccctatgtgcgtggggcagagggaggcaggaactcaggcctggaaggaacctcatgatagtgttgctttttcctttttccaacaaaaagttagagatgcatgatcaataaaataacaagcatataattgcattttgaggtaagtgagcagatgctgtgttgctagggaattgttgttgaatgagtataaaatatgaatttccagaaagttgtcatgtaggtaatatctgattttattggcaaggaaattctcagtccctgtgaagtcatcattaccaagttttgagaatttaatagggagtcaatgtatgcattggtgtgtttctttcttccttctatttcaggtactagtctcatcttttcccagaaacgaaggttggtcagaccatctgggattagaaacagacagcaaaagtgtccctttaacctgaggacactacaggaaaggtctttctttcctttgggcattttcttcatgattgctttacccctatactcatgctactgagctctctcctttccattttgtgaataaactgggactgaagataagatttggaataaatgtgtacttattatcaaaatgaatattttatctcttgctaattcgtagtaatttgcattggttagttcttgaagggaaatgatctaaaaatgtaaagatttatgaatacggaaaaacatgaactattatttcttttaatgtttccctttagtcaactttaggaatacaaaactgagttgttttacctcccttaagttttgggacatgtgattccagctctgttcctgttgatgacagaaagtcacattcaaatctcttgatatcatatctaaaaatcctgatttgtggtcaggcacggtggctcacgcctgtaatcccagcaatttgggaggccgaggtgggggatcacctgaggtcgggagttcgagaccagcctgagcaatatggagaaaccccatctctactaaaaatacaaaattagccgggtgtggtggcgcatgcctgtagtcctagctactcaggagactggggcaggagaatcgcttgaacccaggaggtggaggtaacggtgagccgagatcgccccactctactccatcctgggcaacagagcaaaactctgtctcgaaaaaaaaaaaaaatcctgatttattacagaaaggtccagagcaaaagcagcattttgaacttggtgtatggttaactggacagggatgtggatctgaaggagagcagagtatttgtactagcaaagggacagaaaggacaagttcgggtatcaaaaaaataggtgattaaaactataggaaaaaaccataagggtatgaattgccttgtaaagaaaccattttgagaaggagagcaggaagcaaaattagttaagaaggaatgtttttaagacaaagtaagtattcaacagtaaaaggaaataaaaggtttattgaatgttcccaacacaaagaaatgatgaatgtctgagttgctggatatgctaatgaccctgatctaatcatcatacattgtatgtattgaaacatcactatgtaccccataaatactcataattattatttgtcaatttaagaatattttaaaatcacacaaaacacaatagcagcattattatgtgacaatatactcccaaaatacagaactagtaagaaatattatcaatagacatggcttcaaagaaatagaaattgttttctaaaatatagactttgggcagtaaagcattgcagattgagagaaaacattctttttcccaaagagaagacaatttccaaataagatagtgtccataatgctttgtaactagtgggtgcctcttacgctatcagcaaacttagttccagttcaccctcctcaccttccacccagagactttagggcatgttgctgggggtcaaccttggaagatctctgcatttgaagcaatctactgtctccctgggatgggccgctttctcctttgagtggccgtaacccagcccagagctgctttcgcagaggcaatcaagctatggaaagccctgctcattttgtgttttcagggttgcctttgtttatctctaattcttaagggaaaatgcttctgtaggctcaatgagaccgagtggaaaccatagccaagtcctacagcttttgtagtttctgtgctggggagactacagatctatttggaaaaatagaaactgcattagatcaagctataactttaatatttatgaaaaagctctaattgttgactctctgcagctgaattctacattaaaccctgtagacagggtttataaaatatacatgtacaagttcatataataaggattatttgataatggtaaaaaattaaatgagtattcaaatataaacataaaaatatggcattttctcttctactctaatcctacagtgctatagtaattttttttccttctgaaacctttatggaaaccctaattaacgtaagtcaactgttcaacatctaatattgttgaaaaccttaagtaggaataaaattaagcatttatatttaagtacagttgatactttaaaaaattcttacataaaatctttaattatgatttgctttgtgtatactggcttctgcgatcataaaagaaattacttaactttgccatctctaaaagaaaagtccagagttggcattgtttccagcttatttttcaagacaacaaaaaagtaattttggaaaataagttattttagaaaataaaatataacattttttagaacctggagttctccaaatagtttgttctttcgagaatatgattgagctttctttgccactcaggttcaaagcactgggaagaagtgaaaacaattcaattattggatgcacatttttgaaagggccttacattgctaaattcaggagttgccataattctatgtcatgttgcaagcaagctaaacatcaagagaggtgttgtaaccagctaataattataaataatgtgtgaatactgtcttttttttctgattcctgtgagaaatcagaaggaacaattgcaaggaaatatgaaatcatgttcttcaaatccttcgactctgaaacacagataagaggactgctgacatgtagggaccaatagaatgacagctcgttgcatacaaagataaaaaagacagtgagtgactttggagttgtgttgccttctgcagccgagagaatttggacccaactgtcaaatgactattttttttagaggagtgtaaatggtgagtgtgtacggtgagctagtggtatggttcagaaggaatctgcagatgagctagtggtatggttcagaaggaatctgagcgctaataaacacccactttcccagtaagaaatgtagtgtgctgtgtattagaaagcttcatagactccagaaaaattcaaagaactaaacatgaatcctcctgtcagtaagtccaaggaaacctagactatttcatgcagaaatagcacatttataccgagtatcacttatcacttacagattatgttctcattcattgtcttgtttttaatcttcaaaacaatcttgaaaagaaaatccttgagagttgaaagaaatttaagtgacttggtaaattcatatggaagatggtaaaacattattgtcaatgtgctgcgtcttgcttaatgaatttcctcaaagttagagacagtgtctataatacttgtccttttaagctaagatcataaaatcaaccagtaagatgataaaatatgtagcaatgtatctaaatttatcaagctctgtaaaaccctaggatcaagcagtagcttggagaggtcagaaagctcctgagcttgcaccttcttaagaagaggagaggggaggggaggggaggaagggaaagaagagaggagaggagaggggaggggaagggagtggaggggacgggaggaagagagaaaagagaggagaggaaaggagaggctttagcatgaagcctctggatgctcagattctgctgggaattttggcagcgttatggaaggtccatcacaatcttgaagagaggctttcactatataccaagcatggcttagtctgaactggttcatctggacccaactctagccaactctagtgtgtctcatggtctggtgtgggccgagggcctccaggcctccagagccagccctgtccacaatttggtaatattccattgtttccttacagagctcaagattgcaaaccccaaggtgagaaatggaaaaaagtaatgggacctttaagctctgacgttctatgttcctacagcataagctggtggcttctgcgggtctctgcagccacctcagggcctttctgctcttctcaagagcaagagaagcagaacttcttctcttgcactggaaatacctgtggggtgtgtgtgtgtaagatggacattgagtgaagggacatgagcttcttgaatatcatgttttacgcaaacaaatgtttctgtttttttttttttttttttttttttttgagacggagtcttgctctgtcacccaggctggagtgcagtggcgcgatcttggctcactgtaacctccgcctcctgggttcaagcgattctcctgcctcagcctcctgagtagctgggactacaggcgtgcaccaccaaacccagctaagttttgtatttttagtagagacggggtttcaccatgttggccaggatggtctcgaactcctgacctcaggtgatccgtccaccttggcctcccaaagtgctgggattacaggcttgagccaccgctcccagcccacaaacaaatgtttagcattaagtattgtgtattaattaaaagactaagtctttttcataatagcttagagctcaatagaaaatacaagcaagaaatgatgagtacattcgtggttgcttatggctagaagagggaggagggatagagtgtgactcccaatgggtatgagatttttttttttctttcctgtcttttctttttgaaacaggatcttgctctgtcatgcaggttgaagtgtgtggtgcgaccatgactcagtgcagcctccacctattgggatcaagtgatcttcccatcaggcctttcaagtagctgggactgcagtgcacaccactatgcccagctaattatttactgattttttttttttgtagagatagtctcactatgttgcccaggctggtcttgaactcctgggatcaagcgatcttcccaccttggcctcccaaagtgctgggattacaggtgtgagtcactgcaaccagtctgggtatgatattacttttggcaaatatgaaaatgttctaaaattaggtaatggatgcacaactctgtgtactaaaaactcttgtttcccactttaagctagttgttgtgctttgtgatatgtaaagttcatctcaataaagctgttttaaacagaaagatgataaggacttcttttttttttctgaagcaagccagggtaaggtatttacaaattatgctgttctctttatctctgcaatgacttttaaatcttgtccattcttttcatccattatgtctgtgtcatagtttgaaccctcatccagttttggtccaatacagatggtccccgagttatgatgtttcaaagtatgattttttgaccttatgatgatgagaaggtgatacattttaagtagaaacggtacttccagtacccacacaacctttctgtttttcaccttcagtgtaatgttaaataaattacaggagatattcagcacttcatcataacataggctttgtgttacctgattttgtccagcggtaggctaatgtgagtgttctgagcatgtttaaggcaggctaggctaaggtatgatgtggtaggttagtgtatgaaatgaattttgaacttagtgatattttcaagttatgtgatggatttatcaggatgtaaccccgttgtaagtcgaagagtgtctgtagttacacagaaataataatatgtggttttggttggtttctagttgtaagttgtaaggccttttatgcagactgctgcatttgactttaacatggttttcttacccccgttctttctcaggctttcctaaagcacagttctgatcatgttatattcttactgaacacttcacatggttcaacattgtctacaggatgaaatgcaaactttttaacttgatctatgattctgtcttttttgtcttatttttcacatcatgatcttactaagccacaattcatttttggcatacaaaacatcctggcgttgacttaaagtatactccacttttccacttctctgctttttgcccttctcctaaattcaagctgtcaacatttcacccattcagctcaaatgcttcctcctacatagtcttcaatcgcacgcagcagaattacagccttgaaaattacaaacttctttgtattttaattacttgtctatgtgcttgcctttctactctgcctatctattcaaattattgttcagttgaattttcaaattaatattgtattgtaagcctctttatttgtaattatagagaaaatagattcttatagaaatgatgaagagcaaaattccatcagagccaatacggaccttcggtctacagggaagaataagtaacagatttccctcgcccagcacaagatcgatggctgagaccccaacaacagaagacagactaacaacagaaaaacatagaaacttatttaatataaattttacatgacacacgagccttcagaaatgatgcaaataaacagggagtctgtattttttggacggttgtgcaaaattggactggaggacaaagggaatggtctaatggaaatagacaggggaggctgttcacattcctcttggtgtcctcatgtcacgtgctttcctcccagatgtaggacaagccaggatgctctcccaggaggctcttcaggagagaggggagggagaaggtcagagagtcaccttcccaggtttcatggctgctgcagggagaaagggcgaggggaaggtgagcaaggccttcctgcttctgttgttttctcaaacgcccaggcaccatgttttggggtggcatgtcctgaacctggtctggcctcacctcactataggctcctgtttcttttcttttttttttttctgtttccgcctccctccctctaaacattctaatttaccccaagctctcttccccagaactctcgtgtctgacagagctcgaattctgtcaaccaggctggtcagctccagactctgactaatgaaatgcacttgttattaacttatctccttcaggagcaactctcaatccatgactgaattgtacagatggaacacaggagggtgagatgtctccttgctggaaactgcacagtgtgaaggctctcgggaattgctttatggaatcagactccttcgttccttcgtgtacacctcctagatgcatttttacagaatcagactccttcatgtacacttcctaggtgcattttcctggagctcatctggagtccaggcctcagcttctgttgtacaatgagggatgataatggcagatacttagatacttttgagaaggccacctgagacgtgattgccaaaagcaagtgaggatgactgaatgagagaacggtgaatagcagttattttaaaatttatttttaacatccctacatttattgcaactgattcttgtaggaccacaaaatgtgaaacggatttcaaaccctagcagtgcacaggaatcatcctgtaaagcctttaaaagtacagatctggccgggcgcggtggctcacgcctgtaatcccagcactttgggaggctgaggtgggcggatcatgaggtcaggagatcaagaccatcctggctaacacggtgaaaccccgtctctactaaaaatacaaaaaattagctgggcgtggtgacgggcgcctgtagttccagctactcgggaggctgaggcaggagaattgcttgaacccgggaggtggaggttgcagtgagtggagatcgcaccactgcactccagcctggcagcagagcaagactccatctcaaaggaaaaaataaaagaaaaaaaaagtacagatctttgagtgatcacttttagaaggtccagggctgtgacccgtaagctaatgttttcaaagcttctcaggtaatttagaagtaactggtccttaggttgtcacgtgggaattactgattcttccgtacatatttagtaacatctagagtattctgatccatgagaatattgtctagatttcagagcttctttctgaaatttaccgagaatgaaactctcctgaagataggctttagatctcatcctatgatagtctcacagaaaagaaggtagcttgatggagagtttatggatattctacaacagaccttaatccaggtggtattttattttattttttttaattttttgagatgacgtctcacactgttgccaggctggagtgcagtggctcgaactcggctcacggcaacctccacctcccgggttcaagccattctcctgcttcagcctcctgagtagctgggactacaggtgcctgccaccatgcctggctaatttttgtatttttagtagaggcagggtttcaccatgttagccaggatggtctcgatctcctgacctcatgattcacccacctcagcctccaaagtgctgagattacaggtgtgagccaccgtgcccagccaatccaagtggtatgtcaaatctagcctaaagagctttaaacatttttcatgcatttatttaataaatatatatatatacacacacacacacacacacatttgcatacatgtatatgtctacaaacatatatacatatacacatatacatatataaatgtgtaaatatatacatatacacacacatataaatgtgtgtatatatatttattaaataaatgcatttttcatccacttattaaagatatacacacatatacacatatttgtatatatgtatgtatatatatataaaaatctgcaattttaaaaaacagcacaactggaataaatgtagacatatagtttatagtactttgtaattgtaattaaatactttcttcagaaaattgcattaaaaatttttttatggctgagtgtggtggttcatgtctataattccggcatgctgggaggctgaggttagaggatttcttgagcccaggtgtatgagaccagcctagacaacatagtgaaacccatctctacaaaaatttataaattagcctggcatggtggtgcacacctgtaggcccagctacttggaaggctgaggtgggaggatcacttgagcccaggagatcgaggttgcagtgagctgtggtcacactactgcactccagcctgggcaacagagtgagaacttgtctcaagaaataaacaaaaattatcataatatgaaagtattgataatttaatattcttttgttttttaaatggtaggataataatgtgatttctaacttgccttaccttcgtgtccactgctttaaagacagaactaacatgaggagagaaattagaaaataataaagaaaacgaaattcataaattaaaacatgaagacattatatctgaagggctcttagattgtataagtcaatttttccctagaatatgaaattcttacctatgagaatgaatgttaatgtacttttcaaactaactttcaccttacctttagatgaccttatttcatcagaaaagaagtaaaaaccaattcttactcagaatagtttgaacttacacttaattatcatctatgctgttatttactatagatttcatttaacacagatttttaaatgattattataattggtttcatgggtgagtttattttataatgagtaagagaaagaaaatgtacccctattttatgtcaaatatttttatagtatataatatcttcaaattgtaaatgaatatagagatttaaaaatgttaatagcttctaaggctgggtgcggtggctcatgcctgtaatcccagcactttgggaggccaaggtgggtggatcacaaggtcaggagatcgagaccatcctggccaacatggtgaaaccccgtctctactaaaaatataaaaaattagctgggtttggtggcaggtacctgtagtcccatctacttgggaggctgaggcaggagaatggcgtgaacccaggaggtggaagttgcagtgagctgagatcatgccactgcaatccagcctgggtgacagagggagactccatgtcaaaaacaaaaacaaacaaacaaacaaacaaaagttaatagcttctgaatcattataatttctcaagtgagtaggaatatatttttcttcaaagctcttgcaagattttctgccaatacatgatttagaatttcataatcaatatttattgtttagaaaccctaaaagactgctttcatatttaattttttgtttctgtgattattaaattatttgcctttttaactaaaagaaaaaagacttactcctttttcttctaggtactaccaaaatgcttttctgggaagaacacaatgtacacatccaaactgtaatcagctattttctcttgtgcttgcggcttttcagagctggattatttgacgaagtacatgctgagggctccatcagagcaatagagatagagatgatagagatggagagagatagctacctctgtctaggtgcagatataaatgatgtagatgcagatataaggtgttccatgaaagggccataaatgcaaagtggtcccctcaaatgcaaggaaccgaagaaagaggcggacaaatccagtttgcccataaaggatttattctatttatttgttagagaagttaaagacagaagtgtggtcttgggcaaccacaagacagctagatctctgcactaaaatccccaagacccagaacttacatcatgcggaaaagtatgtgtgttctggaagaatgtgtaggtggctgagagaatgctgtgggcaccacagtctatgagggacacagcaacaccaaggctggttttggaggaaaggcgaaacttacagtaaataggtccttctacaaaaagggtttacatcaactaaatatcttggaggcattccggggctcgagattcatcaggaggcacgtggtggattagcatctaaaatgaagtcactctcgtccctatacagggaataatttgatgcttgatgtcactaaggcacccatcatgagtaagatcagtaatacggaactgacggcattacatttgttctacagagttattaatctagattcaaaatttggataagagacaatatcatcttttctgttcttagagcctctctgagcctaattgggcccgagttgagtgtttccatttcagaaattgtggtgtcagcatgctcaactataaaataaactggttctttatgcttttagtaagtcatacctcttgcaatttactggaaaagtagaaatgcaaagagctccttatgcaacttaatcagaagaacacaaatcagggtcttttaatgaaggtttaagctgagctttgacatgcgaattaggagacaatgcagtaatatctagtatatcttaagttttgatatttgaaagatgattgtgaaataatttttctagtttcattggcatatctactatactctaggcaaggggctggaatcaacaagcaaaaatcaacaagttttgctcttgaccatctcacagacttgtgtttctttatttttttctctatcaagccaagctctatatgaaggcaattttatgatgttgcagattttatgatgttgtgcacttactttaaagaatagcctttacaactcttgagtacactcaattatatttcttatgcccactgaagtttttaagtacctaataaaaaatagtgtatcagaagaggtggcaccgtcaggaatatttcaccagtattaggccaatgaacattagctgtcatgttttcagcattatgtggagagctctgagtcaggtgcacacctccaaaaaacctggtgtgaatatttcagtctcagcaataaaatcacacttcatgtgttacgcataaaggaagatttattaccttcatatcctcttattaatttctttctttcttacatcaggtataattccatacctcagccctttggccttaaagagtaatttaatctattagcccagaaaaccttttaagtcaatccttgacatggaaggaaggcagatatttctttaagggtctggtgtactagaaggtcagtttctgtcacagatcccaggagccgtgcagctaaaaacaaaaccctctggtgctccgtcttttcgccagtacacgcctttaaataagaaacaagacaaaagagacagatcaacgctcatccctgggcttgagcctcaggaaaatggttttaagagaagacgcctgttagcgccagacaaaaggcaattagtgctcattcgggggacatcacgtggtgagggcatgtggactcccttcatccacaagccaagtacgaagggctattgctctgttactaacagggattcatctttaattattcacatttgtatttttttccccagtaggaaaataataatgtttttcatcctttcctgcatatatttattatttttatgtaaattaagagttacactacagagtttctcatgaagaaaaggaaaatacctaaaagatagttacattacaaagaagaaaacacaaatgtagcttcctgaatttttcatgaaaactcacccagaaggcactccatatttcagaaacaaatagcatgggggccttaggacacataaacaatataactgaataaaagaaatttcagaagtcttgtagtcctacaaatatttctctttttggaaaagatttattgaagcaaataaaatgataaaattatgcatgaattgaaaaatatagtgggatggaggaatagaacatttgtgatgattcttgataaagccacacaacataaggtatagaaagtttggtcaccagccaggcctggtggctcacgcttgtaattccagcactttgggaggctgaggtgggcagatcacgagttcaggagtttgagaccagcctggccaacacagtgaaaccgcatctctactaaaaatacagatagtagctgagtgtggtgatgggcacctgtaatcccagctacttcgaaggatgaggcaggagaatcagttaaactcgggaggtggaggttgcagtgaactgagattgcgccattgcactccagcctgggcaacagagaccgtgtctccaaaaaaaaaaaaaaaaaaaaaaaagtttggtcaccatccaagtaaagaaaaaagagaactaaatctaagaaagtggcagttaagtggaaaaggagaaaggttaaaaggaagtcatcgaaaaagagaaacagaataaaactagatgttttaaaggagaaaaaatagacagtggcatcaagaattgcttttaggtttcaagttgcaattcctttaagaagtactgtctgtgaataaatattttcaaagcaaggagaaaaaattaatttagagataagggccatagaaatgataaggtttgttttggttatgctgctcatatcaaaatatttaagtaacagtaatgagcaagtaggtagagatatgagtttggaggttaagaaataggtcctgatagccaggcgtggtggtgggtgcctgtagtcccagctactcgggaggctgaggcaggagaattgcttgaacccgggaggtggaagttgtagtgagcagacattgtgccactgcactccagcctggaccaccgagcaagactctgtctccacaaaaaaagataaaaaaaaaaaaaaaggtggggggaaagaaagagagagaggtcctgagattatgaaaaagaaatgagatctattcacaaactggcagcaccaacaatagagaatgtaagatgttggttgctattgggaactaagtgaggatgatagttgttagagcacattttaaaatatataaccagcatggcagatgtatacatatgtaactaacctgcacattgtgcacgtgtaccctaaaacttaaagtataataataaaaaaaaagaaaaaaaagaaaaatttacctgccctttaaaaaaaaaattacaacactgtctgaaataacagaaaaaaaatatatatatataaactgatgcaagaacttcataaatgataatgtccattcttcttacagaaatagtggaatggtcaaaattaaaactatcatgcagaatcaagggtgagttaggttcaagaaacaagggatgtttaccctggtcagatattgaagtcgatcgaagtgaaggctgagcaaagggttccagactggttattatcaagtatttgtagtgaaagtcactatgcaagaagtgaaagaatgataggattttgggaaagaatcataactactgtttcacaaggtttagtagcaagaagacaagacaaattgaaccttgggagactgccagcgtgaggaaaggctttgtcaggagacagagaaatgaaggcacgtttgtgggcagagcaaatgtaagaagaaaggcagaaatatggacaatgattaattaatgaaataagttttaaagaacagaaaaaaagggttaatatcgaagtccagatagtgagttaagcactaaaataggaaggcaatatgtctgtttttatcttttctttgagacagtaaaaaagaataagaggctggatatacgggatgcctttgtatagagaagatttatacagattatctggggtggtgttgatacacatggtcaaatgaaaaaatggagatttcaaacctgagaaggagaaaatagattaggatataaggagaaggaggaaagtcttttagacgatgaagtcatatcgaatcaggagacacatggtagtagagctacagaaataggactggacagtagggatctggagtggattagtatgagttttcttatccacttttctccagctgtgctaaaataggctgctagcagtgaagaaacaccataatgatcacagagttggggttaattagagtacagggatcgaaagtccaacaggtaagagatttgagagcatcagtgagaagacaattaaataaacttaatatggctctcacaatctaagttaaggagaaaagtgaagccagacagaggttgataaatcagaactataaggccagttcaagggagtagacctcacagtgagaacaaagctcaagttagttgctaataaaggcacagaaaaggtggaaagtaagatctattaaaaaagaaaatcgtaaaattcaaaatcagtaatactgatcaagcgcccattgtgagcaaaagggtaagcttttattgattcagaatgactaagaattgagatatctgatgagttaagaatgttaacttacaattagtgtttcatatataatatgtatataaatatatataatattatacataatattgatgtaatcactcctatagctaattaagtacatgatattttgccaggtcaactgttatgtttattagcaacagtcacgggaatatctgaaatgttggaaatcccctatcccaattcaatattaatgaaagtaacagaaagttacatctttctgttattatatatagttacatctattcttatatctatctttctgtatcaaatatttatctccctatataggtatatttttaatctgtatctttatacataaagtattctgggtaaactgcacagaccttagcatattaaattctcttcttcggccgggcgcggtggcttacacctgtaatcctagcactttgtgggaggccaaggcaggtggatcacttgaggtcaggagttcgagaccagcctggccaacatggtgaaactctgtgctactaaaaatacaaaaattagtcaggtgtgatggtgtgtgcctgtaatcccagctactcaggaggctgaggcacaagaacccgggaggcggaggttgcaataagctgagatcaggccactgcactccagcctgggtgacagagagagactccatctcaaaataaatcaaataaaataaaatctcctctcacacactaccatcttccctaacaggtgtgctaggctctagaagtttgaaagacagaggggtgaattacttctgtattcactcagttgtataaaccatatgtcctcatccattttctactactatacagaatactacaaactggataatttataaagaaaagaaatttatttggcttatgtttctgggggctgagaagtccaagatgatggcactagtatctgcttagcatttgattaaggtgttcttactacctcacacatggcagaagagcaagagagagagagagagtgagagtaagagaacaggaggaggcagaacttcaccttattttcaggaaccaactcccatgatagcccagttctgagataacagcgtcaacacaggcatacctcagagatatttgtggtctggttccacactacctcaataaagtgaatattgcaataaagtgaattacacaaaatttttggtttcccagtacatataaaagttatgtatacactatactgtagtctattaagtattcagtatcattacattaaaaaattagatactttaaaaaaatcctgttagctttatctccagaatatcttccaatctacccacttttctttatgtctatcagtaccgtcatggtctaagccaacagcgtgctttcctcaggctatcaaagtaggcttttaactggctcctcacaggagaccaaaatgaagaaaaagaacaataacaacaacaaaaatagatactttaatttaaaaatattttattggcaaaaaatgttaacagtcatttgaaccttcagcaagtcattttcattttgctggtggaggatcttgccttgatattaacagctgctgactgatcagcatgatggttgctgaaggttaacgtggttgtagcagttcttaaaataagacaacaatgaagctaccacatcaactgattcttctttcacaaaagactgcaccgtattctatgatgctatttgatagcattttactcacagaagaacgtctttcaaaattggagtcaatcctctgaaaccctgtcactgctttatcaactaagtttatgtaattttctaatttccttgttgtcatttcaaccatgtttatagcatcttcaccaggagcagatttcatctcaagaaaccactctctttgctcatccgtaagagtagttctttatctattaaagtgttattatgagattgcagaaattcaatcacatcttcagattccagttctaattctagttctcttgctattctcactacatctgcagtgatttttctccaccgaagtcttaaactcttcaaaaccattcatgacagttggaatgaacttcttccaaactcttgttaatgttgatattttgacttcctcccatgaatcatgaatgttcttaattgtatctagaatggtaaatccttctgagattttcaatttactttgcccagatccatcagaggaatgatccatcactatctatgggagatatcgccctacaaaatgcatttcttaataggacttgaaatttaaaactactccttgatccatgcactgcagaatggatcaagaatggctgcagaatggatgttgtattagcaggcatgaaaaccacatttatctccttgtacatctccatcagagctcttgggtaactaggtacattgttgatgagcagcaatattttgaagcacttttttttttaagcagtaggtctaaatggtgggcttaaaatattcagtaaactatgctataaatagatgtgccatcttgcagggtttgttactgtattcctagagcacaggtagggtagatttaatgtactttttaagggacctaaggttttcagaatgctaaacgagcactggcttcaacttacagtcattagttgtattggctcttaacaagcgagtcaacttgtcctttgaagctttgaaaccaggcattgactgctcttgctgtgaaagttctagatggcattttcttccaatagaaggctgctttgtctccagtgaaaatctgttgtttagtgtagccaccttcattaattatcttagttagaccttctggataacttgttgcagtttctccatcgacactgctactgcactttgcacttttatgttatggagacggtgtctttccttaaactgcatgaaccatcctctgctagctttcaacctttcttcttcagcttcttcacctctctcagccttcgcagaattgaaaagagtagtgccttgtgctgaattaggatttggtttaagggaatattgtagctggtttggttttctttcacgaccactcaaactttctccatatcagcaataaggctgttttgctttcttatcatttgtgtactcattggaaaagatttccatcagaagctttttgtttacagtcacagtttagctaactgcttgacataagaggcctagctttcagcctatctcagcccttatcatgccttcctcactaagcttaatcatttctagactaaaaacacttagtcacttgaaaagttagaggccattgtaaggttattaattggtctaatttcaatattgttgtgtcttaggtagtaggaaggcctgaggagaaggacagagatggggaaatagttaaatagttgtttgatgaagccgtcagtacacatacaacacttaataagttcagtgtcttatatgagcacaattcatggtgccccagaacaattgcaatagtaacatcaaagatcactcatcacagatcaccacaacagatataaaataaaaagtctgaaatattgcaagaattagcaacatgtgacccagagacagattaagcacatgctgttggaaaagcggtactgatatatttacttaatgcaggggtgccaccactttcaatttctaaaaaatgaattatctcaaaagctcaataaagcaaaatgcaataaaacgaggtatgcacatcctaatcacatcctaaaggcctcacctcttaatactgtcgtaatggcaattatgtttccaactgataaactttggaggaggcacattcacatcgtagcaccatataaatgaatgcaaagcaaaatgggcccaagtaggttgttgaaaaactaatgggtagaagggtcttggatgctcacattaattggaggaaaatgaaaaagagacagtaggataatcaatggcaataagatttcttgccatggaaaggtctaaactagatatgaatgaaaatccagctaaatgcaaagatcaggatcggtcttttcccttttttcccaaatatacactatgttattttctactttatgtctttggtacacaaagtgaaatatggcatgggttgccaaattttgcaaagtaaataatacatagaattcagaccctactggataaatacattctatttttaatgattcagaagggccctcatgaggatgattatttttatttgtttatttacttatttattttttgtgacagagtttcgctcttttgcccaggctggagtgcagtggcacaatctcggctcactgcaacctctaccttctggtttcaagctgttctcctgcctcagcctcccgagtagctgggattacaggcgcccgccaccatgcccggctaatttttgtatttttagtagagacggggtttcaccatgttggccaggctagtttcaaactcctgacctcgtgatctacccacctcagcctcccaaagtgctgagattgcagatgcgagccaccatgcctggccatgatgatgatgatagattccttctcagcaatccagaggaattaaatctagtctatcttaatccatgtttatcaacctgtattgtgtaattcaattaggcacttaacattagaaacttataaaaacaaaagtagcataatactcagctgtgttaagaaaaatgtgatatcaactactcctcctttattacagtgactcagaacacccgtgtccttcccaacattggatgcaatgctaaagacatgatgttgctcctgctggaccacaccttgaaggaattgcctaccccacctcacctccaaaattaaagtctttcgttttgacaaaagttaa

SEQ ID NO: 1516 - DNA, 251656 bp, Homo sapiens
ttctacgtgatttttctcctttaatggcactcctgacagatgaggaaacaagctcagagcaattaagcgacttcccaaggtacagagctgctgcttggtaagaagcagagacttgcaactcctgggcccaggttcctgccctggagcctgttcctggatgccctgggctgagccctgcacgtcagcagagcccatcacccaaccactcacctgaccccccggccacagggctgtgcccagtctacacagacacacagcagaaagaggatggccttcaggtttccatttaatggccaagccagcactgccaagatgtcctcctgcctgagaagcccacccacgctggcacccctcagcctcactagcggcatcccagtccagtcctggtgtggggcctcatctcagctccttcagcaagctgttgacagagcccagcagctcctggaagtagccctcgtcctcaccatcctgcagctccaggctggccagcacctggtactcagcctgcaggctggccagtgtcctgccgagctgggggtcctgacggtagcggtcccggcaggtggtcaggaggacgcccagtgtctgcagcaccttctcacgggcatcatgctcgggcagcgccaggaggtgggccgtgatctcgcaccagccctgttcccacaggcctggcaggaggtgtacctggcgatactgctgcagcttctctggggacatctcctgggtcagctcagcctcctcctcggcgaacatctgccatccgccacagccgcaggccaggtagggtgggggtggggagagaacacacagggagcagttagctcacacctggctagctctgcccttcagacaggaaggcacgaggctgacccctgagggcccacctcttcctctatccccaagtctgtctgtctattcattcattcatccaccaacagaaacacttgtgtggtgccaggtgctgaagaaaccacgatggagacatagtcttaccctcaaggagcttaaggtctagcaggagaataaaaattaactaattcccaaatagcataaatgtaatctaacagtgcagcatggaggcagacaggctggcttcaaattcctgctccaccactgacttgctgaatgaccatggctggcacttagcctccctgagactcatcgtcatcacctcctaagtggagaaactcagcctgtctgtaaagcgcagaagcccagctctatcagcagaacatggtgggagccaatcctgccgggctaccagcagcgggaaagccaacacctgaaccatgacaagcaggcaggttacctgaaggtcagaggtagagggttgggagggggcagagatctcccgtgcagctgtaggaagtgtgcctgtatggagaaagaaggaatgcctgccctaactccaggggagaatgaagcacagggaagatgcacaaggcaagagggaagcccaggagaagaggaggccacagtggaccacctgtgcttcctgcggcagcaggaagtcgtggggctgattggggctggcagaggaaactgaggaggggtgcaatcctgcatcctgggacaggagaggctgagaggtatcccctagtcctttcctacttcacccctcagtcctgccagcttcgcttccaaaacacaccccaattctgtcagctccacctttgtcccttgtgtcctgcgatccagtgcctcctgctctcaccctctcctccagcccccaaaccctcacagcctggcattgcgggtgataaagacaaaatcaatcccttccctgggactgcgaggctctgcaggctctgcccccactgtgcgcggcctggacccactcacacccactcctgtcactctaactctcccctggggcctctggaggcgcagctccgacttccaggtgcacccccgcattggccccattcactccacggctccctgcacacctcaccgccactgaccggcctcccctgactggccttctctgcttatatgctgctgtggtttgagtgtgttccctaaaagttcaagtgttggaagcttaattcccaaggcagcagtattgagaggagctgcctaggtcaggagggcagcgggttccttacgggagagcggttgttattctagagagcaagcccggcccagcatgcttttttccgcaagtgctcttgccctctcaccttccacaatgttgtcatgcaacacaaaggctcccgccagatgcacccacccaatcgtggatttcccagcctcccgaatcatgagccaaaaactgccttttctttatattatccagtcccgggtattctgttaaagcagcagcagacagactacaacacaagctcaggggaattctctgataaacatctgcctgaaagctcagggacgacagggactgcggattattttcccagcacccggcacagcaggcagcacaggcaggcagggtccccctgcggcccttcagctcctcagatgcaccagaggccatggaatccaaaccccaggcaggcatctcaccactgcagaagcccagatgtcagggcatggtctctcagtagaggtcctctcacaggccaaggtacatatgaggactgcctggggcctggcagaccccagcaccctgatgggggtgtcacattgcccatgggaattccacagtccttggctgtcatgacaacatgctgcagtgatccccgagctgcatggcacccctccatcgtggtggacagctcatgtccctccaccttcaggcagctctggacccacccctagcttggctaggtcttcattcttaagcgctgcaagaggctggacttagtgactcacgcctataattccaatactttgggaagctgaggcaggactgcttgagcccaggagttcaagaccagcctgagcaacatagtgagaccctgtctacaaaaaacgaacaaaattaaccaggcatggtggcatggacctgtagtcccagctactcagggggctgaggtgggaggatcacttgagtctgggaggcagagtttacagtgagccaagatcgtgccactgggtgacagagagagaccctgtctcaaaaaaaaaaaaaaaaaagaaaaaagaaaagaaaagaaaaaagaaaaaagaaatcacaagaacagagaagccctgactgcctcagcccaagtacagtgtgtcctaaatctctctggctgaaatttatctgctgtcctccctgaaagaagagggccatttctgtactgtttgtagagagatgccagtcctcccctccccaatcatgtcagcaccccaaagcttccagaggcaggctcccggggccggcagcctcggggcagccttggtgagcctgcctggtggtagtgtgctagcaatgtgtcagtgccatagtgcccaggatgccagggctgggggcagcagggacacacacccaagacaccagagaacagagcccagtttccctgggaaatgcccagccagctgacatgtccttctccaggctcactggcccagtcccagaacctgaactgtgcccaggccttatcaattggatctgagcaccacatggctgcctgctgttctaagaaactggatttctgcagctttaacaagagaagagagagaaacaggcaaagacagagagttggggagagacagtgatggacagaggtggccacagccatcccgacactgcctgggagagaaggcctgggggaggcgtgtgcagagggagtgaggggcccagcctccaccattcggcagcagttccagcggctgcccagccctgctccactagtcggcatgcggctcttctggggagcgtgtggcccgagagaggcaactgaggaagccctgccaatgctctctgcagtagctgaattaagaatccaggcctggctggttttcctctctcctccttaattaagatgcttcttcaagcttgcaaacagggctgggcaccaagtctcctcccaagtggcaagcaattgggtccctgagactctcaagggcagccactctgaggccctgcccagagccaaagctcacagaggaggcacctccacgtttctagaatccgaagagtgagtgccattcgaaggagctctgggctgttctaccccctcagccttttgtcccctcggggcctggtctcggctgctccaaggcttgcctcatactgagccctctgcctgcacacttggccgtgaccatggctggcagggccacctcccactcctcatcagccctcaggtttcagcttagccaccacatctcacatgacatactccctgacgtccccaatctcttccaactgtctgtctgtccatccatccagaagcacacacaaagcaaacaagtgacgtccgcagtctcttccatctgtctgtccatccacccagaagcacacacaaagcaaacaagaggagactgggtgggcctgggcactcaccttctccgtgaccaggtcgtagagcagtgtgaccacgcgcacggcgagcacctccgtgcccttctcctgcaccagggtcctcaggacctgcagccccccgagcttcaggaactgccgctgggcataggggaagtggcgcagcagggagcacagtgcaaacaggacctgggggcacagacccaggggtaggtgaggggccaagcgagctggacctgccctgaggcccagggaaggcaggcagaggtgccccaaattagtccccattcctcccggccccacctcagttacagctataccccagaacccaggactgtgaggccaggagggactcagacaccttcaacattaccaagtgagtaaatgggaggtaaacagaggccaagggtgggaggccaggagtagggcccaaggccacagcacaggagctgcccccaggcctctagtcacctcggcacactgccatctgctttagttgagtgtaacttctccccctgtgccacccagcagatgatgctcaggcccccatggtaacatgcacagcctggacaggaaccctttcctttcaggccccacacgtgtcctggaggctgggcaggaggaagggcatggaaacacaccttcttctttgcagtgagcggctgctccgtggccaggatgaccagcagcttctgcagggctcccccttcgatggcctccacctggaccttggggttgctggggaagaagcacaggacagcatgactaccctgcccagcccagggatcggatggtcagggaactgagcccatgtcagccatccctggggagaaacaagaacaacagaggttcccacacggggcaagtcaaactcagctggggaaacaaagaccatctggcacagacccacgtgggaacagcggcccacagcacaggtgacagggctgagtgctcccatgccagcccccactccccagcagccaaggggctggagtgggctgggaaggtgaacaacctctactactgtaaagacatttcgatgccgaaggtgctccttcagcgtccctcccgtaggaagcctttcttggcgcttcccaagccagtgccggatgttccttcctccatgacccaagcacatcacacactggggcaattactaatgggtctgttcccctctgggtctggtgccccaaggccagggccccatccctctcctctcctgggtcggcactcagactgcacatagaaaatgcttgcgggagaaggcaggaagaaagtgcaagagacaggagcctctgaatacccaggcagatcctaaaacaggacaacccaatgcctcccactgggctcccactctataacagcagctactgtcagcttctctgccctgtattctcagcactcagcacagagcctgccacgtcacaggtccctggacagtagggaatgaatgaacgactgaacgaacgaacgaatgaacaacacgtgtacacaaccatgaacatatcaatagataaacatactgcactaaagtactcaaaaccctgagctgcctctggaactcctctccccattctgggctagagaaatagtgatgtgattaaaacatttcaggcccagacctcccagatgaagggatgaggggcctggcggggacccccatcagggcagggtgccatgcaggggacaaggccgggatccctcacaggatgcccttttgcaggctccttgcttttcaagattgcattagggatcaattaaggagcaagtgtcaagcacagggaccagatagtcaggcccttgggcaggtcagggctcccctctcagcagcccacatgtgaggccccagagaaaagaggggacaggcacacaaaagcctgaggccaacaacaagtgaaggggccaagccagcagtcagatggtggctgtcacacccatccaactagcccacaaaggacaccgcagtctaccaaagccaccgcatgcctctggctgcctgcccttggcatgaccacaagctcccagagacccaaaaagcacctgttcctcctaactcccaaccctcctggccagggggccctcacggtgtccttgagagtgagccagggtataaggaaacaaagacaaatcagaaggagctggctcctggtcctaaacccagaaaagacacactgtgccaccgtacaggagagggcccgacacacagcaggcgtgcccccaaagctggctgaatggaatgaagatagctccccacttctattctgaccaggaacaagcttcaaggtccagagcagaccgagcacgctgagccagctttctaaagagaaaagctcctttgtaccacgtgtcactctgtagcctctcagccagaaaggaagtacagggtgggtgccagcccgtcccacagcaactccacccctgtgtctgcagagcagcctggagatgggccagagtccctggggaagggaggctgacagctcctctccagataggcaggcaggcgctggcgcaggggggcctgggagctgagctgctcccctgccccccacgacttgagacaggcagctgtttcatcaaagcatgagctaattagggctgtctctgccatcatgtgcctaaggaacgctcacccatgacaggagggtccaggaagagaagacgaccacgctgagagattcacacaaacatcaaatgctgcttccccaagggggctgagagatctgacatcgcatcagcctttgggagcactgccaaggagtcccatccctcatgggccctcagagcagcagagacaaggccctccaaagacagcacaaagctcatcacagcaccccatcatcgcagcctcagttaatcacccagggctgggcaaccaaagcccttccactttctgcactgtgaccagggcaaagagaagtcccttctcttcagaaggtgggctgatgtgggtcgggagccacccacagccaagccagcagcagcccagtcccacccactctgtccccctcaggcaggctcttcccaccccatttagagtaggagagaagagagctccaacatcagataagtaaatcggagagaaaagagaaagtctgaccttttgtaaattgctgaaatcaggttcataaggcaataaattcatgttttcacccacagccaagtctgtgggtacggcaggaccatgggccaaacatgggctgtgacagtgcacagccttggcagccctgggcccatgccctgcctggcctcttcacatgatcagcttaaacgaggtacccatggaaccctgggaactccaggccttaccccagggttcccacagcttcaggagtttcctaaaaggccaccctgtgaagtggccttttagggctgcccaggcaaggggttgaagaaacacagcagaggaagagggggaagatgaggcttgcgcttccagctgctcctcagtccatccaggcagggccagtagagctgaaggtttcctgagcaatcacccaccaagggtagaatctgctcctagaaacagaccctctcgccagtcagctctgccttgggctttaaatgctcacagcctggggctgggggaggcaactaccaaaacagctcagagtgaggcctctggatgtgcaaggaccagggcctgcaggacccttgctgggaatctcataagcaatgaatggctcatggccttgggcaagttttcacctgtgaggcagagctaggactacccatgtaaaagacagaacagttaatgaatgccaaaatgccacactgctagccaatgcactgtggccaaaagataattacagtaggctcactacacaaagaggccagaccacatctttgagagcacagctttatttggcctggatgcctcgagcacatatcatgtatggcagccccatcctcctccagcctatggactctggaccagagctgcggcccacccctggagggaccagtcctgctggctggaaggtaggtgtcctgacagttggggatctgagttaagggggcgggggcctggcacgcctcaaagtgacatcagtggcgctggtgtgctcaaagtcaacagaaggatattaaggacgtagctcatctccgatgcgataaatgagaataaaccttgttcagggctaagccggctggactaaataaataccattagcacttggattactgggatgttcacaatcagcaggcaagtcagctgtctgtgtgcagagggacgacagcagctgctactctgtaaatcttgcagggagatgggctgggggtggggcaggctgcaaaaatggaagtgattgcatttgcaaaaaccaaagagtttgggtcagggtgacagcaatttgggcaatcagccaagagtcagaggtcatattttagctaactgaagctaagcaagtgtctgggtggaaggggactgaaggagctgaccacagggaaggcagcccagctcggccagggggcccaggagattgctgcccagcacacaccccggggctgacttcacccttgggctcagggctggctacataattttcaggcccaagtgcaacatgaaaacgtagggccttttgttcaagaattatcagaaatttcaagacagtgagaacagagcatgaagccaagcacgggcccttttgagtgtggggtcctgtgccgctgcacgggtggcagggccaacaaggtatgtgcacggaaatcctgctccagggtcaaccaaccggaacaacaagggctgaaaagtaagcttgaatttctgaaaaggaaaacaactggaaaaggcagagctctaggatgggaataaggatgagggtgactagttagatgggggccaaggaaatgctaaggtgtaactgaagagagcttctgtgattgagactgccaggccagaccaggacaccagaggcacagcagagggatgtgctcactcacgcgtcctcgtgacatttctaagtgcaacaaatactcttttcattcccttagaacaggaaaaaactattatttttcttctgaaatgcctctgagatgatgccatgcactgagggcagagggcacatctcaggggtatatggggccaggctcaatcattcacctgatgaagtgcagctcaccttcttgcccagaaagaaagatttcctctggtggccccaccttgcttatgccttaatgtgtggcctccatcatctgggaaagcaagaatttgcaggatgtgtaatcctgaaatagatgggttcaagagacatctatatttgcctgccatccagggatgagtggggctaggtaatcaatcagttaagatacaaacaattggctgggcgcagtggctcacgcctgtaatcccagcactttgggaggctgaggcgggcagatcacttgaaatcaggagtccaagactagtctggccaacatggtgaaaccccgtctctattaaaaatacaagagttagctggtgtggtgtcaggcacctgtaatctcagctactcgggaggctaaggcaggagaatcgcttgaacccaggaggtagaggtttcagtgagctgagatcacgccactgcactccagcctgggcaacagagcaagactctatcttaaaaaaaaaaaaaagatacaattaccgaattgaataaaaatggaataggtttaacaacaacaacaacaaaaaacaaaaaacaaaacaaaaaaaacactgtacaaatcttccactacaaagtcaagcttccaggaataacaaaacacatgagctgcacatcactttgtgttgggacctgtatggcctcaggagttccatctggacactggggaaaggcagggctatcatctgaccccttcatgtacagcccccaactggaagccacccacgtaagcaactatgagacacccactcctcaccacagtaacagcaactcacaagagggtctctagaccctactgacagacacacacacaatacacacacacagacacaatcatctgcccacctctgaggagataaagggaacctcagagggaggggcagcaaatcaccttcctgagggtcatctggtagctctccaacacagccctgtgtcacaatcacctgggcagtttatttcctgaaaccatttcagactagtgctttaaaaaattacagaaaataggccaggtgtggtggctcatgcctgtaatcccagcactttgacaggctaaggtgggaggactgcttgagtccaggagtttgaaactagcctggacaaggtggtaaaatccccgtctctgcaaaagtaaaaaaaaaaaaaaaaaaaaattgccgggcatggtggtatgcacctatggtcccagctactcgggaggctgaggtaggaggatcacttgagcccaggaggctgaggctgcagtgagctatgggcaacagagtgagattctgtctctctaaagaaaaaaaaattatagaaaagtaattacacaaaaaaatgacttactggaaagctgcaagaatagtaaataaactcccatccagattcaccaattgtggacatttaccacaattttctgtctctcttaatatttacacagattttcttttttaaaatatttgagagtaattgaagatatgaagaccctttacccctaaacatatcagtgtgtatgtcccaagaacataaccaaagtacagtgatcaaaatcaggaaactaacactgacacagtaatctacagatatttattcagcttttgccagctgtcccaataatagtccttaccccccactctttcctctttttaagaaacacttttttttttttttttgtagatgggggttctcacgatattgcccaggctggtcttgaactcctcctagcttcaagcaatcctcccgccctggcctcctaaaacgttgggattaccggcatgagccactgcacagagccctctcaataatattgtttttagaaaaataattttgaccccacgtccgatttatgcccatacgatgtacacagcagcctgtctccttggtctcctttcatctggaactgtcccttagtcttgtctttcatgacactgacatttatgaaaagtgcaggccagtggtagaatgtttctcagtttggatttgtccaatgtgttctaatgattagactgaggctgtggctttggcaggaatacacaaacacaatgccgtatctttctcagtgtatcacataggagggcaagtgatgtccataagtctcacaattggatgttttctttgcatacttggttatggtggtatctgccagatttctccactataaaaatactatttgttcctctgaaattaatattttgtggggagacactttgagatatgaagacagcctattcctcatcaaactttcatgtagtcgttttggcaatcattgacaattcttgcttaattatcccaggttaagcatcttaagtccaaaaatctaaaatccaaaatgctctaaaatctgaaactttttgggcatcaacatgatgctcaaaggaaatgttcattggagcactttggattttggatttttggatcagggatgctcaagtggtaagtatataatgcaaatattccaaaagccaaaaaaaaaaaagaaaatccaaaacatttctagtctcaagcatctcagataagggatgttcaacctgtaccatgatgtttgtcaaatgatgatattcaaactcctgtctttatttttcttgtttctatctttatttgctggcattctacctaaaagaagaggttttccttctttcctatttcttcattcattcatttactggtatcagtatggattaatagattcttatttaatctatggaatggcatccatttctatcatttacttcaatgctcaaattatccttaatcaccaggcattttcatgctggcttctgtgtctttttaacatgtttccatcaccctttaatattttcttaccttctggcacaggatgttcttgtacaagatattgctcttttcccgtgccagccatggaatcagccatttctccaaggaacaattggagccctttttgaaaatacagactccaagccctaccctgcatatactaaatcataatctcagagaacgtggctccgaagacctgatttttcataaatgccacatgtgattcctacgttctgaggacaagcatttgggataactagagtcaatgctcaaccttttatccagtatagcatctctggtaattggcagcccagtacttgaagactacatcatcaaacaaggcagctttacgctagtttaaaactcctccaattgccagaaaaacatattctgatactgagctgaaatctgctctcatgaagcttataccctctggtcctataccctctggtcctaagtctacccttgaagaaagaaagggttgcctgatcttgtcctgacaggtcagcccttctgaaagttgggagcagccaaccatccagagaaagctcccctctcacaacgtggcctcacgggattctgcagtcattctcagggtgactcttgaaactctccactttcctgacaatgctctatgggaccctgttccacttactgatgaatccctacagtggtggtgcccaaacctaccctcagggatccaggctggacaaccccccacccacagtccaatgggcctggctgcctctgccccagggccactctgcccctaatgcctcaatctctagatttttgttagtagcctcacagagcttacagtggcctgcctaggtcaaatccctaaaggctgctcacatgatcttctgatgagccagggggtccccaacatggctctgaagccaagcacagggcttcgattttattcttactaaagaataaatattgtcaggaggcaaaaagcaaattacaaatggtatgggtgatatgacaccatatatttatttctgggtggtgaatttttgttttaaacaaggaatctgaattacttataaattagaagtttaataacaataaaatttaacatgccacttggctacctagacccttcctcctagcctgtcactattcttttggattctcactgtcatgtatcttacatggttatctcttcctgatccgtgccatctgttcccacatcttcacatgagaaccagaatgcaggttagacagacagagtctgccacaagctctttggcacatcactacagtgaaggctctgttgacattgaaccacttgaaccatttctaaataaacattgattaagtctgattgttcaagctgctacaaatctacgtcttttttttttttttttttttttgattcagagtctcacctcactctgtcacccaggctggagtgcagtggcgcaatctaagctcactgcaacctccacctcccagaactcaagcttaattctcatgcctcagcctaccacgtagctgggactacagacacacaccacaacactaaccaccatgcccagttttgttttgtttttgtttttgtttttgtatttttagtggagagaaggttttgccatgttggccaggctggtctcgaactcctggcctcaagtgatctgccagccttgacctcccaagtgctgggattacaggcgtgagccacggcactcggcctcaaatctacgtctttattatcatttctctatctgatctattagattattatgagattctgtcaaatgatttcctgaaacgcagacttcctctgtgtctattataccggcctaatctgccagcctggcaaatcttatgaaaaagaaaattagagttgggaggaacttgagacagtcttctggggtactgataatgttacatttctggatctgggtggtggttacatgggtgtctccactttcaataattcatcaagtagaatgtgttaaacttttctatatggagggatgggggagggaggacttaagcattaaactagtccagcaagacctggttttatggaacccacactaactctaagaaatgacctcttttctttaaaaatactcttaagtcacatctcaaaaacttgctctgttattttgaaaaccagaacagttgcccattgtgtctccttgcccctctcccaatccccataatgccataaagatttctgcacacagtttgatgatgatgtccctaagtttctgtctggcatttaatttttcagaccctgtctaatttggagaagccagtggttcatttacactttttgtacactcctggtctcaagttccacttaactctatgtttgttttactttctgcaggaaggccattctccttgagagagaaggcagaggcaaacagaataagcagtaaggacagagatgccctctatggcatctgctaaatcacctgattgaaccaggtggcctaaagccttccttgccatccctctcactctcaacagtagctgcacaggcgcctttgttgttcttagtgtttcccaggtctcacccatctggtgctcctgacactgttctcggaggttgcatccacttctctatttgctcttggttacaggtccctttttcatctctagacaaaatctcagctcgaactgtgccccctgaagccatgtgggtctctttaggtggctccctgttccctgcagtaatcactcgtgactctattaagtacacttcatttttcaaactctaagtcatctttccttttgaagctcctgttcagacatcatatctactttttcctggaccctctgaaatttactttccctaaaactcagaggcagagagttttaccttccccttttagcttctccaaacacagtcactttctgctgatgttctctagactttttttttttttttttttttaccagacagatccttcttgttgctcagaatataatttcagtgaggcccttctccttattgcttccttaacctcctgagagagaaaactgtcagaaaagagaattaagaattaaagcaagtgaagaatttattggtttcttttttttttctagaagatttccaactgcccagataccccgtgcaccacgccagtttgcttctgtgccagttttataatttcaattgagaaagcctcttctacacggagggtaaagagttgacaattacctcagagttgattggttggttagttttttggtgggctaaaagccaatgacctggactttttccatttttttttttttcctcttcaccaaaaagcccaaacccaggaagcaaaacactgagtgctgctctggagtcagagagacctaggtgaaagtccgagattctagtgttttcagctgtgtgactgaggtaagttactaagcctctctgtacctcagtttctgcatttgtaaaacagggattaataacaataatatttatctcatgggattgttgcggggatgaaatgtgattttatatacataaacatacccagagttcctggcaaatgccaagcattaggataacagctgttttatcataatataccatttaacaaaaattattatttttacttttctgctaagacagaatgccagggttttcaggcttctcagaagggagaggagctatctgtgttgggggacaaagaagacctcccactgagtggccttagattcccattctcagctcctctgactggatagacaaagccagtacagaaggaattcatgggggagaaatgtaattaacaagctagagggagagattgggaggaaggatcaaagcagctaattagaactggctaaagggagaccacagggtagggaacatggaagaaagcgggctaaagagaattatctgcagcctctaattattcaaagaatgtccctgagtaattgtctcaggcagtctgagggaggcaaggcaggagtaacaaggttaagcagaagaaaatttaagctaaaacatacgggagatttttcacacactgagatttatcaactttattagagaacacagaggatgttattttaggtcttctatactcagttggtggtataactatccccatgtctggtggctgggggagagcggaggaggccagaccctgcagggcaagaggggatccaaggaaatggcccacacaatccttgctccaagcttataggcaacacaccttgtcaacccgccctttgaggctcaggaaagagcttccttcctcactcagatctgcactccctccaacctccacatcccctcaccctccttgtgttctgtcataaacttgataaacatgataaatctcactgtgtgaaaaatcatctcctcaatcagagccagtggaatcacgcagggcctattttgcgtttgccacacaactgtaggaatgtttatgaatgagccatctcttaatagcaaaagaaaaggcaatgatcgtaggacggtctatagctgaaaatgacaacactgaaatacttcgtttacaggatttggaagtcgtatagactacaaatctctctgctgtgcaacacacataacaagtccccaaaatatcctttgtttgctgaggttttgctcagatatttaaggttctgacagtttaaatatggtgaacaatatggtgaaccatccaaatattttgcatcattggtatttggaaagatctttaagaacaattagttctagttcagagaggcaagtgcagcacccaggctcccggttttccgtgggggcggatcaacatggcctcctcagctagctgcatttcacagggagtctcaggcccccctagcatgggtttcctaggcctggccacttggctcacattgtaacagagaagaaaactgggcagatccgctgactcctcagctaggcgcggggttcaccaggtctcactggaggctgagaaaaatacagagcttcccggaagcaggaacaacactgggaggcctgaccttgctcaaggccctttgacctgactcaccagaccggaatgggaacctaaaggaaagtggagacttcccattctgtggaaatctttaagaactggagaaaagttccaattacttacagcttcaagggacagaatgatggatggctttgtttgcaaacatgctatttgtctgaggctctttgtccagtcagctggttgacaaatactgatcacgcccagtgtgcacagggacctcagttaagaataccagggctagagcaaagaacgaacatagttcctgtctctatcagacaaaattaacagccgacagagacgcgcagagagccactctgagagaagccactgggtgcaagggttgtctgaaaaatggaggagctgagcaggagggcatgctggaggaatgaccttgacaagatcaaaagttattaaaataggaggaggaaagctaaacttctgtatgtactgcccaactgaaggcagatgaaaacctccttttttccccaaaagaaaatgttaagaatcaccttccacagactcttttaactctatttctgataaatcattaaaaggccttctgctggaatcactcaaataccaaagaaaaagttacactcgtaaaatagttaatgtcaaaacgtaaatggtttgtttaagattcagcaattgttgctgaatcaaacacaaaatctctatggcttgaatagcaagggaaacaaaaggcttgacgatttagtgctcgttaaagcctgtctggctgaattttagattgcaacttaaaagaaaaaaacattaaaccagttcaagtgtgaactgacatatgcacagcagttttcagctgcctgcaaatggggcaaggacacagcctggaatgtgacttgcacacgccatggctgagtatggaccaatgtccagggtacaagggcagggcctgagggaacccgacaagaaagcgtggggaagctgagcccaggggcccaccaggggctgagggtgacgctgggaagagggccaatccccattagctctttcctgcagggaggctgggggcttgagaacaatcaaatgctaggcaggggcttccctcttgcctggggaggtggggaagcaacagctttttgctgtccctccccttttctggccttgcttgtcagacacttccatgagccacagtgggactcctgccctttcaaatctcatcacaggcctggtgacccccacaaccctcaaatcgggtgttagaaatagtcctttgtggtaggtttgtggggtgctgagcagaatctttgtctacattctcttgcctactgggatataaacgcttaaaatttcaccatctgggatttacttctttgagtcttaaagacaattctgtctttcagggtcctctattaaaatgccattgtccctgggttgggaggaccctgtataagtagggtgaccacataatttattgtccaaaccgggacacttttgagagtgaaaggggcacaattaattactgcactgggacaagaggcataaacagaacatatggtcactctctgtataaagctttgtgttaagttctatggaagacacaaaggtgaataaagcactttcatggtcctggaacctggaccttgagctgaggggcaggagatcctgggaataggctaactctaggcacccacggagggggataacagcactccagagggaagtgtcatggcagcttagcaaagaccaagggctctggagccacacagatttgactttgaatcctggacttctttctgtacaaccttaagacaggtcaattaacctgcctctcagctcaaggtccaggttccgggaccatgagagtgctttattgacctttatatcttccatagaacttaacacaaagccttatacagagagtgaccatatgttctgtttatgcctcttgtcccagtgcagtaattaactgtgcccctttcactcttaaaagtatcccattttggacaataaattatgtggtcaccctacttatacagatgaggacccagcttcctcatctgtcaaatgagggttacttcatgaggctaccgaggattaaatgagataccaaatgtaacagtacctggcatgtaattttcaacaagttcaatattgctagcataatcaagaccagccttccactcaaacccccgttactgctggaaatgtcccaagtcagaaggtgggggcaaggcaggaagagaaaaccactaaaatggcagacttagtttagcttccctccaaactaatcctccaagggccaccacccagggctgggcagtgaaaggaccaggatcacagtagctcctgaggagtggaccacccggccgccttgctctcctggtgccccttcctcctggtcttaggcttcacacactgacccagcccctcagctactgctccatcctcaactcctggaggcagacaccacccaccaggcttcctcaggccatttccctcggcgggcgggtgtaggggggtggtgactttccaaagtgactgagccctgtcctgatggccgggtaatgctgtctggtgggcactagtacatcttcctgtgcctcttgtgacagaaatgccaaaaacaaacaaaacaaaaaacccgcagcccctcatcgccatgagaggaggggattctggaggccaccatttaatagctctcaagtgcttttcaagcattaaatcatgccatcctcatgacaactcaatgaggcagacaccattactcccattttgctcatcaacaaactgagtcatagaaagctaagtaattttcccaaggtcacatagctaataagtagcagagtcatgaaagctctagaataggagctaagaaaactggattccactggggacacgccgcaaattactagcctaatggccaggaaggaggccttaacttatctcaatttgacttctattatttgtcaagaagctgtgctacttcaccaatggacctgctgtgagtatcgagtgagatagggcaggtgaaatcactgtacaggtgtttactattatgatgccctggcaacatcctccatcgttgtgtttctgagagctggacccagtatggaggaggagaatcctggtaccctgctgttctttcctcccttgggccctgcacactctggctcaaggtaaaggaggaattactctaaagcagtggttttccaagtctgatctctgggccagcagcaccagcagtatctgggagctagttagaaatgcaaattctcaagcgtcaccccagactcacgaaatcagaaccattaggggaggggcctggccatctgcattttaacaaggcttccaggtgcttctgaggcatgcttaattttcagaaccgctaggctagagtatccctggacagataacaacctgggcctctctcaccctggtgggcctgaggcaggacccagcattggccagaagacccaggccgtgagggccactgccccaaagatgaaaagctcccaataaaacccagacctacatggctgcactgatcaaaatacaataaagaagaaagtgagaaatctgacaaaaagaaaacgcagcttcagtgggggtcaaaatacaacaatcttctgtgggagatgagaagcataaaagggacgttagatgttcaaagaaccaaatgtcacaacgacaaaaaatacaagaataaagacaaagtgtggatatcaatgccacatgggcctcagtctaatgatggcagttgcagggaacagcagcccccccaggactagagcctgctttcccccgcccccaacacgacagcctatataaatagagtcttgaggaaaaaattaccagcaattagtcatgaatctgcttgctggaatgaggagaaacttgtggaaagtcaccagaggctctggtgggaaaagctcagctaaggaggccacgcagacagggcaagagcaagacgactaagggagaaggcctgtggggtgttcctgcaacctttgatgccttccaagtcttaacctggaagggaaaatgaagggcctggccactgggctataacgagctccaaactgggcccacatccaagtcggaagtcctttaatgtgtgcttgggctggaggtggggcaggtgaatgaggaggaagagtcagcatagcaggccctgccctgggttgcaggtaccttggggggatgaggcggtagagcacagcttctgaccacagtgcctccaccacagaaagcctgtgccacacaggtcctcccctggcccctggggaatatgcttcagaagcagtgacagcagcaggctcagcgtttccattcaagaggtctgctgaaaatgaccctgtttcaggaccaaagtgatgaggagggaggacctctcttgccccgatgaatttctcaactcatctccatcgacagaggaatctcagtgtgctgtgttccccaccgcctctgcctgagcgccctgcccctgcccgtccccatcttcatctggccagttcctactgcaagaacccttcagacacgatctcctcagagaaacactcgctgacctcctgaccctcacagggcccctgctatgcattcctggggccctccttctttccatcctcttaacagacctgacaagatcagcttcccctcctaaaccatgaactctctcaaggacctggactgtgccttgttgtctgttcaactgtgacctcactctagatggtagagcccaatgcccagcatgcaattaacaggagctgcctgcagacacaaggctggctctgtgtcccctcccagctgagacactgagccccagcactaggcacgtggatgggttgggcacatgacctccctccctttctgagcaccttgcccattccaagagctcacggaatcagactccgcgactgccctgagttctgacttctctccccatctccctgcactttgattctcttgaccatgggtcctcctcactgcatatcccctgcctgcttgagaaaagggatgcagcccagatggtcaataaccccctgaggtcctcctcctaggaatgtctgtatttgctcacaaagagaagtttatatatataaaaccaagaaacaaatttctaatggtattaattgaattttaggcagtagcagaaagaaaaaaagatttgggaagcagggagtttcacttgattcctgaaatcacctctagtaggtaatgcccacctctgctgtgtctaagatcagccctgactcaatcttaggattaggcaccgcctgccagccatggcaggacagtccacagatatgtccccaggtggccactgtcacctcctttcagcctgacctcagctggctgtcctccttgacaacagtcctctctggctgaagactggaaactgtaggctagagctcctgctttcctttctgggactctaacacagtaccagcccaactttccatgcctctgtcaggtcagcatggtatcagagatggctgtttggccactctcctcctgcaataatactccacgctccaccaacccctgttccatctgagagccactcacagtcagctctgcccgaggtccctgatagattggctggtgccaaggatccattgaggagatggcacagagccacacaggggagcaacaacattggaagagggcaaggtcaagttgacaaataccatatacgatcagaaagaattgcatgaaccgcagtggcataatgtagcataacagatggataattagatttattctaagagctgtaaaagtaagtaattaaataaaaatatggaacaatgaatctgccacagagagacatctaacagcctcacaagggccttgcagctggcacgagcagcctgggaaggaagcagtgggcaaggaacctctaacactgccctgatgttttaggcacaataaatttagcaccagctcacactgggcacaaggggacagcttgatctcagagggggataatcacacccatggctgcaacagtactgtgccctgggagtatggcctcttgtctgcatctggaagacagcagcctgaggtattccgataaatgccccaccactggcatgtttggaaaggcccctgcaaagcaagactggcagattgtatttatctttgcagaagcagaggcagagaggaagggagatgaaaatgtatgcacagatgacaggattcactgccaccaacaaaggcaggctgggagacccaggttcaggtctccactctcctcccaaaggatggtggcagatggtgagggtacagttaccacataagaaacacaaggcaagcacccaatgtgtgcaaagcaaagtgttaggtacaggatttcaccagggaagcagcttccctggacatgacattagctatttggaagcaaacagatcagttggaagttgttttgtattagttaggactctgtttttaagggaccaaaatgaaattcagaggaatttgaattcctttgaattccttcctcatctatggaaaagagagtgtactgggtcccattatgaagaggcatgacaaaggtaaaaagcacagctgggtccagaggcttaagtaatgtgccaaggccctctctcagcctgcacctctaggctttgcttctctccagttttctccctgtaaacagccaatcccagcataaaggtaactacatcctcccaagtggtatagaattccagggaagatcctggccaacatggggaaaccgtctctataaaaatacaaaaattagctgggtgtggcgatgcgcacctgtagtcccagctactagggaggctgaggcaggagaatagcttgaacctgggagggggaggttgcagtgggccaaaattgtggtgagccaagattgcgccactgcactccagcctgggcaacaaagagcaaaactcaaaaaaaaaaaaagaattccagagaagaactttgattggtcctgcttgtgtgacacacacacccctggaccaattactgtccagatggaagtgatactgtgagtggcaagtctagatcacatgaccagccctaactgggaagggaacaggtggggcataaagattaacagcctcaccacaccatgtggcactggtgaagagattcccaaaggaaaggaagtattattttccaaagaggagaacagaatgtgttgagagaccaaaaacaacataaatcaagagccttcatagcccaccacattgttttataccaccccaggccaagatactagatgataattgactatctggggctggaatgggaggtggccaagtctattaacagtctggttggagatttgtttgcagagatcccatgtgacctaccggcttgaaatgctccaaaggccctgctgcttgtacttctaaaagcagcccatccttgtagacctgcccctgagaccatgcacaggactttttctacttcaaacagctccacttaggaaatctacacagcactaaaagcatagtgaggagttcccccagcagccaactctttgcagggttttctcaccaactaacttgaatcttcttctcagagcacagaccataaagattaactcccctgaacctggaaacctcagcacctttgacgggggtcaagagcggggatgaggctcagcccagagttgctccccattcacaccaatggtttcacaggatagctctctattccaatatacccctacatcctggagagggagggaaactcagcataatagctgcaaaagtagaaaacttcccacatccccagcaccacaaaagctgccactttgctcaatgcctagcacaaagggctcacagtggggctctccccacaacctggcttgaaggaagagaggtccttggcctttcctcacctccagggcccacggcacactcttctaacatcctcactgggctccaaccaacaggctcagtcatctctctggctaaatatcaaagcagcttcccttctcaagcgtgtccaaaactcaggtctccttcaggccacacagatgacaccctccaaaagcccagaatgagctctgtagggtccctggggagagctgagacataggaggcctcgttgttccaaggccagctggggataagggttatggggacctttggaagccagatccagcaggagaatcatgaggcttcagttcctgagctctgcacattcttaagtgattccgttgacttcaccaacaacctggggcccgccgaaagcagtggtgctagccaacatctggtcaccaagttctttctgccaccattacttgtccactgagcctgtccctagaaatgcagaaagacaaagctcagctcccatgtggagtacttaaatgctctagccatgcctggtactcacagccacatttgaaggtctggttcaacgcagccatgctgggtccagatgtaagaacctcaagctgggctaaaaagcagctttcccatgggtgaaccctctggctcagagctcctcaggctggctctgctgctgctccacacatgccacaatttactacagctgttaagagccccagagacaagaaagctcctccttcccacttgttccctgcccttcttcagcacaggctggaaccaagcaccagccaaacctggagagaacctcagaaactatgaccccaccccacaaactgagctcacacaatttttcttgagccacaaactaatttttgttaatcccagagaaacagttcaaacagcaactaacctttttcttccttcacaactattaaacttggacaaatacctcaaaatagtacatgaaccaagagtttaatccttctccccagaggcaaagagaggactatgtgggtaacatgagggtaaaaccctgggtccaccaagtccaggacaaacgggtcctgggtcctcaggcaagggggacagaggggcaataagagcagaagggaggacaacccagggctgaggccccagtgatgggggtagagaagcccttgttcagtcccagcatggagctgaggctggccacagtattcctacagtacagcaggagcgacacctgcctgccacctggctgaagggatctgggcaaactgatgagtccacccccaagcccaagccaattaaaggttatccttatacaattaaaggttgtgtaacatatgtaacaaacctgcgcgttgtgcacaggtaccctagaacttgaagtatttaaaaaaaaaaaaaaaaaaaaaaggttgtgtaagaataaagtggcccagagaatgatcatgaatgctaaaacacagaatccaaagggctcatgccagaaaacccaacagcaacttctgtgtcttattttataataagtaatttaaataattataaatcatgtaagttcatggtaaagaaaaaaaaaatcaagcagtatagaagagtgcaaaatagaaaggaaaagtccctgtttctcagaccatcagaggtaagagcagagttttttcttttttcttttgagacagggtctcgccctgtcacccaagctggagtacagtggtgtgatcacagctcactacatccctgagctcccaggctcaactgatcctcctgttgcagcttcctatgtagctgggactagacatatgccactgcacctgactaaatttttttttaatatagagctgaggtctcactatgttaccctcaaacttctgggctcaagtgatcttcccgcctcccagaatgctgggactacaagtgtgagccaccgtgtccagccttgactaatttgttgttgtgattgtagagactaagtcccactatgttgcccaggctggtctcaaactccaggctcaagtgatcctcctgcctcagcctcccaaagttctaggactacaggcatgagccatcacgcccggcccagatttttatatcacatatttaaaaatatatgtgcaatataaatttatatataaatctttacccatttactttttatatgaatggatcacgcttctacacatgctattttcaatgtagagaccctactctccagaaagaagaggctcctcaggtctctccgtgcaccccttgatatcaaattgagcagcaaacagaagagaacaggggtggctggtcatattttaaaagactccaggatacactaacattccagaaccaaaagctaaatccaaagagctcctcaggaaagcgtgaactcggctgcaacggggtctctctctacaggccagggagagggaaggcagcctttataaaccgttcctcttgggctctcctgcctgtggctgttagcttcacctcccccaacttgccatctgagggccttcattcttcactgtcatgcctgtcaccacctctgtcctccccctttgggcctgctctacagcctccgcactgctctgaaacatcaccactggcaggactgtgcaactgagaacaacaggagatgacctcacggcctttacattctaatgccagctcccaattacttgtactgttgaataattgaaagaggagaataatccactcagctgatttgggaagccagccaggcacacagattatctcagagtgaattattcacactagggataattgggagttgcccaaacttctatttgtagttcaggcatcacgtggaagaacattcggtatggaaagtatgaaagctggagagggaaggagcccctgtttccgggcctgggtttcctttatgttgcttgggaagtcaatgctcctctctcggtctcactcagagtcggtgagcacaatgatgatgatgatattaacattaacaatattttagtgacagctcttgctgtatttccttacaatgtgctgtgttctgtgctatgagcttcatgtgtatcatcctacattatctcatttaatcctcacatgagtctgtgaagcaccactgtcttcttcatctctgagctgaggaagctgaggcttaggttaagtaacttgcccagagatatacagcaacaagctgtatgtccatccatagaccaggatcttactcaagaagttcttttgccacacacctcttacctctcccacttttaagagtcttccttacacaagacataaaactgtaaaggataaaaacaccccatttttagtataatactgtctactctcatcttgaaattactggatttcaaggtaagaaaaatggctccctcctctgaaggttggcaagaagcctataggaaggggctggtcagctggtcaatccatttcgagaaatccagtgtctggaagcacaagccactggcagacttccagaagagctcagccttctctcatgatcaaagactcaaaaatgaaaccactgtcctccccctgacacgccaccacttcagccaagaggcagctactgagctgggcagctcagcaccgtgaggccagagcatgggggaagggcataggctcagtgagctgcaaggaacacctgcctcagacaagggtccatgaggtgactgactgtccctgcatgtgtggggtctccttccacagtgcctaggacagagtccccagatactaggtgtggtgccagtctccagcacggtcaccggcgatccccaccagcgatcccagcctttgtgttggtgcctcccacattaactatagatgatctatgtgaccaaaagaataaagaggaagtgatgatgtcgaattctaaggctaggccacaaaaagaactgaagtttccatcttgctgtcctatgttgttcactctgggggaagccatggggagacctgcacagccctgtggagaaactcacagagagagaaaccgaggcctctcaccaacaactggcaccaaccagccaggcgtgtaaactggaagcagattctcatacccagtcaacaccctgcctacatttccaaattcctgacccaaagaaacagaaaaataataaactattactgttgttttaacccactacatctgagaataatttgttatacaacaacacatagctaataaactggacaagagggaaaagagctgcttcacagcattgtttccagaagtgtgacgtatccatagaagaaccaaacctggtgtcagggccagaggccaccaaaggccctgactaagcccctaaggtcttagaacactatatgagaaaaaacaatgaccttcacggcccagatattccagccctccagtcaaggaaaagcttgcagaaaatattcacgatgcccatacctctgcctccagtcaggatgacaataacaacaatattagaagctaccattactgaatgcttactatgtgcccggtgcatgctcagtattcttatattacctctcttttttttttttttttttttgaggcggagtctcactctgtcacccagactggaatgcagtggcacgatctcagcttactgcaacctctgcctcctgggttcaagtgattctcctgcttcagcctcccaagtagctgggattacaggcacgcgccaccatacctggctaattttttgtatttttagtagagacggggttttgccatgttggccaggctggtctcaaacccctgagctcaggagatccacccgcctcagcctcccaaagtgctaggattaacagacttgagccaccacgcaggccattacctcccttattcttcattgcaatcctcagaggaagcacatagtagggactcaataaatatttgctaaatgagtaaataaaccaccattaggagttcgtctctataactgatctatgtccttttggtataatttcaactttctatattacgtattactttaacgtttgaaaagcttacactgagaatgtattacttaaatagaggaaacaatatatatgaaattaaaaaaaaaatttgtagggcaagcaaagctctaatcattatgtgccatccatcacgtttcccagagaagtgcacctccatcctgagctgactctctgagagcttctcacacatcctgagcttctcacacagcttctcaagagctacctggatccactagaaagcccattcacacagcaccctgtgttgcttgaccctccagattgtcctccaactcagaggaaggaagtaggtatgctgctagctggtggaagtggcaggattgctctactcgtctcaggaccaggtgccatggccaaagacagccccagcaattgaaaatcaggcagacatcacggtcctgagtctggacagccacaatcttatgatgagagtagccacaaacatggagagacatgaagctttctgactctatatcctaatctggggaacaataatcttcccagttatgaagcactatcatggccatcagatctaccacccaaaatcctgatgagaggaggtgacttgaactagataccaggaagagcttcctactatcagagatttaagataacaaggtaggcagtgctgtagtctgaaaccatgaagagttccttctctcccgcaaagcaatcagaggaatcttttttttttcctcctttttttctttttgacactaggtcttgctctgtcacccaggctggagcacagtggtgcaatcatagctcactgcagcctcaaactcttggactcaagcaatctacctccctcggcctcccaaagtgctgggattacaggtgtgagccactgagccaagccaggggatcatttttaaaatgtaaatcagatcttgttactcccttaattaaatggcaccagtggcttcctgctacccttagaataaaatccaaatttagttcacctaggtctctaggtgcactgccaacttcgccaacctcacctcttcttagtctttctttagctcactccattccagccacactcaccttctggctgcttcctcaactggccaagcttgtccctacctcaggacccttgcaacggctattcctgctgcctggaaaacccttggcctaatgtacatatggctgactcaatctatatttgagttgaggccagaatgacatctctttggaaaagtctctgtaactaactcatctaaagaaccttatatcatcctattttattttcttcataacacgttactgacttaaaaatgctttattgaggtaaaattcacataccacacaattcacccatttaaagtgtacaactcaatagctttttgtgtattcacagagttgtgcaacatatcacaattttaaggcattttcattgcccccccatacctattactagtgccccccgcaactctccccaacccccactccctcagcactaggccctacagatttgaatattccagacattccacagagatggaatcatccagtatgtggtgctttgtgactagcttttttcactctgactttttaaaagtttcatccattcataacatgtatcagtacttcatttctttttattgctaaatattccattgtatggatatactacattatatttacccatttctcagtcaacagatacttgggttgtttccactttttggctgttatgaatattgaggctatgcacattcatgtacaagtttttgtgtggaatatggtttcacttctcttgggtacacacctagcattggaattgctggatcacatgataactctatgtttaactatttgaagaactagtagtgtttttcaaaatggttggatcaatttacatttccactagcagtatatgagggtcccaatttctccacatccttgtcaacacttgttattatctatctttttgagtatacagtgttctctcattgtggttgggtttgcattttcctgggagttaatgatgttgagcatcatttcctgtacttactgcacatttgcattatcttgtctggacagctgtccattcagatcctttgcctattttttaattgggttgtctttttattgttgaattgtaggagtttttaattacgttgttttctgttgctgagttgcaaacattctttaggtattctagataaaaagtcccttaccagatatatgacttgtaaaaattttctcccattcggtggttttccttttcactttcttgatggtatcctttgaagcacaagagtatttaatttaatttaattttattttattttttttttgagaaggagtctcgctctgtcgccaggctggagtgcagtgcatgatctcggctcactgaaacctctgcctcccgggttcaagcgattctcctgcctcagcctctcaagtagctgggataacaggagtgcaccaccacgcccagctaatttctgtatttttagtagagacggggtttcaccatgttggccaggctggtctcgatctcctgacctcatgatctgcccgccttggcctcccaaagtgctgggattacaggcgtgagccacagcacccagccaagagtatttaattttgatgacatactgactgactaaaaaatcaacttctgacatgtaaaaagaaacacctatctgtcttgttcaccaccacatcctcagtctagcaaaatgcctggcacataataggtagtcatgacttttttaaataattttttttcgagacagggtctcactctgtcacacaggctggagtgcagtggcgtgatctcgacttactgcagcctctgcctcccaggctcaagtgatcctcccacctcagcctcctaagtagctgggactaccagcacaagtcaccatacccggctaattcatattttttaatgaatgtatgaatttttagggccagaggagatgagtgttgggatgggctatgagagagggctccttgccaggaggcaggggtgaacacagtgatatctggaatcatttctgtctagaggagctgtaaagagtgagagaatgcggtcttccacaagagcatgggggcagtgttagatgcaacactcctgagaagtgaacggcatcatcaataacaaactccctgactgaaatgctcaggtagtcatcctgtcttttcagccacccgggtgagcaaaagacagaacaatggctcaggaatggggacaactcaggcaaaagggcctagtcacaggggtgaggttctttccagaatcctcagcacacagcaacacccccaaagggggctctaggctcttgctttacaaaaaccgctaggggcctgtgtgtcagcatggctgacaggaagcggttatactgaggaaaaagagatgaagtcaaaagataaagttgacagatattagggttgtttccacattttgcctatgaacttgcctcttctagcctttgccaagaacaatgaaataagaagtctgaagagctgaatgtccatgccagggtgcttcatcaaagcacctcagggatcctagacttgactgccgagaggaggcattttagtcaggcaaagaggttggaggtgtggtatgggtgcttaaagttggctaagtgctaaaaaaggtggacagtttggacaaccagtctatgagtcccatggcagggaaggaggtaacctaagagacaagcaggggtccaaaagagaggtctggaaactcatcagttgcagcatcaagaaaggtattcaaaggcaagggcccttgcccttccatcccagacttccactgtgtcacttttcatgagggaaaggaaggagggcacagtgagttttagaggcacatgcatgcacacacacatatatggagttgcctctgggaatgtaaataaatattcatgaacagctcagtgtatgaaaagcaaggacagaggatgaaaaatggtgccaattagaaagaaagggtggtatctatttttaaagtggctgaataaacagtaaaggattgcttgctaaaaatactgtgcttgaccccctccccagtggcagagtccctctcctgtgcttggtaacaacaggcaaactctcctcccagtgtggcaggtctaatgctgccatggcagcctcatgttcttatgagaggttcaccctgggccaggtatggtggctctcgcctgtaatcccagcacttagggaggccgaggcaggcggatcacttgaggtcaggggtttgagactagcctggccaacatggagaaaccccatttctataaaagatacaaaaatttgctggctctggtggcgcatacttgtaatcccagctacttgagaggctgagaggctgaggcaggagaatcgcttgaacccaggtggcggaggttgcagcaagccaagatcacgtcactgccctctagcctgggcaacagagtgagactctgtctccaaaaaaaaaaaaaaaaaaaagtttaccctgggtgcctgtctccagtaagaaggagatttcttgtgagaagcattctgggtctcggaccacaagctgataatggcactcatgcctcagaggtgactcaggttctcaacagtctccaaaagatcccttggcaagagggagcaagtgaatgcaggactccactggagaatccaactatggaggcatcagaaccaatgtaacaaaaaaggaggggagagtccccaaattatcctccccagagtccagatcatatgggagtatttcatgagagtcatttcatgggactagtggggcactgaaatcaagtttcttatccactgcccactcctgatacacatgcaccaggatattcccccctgggattagatctgactgatggcacatgaaaataaaggcaaggagtgaagctcagtatgattcatggacagagaaaacaacaggaacccaaattgtatgtgggccagtgatgggcagggactggagtttctgttctgtcccagatgcgcaaatctcacccaagtcagtcctgtaggaaaagcacttgctctcccacgctcacgcctgctctcgcgtgctctcaatctctctctcttttttttttctctctctcagcatttatcaccacttggcaccacactgtggttagaagtctggctttgaagtcacgctgcctgggttcatgtcttggctctgacacagtctagctgggcgacactaggcaagtacttaacctccccaagcctcagtttctccatgcataaaatggaaatagtaattgtctttactccataacagtacttacttggccagattcaatgagagcatgcagtgactctcagctcggtgcctgacatgttgtaggtacttttttctaaatattcttcatgtcttggtctagactctaaacattttgaggacagtaaccatgccaaatgcatcttcctatcctctaagagtgtaacagagttgaaattcagtaaacttttgtcaaatgagctggcttccctgagcatgtttgccatgggcaacaaacccagctggcaaatgcatttgtccagttcaccggccccatttgttctcatcacctcaagataaatcctcccaaccaccagcaaggtgtgcagggtgggcagcatctgcccctccctccattaggaaaaggtgagaataaattggaaaacaaacagccacaggcagtatttgcagctcctcagagcgatgccctatcgatttttaagtgtcactgttaataacaacaacaactggcagtgatacaacatttttcttccaaaacaatcagagcattttatagagacaatttcatctatctctccatggctccagcaggagcaggagaatattccccacttcaagtaaagggcaggagaggccaaggggtttggccaaggtcactgtacaagtcagtgggatgccggtgctcctggtctctgcggccctctgcatccctggatggcatctccctaggacagaacttccctagcatagttcttttcagatgtttagcaaagttaaccttttaacaaaacacccatgggtggagggtggcatcaagcactattccaaaaagcatcctcttggcgggaagcccttagacatgaccactccttggcttagtcttcctcttcctgtgtgccatcaagaatcacacctaccagttgggcgtggtggctcatgcctgtaatcccagcactttgggaggctgaggcaggcagatcacctaaggttaggagttcgaggccagcctgggcaacatggtgaaacaccatctctgctaaaaatacaaaaattagccaggcatggcggcttgcacctattagtcccagcaactcaggggggctgaggcacgagaatcacttgaacccagaaggcagagggtgcagtgagccaagatcatgccactgcactccattctgggtgacagagtgagacactgtctcaaaaaaaaaaaaaaaaaaaaaaaaaaaaggccgggcgcggtggctcacacctgtcatcccagcactttgggaggccgaggagggcggatcacgaggtcaggagattgagaccatcctggctaacatggtgaaagcctttctctactataagtacaaaaaattagccaggcgtggtggcagatgcctgtagtcccaggtactcgggaggctgaggcaggagaatggcgtgaacccgggcggaggagcttgcagtgagccgagatcgcgccactgcactccagcctgggcgacagagcgagattttgtctcgaaaaaaaaaaaagaaaaaagaaatcaatcacacccacctagtagtccagaggctggagtgccacacaaagggaggcagagaaaggacaggtccaatcttacccatgcgacacacagatgtgtgtccaaggagattcccgtccaaccacccactctaccctgcccggactcccacgctccacccctccccaacacagaactctactcccaagagtgacgtctggcagaaactatgaacatgaatgacagtgatgcccaagcagacagacacagtctctgtgagacacatgccaagtgagcatccctcctcccagagatggaccctaaccaccactagacaagagcttcctctgctggaaacagctcatccagccatctccatgatacataccctgcccacagctctgggcatcaggcagataggtgggacaggaggccacaagtagtgtgtgtcatcctgaaggctaaaatcaaagcttcctgtcacactgggctatgtcgggggattagcaaaggtagctaatcctggtgcagaggataggttccaatcaagatctgaaaaatcaaaggctgaggaaggcactgaataagatctcctgcaccttatataaccagcaggctcaagtgtctggtctgtcctcttgtcactgaatagagcagctgtgcttgcaggacttcaggagaaacagcactcaaggcagatgagagataatatccaggctcaagtacaaaagaggaatgaactccttagaacctggatgccaaggattacttagtctcaggcaggactgatactatcccaccaaccctccctctcttacggtgtttttttttttgtttgcttttgtttttttttttttgagacagagtctcactctggagactctgtcacccaggctggagtgcagtggggtgatcttggctcactgcaacctgtgcctcctaggttcaagcgattctcctgcctcagcctcccaaacagctgggactacaggcatgtgccaccatgcctggctaatttttgtatttttagtagagattgggttttgccctgttggccaggctggtctcaaactcctgacctcaggtgatccacccaccttagcctcccaaagtgctaggattacaggcatgagccactgcacccagcctcttatgcattcttgaggcctgtgagctctagagaatcaggcatagcctcccaagtgggattaccaacccctaccatccccttatacccagacaaaagcaggaaggaaaatctgaccacttcttgctcttgagggcccaagctagggtgtgggcaaagggtccagctgagtctaagctggaaagcagggcgatgcctctgataagaacaaaggctgtatcagacacaggggatgagatgcttctcaggcgctattcttcacaaaggggacaccagcaaaataggcaaattaaactcatttgtgcctggcacaacggcagcagtggaagctacagccagagcagctagaggggccgaggtaatggcaggacatggcagtgggcacatggggagaagagaagcagggctcagctcttatctctatagcatcctaagggtgtggcatgggccctggttcaccagctctgatgtgggaccaagaaacctcacctccatcccttggggatattttaagtatgttcaattttgagagtgccagagttaagaaatgctgtcaggggagttgtttttgtgtgtttttggtctccttctgagatggctttgctgtacttgtttccatctagggatgagtgagatcccttatggttccctttgacctgcctgattagcgattccacaggaaaacacctcccatgacaaaatgaaagtagacttcaagccaccttccttcaggctgactcctgtgtaaatgagctgcctgcagcctgactcacggcagctcaaaatggaaaaatgaagagaaacaaaccagtgtagttcaaaggtaagggtgagacttgcctatcacgtgaagcttctatgggcctaacccagcacgctgccagggacttggcatgggtatacaattcaggaaggaaggaactcagggcacacttctcaagccagaaagaacctcatatctagtgctcttgttttcacagagacttaaagtctcacagaagtaaaatgatggcttaaaagtcagttctctgactgtcgacccaagactgtatcccatgtgtccagactcctgagttcaggactaggtcagagtcacactgagtcaggggcccctgtacatatttgcatcacctcccaccccatggccatggctagagataagtggtggcagagctgtgggcgggaacgtggacttcctccctcagcgactggccagtgaagtagagcccgctgatgaaggcaaaccctgcaatctccagctccacagatgatgttctgtactaacaggctccctggcaaggcagcagggcacccatcatcctaatggactttgtgattaacatggctagtccacctacagcgccaggccctctcccttccctccctctggattgcagggtccccacaggcagcagctaccccaggtgtctgtttgatccaaacattaaaaaagcgtccattcactatagcaaagaggcagttatttcaaacctatacattatgcatccctgctggaaagaaaaaagagcaaaattaaattaaaattctctctggaagatttctgcccagaaagacagaaaagcactctggagttgtacctagttcccaactccaagcagctctctgctgcccttcccctgcttcccctcctggctggacagctccagatgtgtctctgagtttcaatgattcactctaatgataatgcaccctctgaacaaatcacggactctgattgatttaggacgcaacttgcacaaatacctgtaatctagttctaatcttgtttgtttccattccaattatcctgcatcaatggtttaaaaatgggaaccgtctggtgcatacatccaatccattttaatagaggataaatctgggttattgtgaccctttcctctcccaggcgcaggacaacaccagccctctcaaggcactgattgggcagaatcagctctaactctattcaactcttcaaggattcaattaatcataaagccaattccattctaggctccatctgtcttgcctccttcggggactaataatcactcactgtgtgtttttacacactagttgaactgaaattaagactgatttcatcatggaacactcaaaaagaaaatacatttcttgaagaaaaatttcagagctactttaaagttctgttcagataaagatatttgtaaatataaacaaaaacaattttaacttcaaacttcttgacattgtaaaataattcctgcccccaaatccttggaaaagggcagcttctcaggagaatcagaaactcctgagattggatcagacaacagaaagactcaatttgtccttgggcacaacataggtacctaaaacatgggaggggaaaaaaaattgggtcaatttgatatttgatgcactattttgttttatttatgatagattattttattttattttattttattttattttattttattttattttatttattttgagacagggcctggctctgtcacccaggctggagtgcagtggcatgatcacagctcactgtaatctccttaagtgatcctcccacctcagcctcccaagtagctgggactacaggcacacaccaccactcttggttgctttttgtatcttttttggtacagatggggtttcaccatgttggccaggctggtctcaaactcctggcctcaattgatctacccactcggcctcccacagtgctgggattgcattattaaaaaaaaaatctaactagtcatccattctgggaccagaggacttaacctaaaatttagaattatttttattttgcattacctattcatgaaggcagggaggtcagggaagatagggcaccatattcttttcaatgtgtaggacctctagaagttttcagctggccctgaggagtctaaaccctcacactcctctaaagggcatgatatatggcttttgtattcctgcatagcctggctctcatagaagcattaaagtgactgccctggcaaacactctaaatggagccctcttactacacccatctcatcccctaccctgaggataatctctttaccaggagcatgaccatggaaagggccacggcccaaccagctggccacctggatctagaagcaagcctaacttgtcagcaggtttcaacagagaaaatgaaaatagttgagctttttattttttgagacaagagttttgctcttgtcacccaggctagagtgcaatggcgtgatctcggctcaatgcaacatccatctcccgggttcaagcaattctgcctctgcctcccaagtagctgggattacaggcatgcgccaccatgcccagctaattttgtatttttagtagagacagggtttcaccatgttggccagcctggtctcaaactcctgacctcaggtgatctgcccacctcagcctcccaaagtgttgggattatagatgtgagacactgcgcctggccaagttttttactttttactttttacaattgtaaagacaaagcatttgggcctctccagagtccaaagctcctggtggccattgtacgcctagcacagacccgtacacctggttcttacagaacagtcccagcacaatggagggaacatgctgcagccaaggagacacagcatgtggcttctttattgccttaacagattttaaactaaaattttgaattacacagattcccaatcagaactaatgacataggcattccaaacttaacatcaaagatgttttgtgagtcatattggctctaaaaaaccatcagtaatcacttcttagacacaacaatcaaatacctccttcgtttaaacaataaattttgcctactaataagtctaattaattgaagcactgtcatttttaaacgtaggtcaatgtaagcattttcccaaaagtttccacctgagtcattctacaactattgaaagcaaagaaactatctcctaagaagctctttatggactgataaagaatgatattcaagatacagtgctaccagcctgaccaacccagtgaaaccccatctctacaaaaaatttttaaattggccaggcatggtggtacgtacctgtggtcccagctacttgggaggctgaggcaggaggatcgcttgagcccaggaggttgaagctgcactaagctatgattgcacccctgcactctagcttgggtgagagcgagaccgtatctctaccaaataagcaaacaaaatacttatatagttaaacagaaaaagtaaattacagaatgatgaatctacagtaaactgcctttcatgtaaaaacaatatatggaaatatttactttaacatggaaaaatatctctagaagaaactgacaacactggttgccttgaggcagggaagcagggtagcaaagggacacggtggaaggacacagtggaggatacttttcatatcctctggtgccgtttgaattttgagccatgtgactgtattaccaaatcagagttgaaaacatgaagtttaagtaagtcatctcatagacagtaatctggacacttaccaaaatactacagagaagtcagaccatgttccacagggaaaacaagaatcttatatatcccagccaggcatggtggctcacacctgtaatcccagcactttgggaggccaaggcgggcagatcacttgaggccaggagttctagaccagcctggccaacacagtgaaaccccatctctaccaaaaattacagaaattatcttagtcatatggtttgaatgaacctctgtgtacagacttcacgaacaccatcaagattagccatggcaagagaaaaatggggcccccagtggtcactacacatatctgagggcagatggcagcagcacaggagggagggaagaaagagaggaaggaagacaggaaggaaaggagagagatacggaaggagggaggggaagaaggctggaaacaagggccgcactcctttatgtaggacaccttttgccctctaaggcatcatctagcttgataagcccccaacagtttctctcctttgcaaaaggggaaactgcagctcatttaagtcacagttcatagtgagttacaggggtggagagggtggctttacatgaactttgcaggaacacatcacttctgatcctaggacttctctaactgcacgggaaatgccatctgaaggccatgtcttatcctgaaaactcagagtttctgactcatcttctcattctgactgccagctggctctgtggtcttgaacaaatcactgcagcagaggtactgagtgggaacagaggctcctccattcagccactgatcactgtccatggctctttgggaaaggcatgcgtgcgacaggaatttcacgttaagggtcacaggtaggcaccagggcttgcgtcttcctgccctctcttcctggaccgcccagcaagtttactcctggtcccatttttttgctttggcctttgcttctctttgaatctttgtatccaacccaatgtgagcgtacacttacccaagagttttccatctagacaatgaggactgtggaaagacacttgctcagagcaaaggcaccagtgtgaccactatgagggaaggttgtcctaggatgcccacagagatcccagtctaatgccaaacagcaactctaaccagggcagcctttagtctcaactccttgccatgagaatctaaatgaccagataaccgtagaaggtaacctggggaggactgctgggaattgggcagatgactttcattctattttctagatgctttccagctggctttttatttattttgagacagggtttcattctgctgcccaggctggagtccagtggcgttatcatggctcactgcagcctcgacctcccaggttcaagggatcctcccacttcagtctccaaccatgcctggataattttgttgtttttgttagagatgggatctcactattttgtccaggctggtcccaaattccagggctcaagtgatcctctcacctcagtctcacaaagtgctaggattagaggcatgagccccaaacaggccccagctggcttttcttttcttcgtgacagagtcttgctgaagtccagtggcgcgatctcggctcaccgcaacctctacctcctgggttcaagcgattctcctgccttagcctcccaagtagctgggattacaggcacccatcatcacatctgtctaatttttgtatttttagtagagacggggttttgccatgttggccaggctcgtctcaaactcccagcctcaggtgatccgcctgcctcagcttcctaaagtgttgggattacaggcgttagccaccatgccccacccccagccggctttttaaaacagtctttatcctttcctttttccgggtgatctgaaaaatgaaggcttcatgacaggagtctctatagcctacaccatcctgcaattgccagtcagaaagagtaggaaggcctgagacattctgttttctggcgtgttggccagatgctctggatggaggctggggcaccagggccagctataatcttttcccagcagcctggctgaagtagctgtgggaccaaggcaactgattaaatgcagaataaaagctgagagaaaatgggatagaaataaattagctttagacctcaaggctgtgtatgcaagtgaaatgcagtaggggctgggaggcagcatgggaagtcagtcttagagatttccctgaaacaaagggattatggattgtccaatacaaggaaatccttctgttccacagccacatgacagcctcttttactcagggctgttcattccacattttgcacacattctgagataatgggatacactaactccctaaaaaagccccaagactcccccagcaggccttctatccaggcagcacaggctgcaaagcagggctggtcatcatcagggtacagggtcgatatttcctgccatccttcaatagttgccctccctctatccttgacagattctccacttttaagtattgaactatggttacagaagaagagctgctgggagagaatacatctaactgatcagaatttaacaaacaaacactcaaaagtatttggcagaaggagagaagagaagaaatacaacggagaaggttccccatctatgtccttgtgacttaaatatcacagagaacccatccagaaggggcttgatccaaaaaatggaccatagcagcagagtttagaagcatgcttactctagttaaatcagggctatttctaaaaaggctggtcagagctctctttcaggtttgctgccaaagggcagaagcctgtaggtactggactcctgatgaggctcactccagtcagtgcccactgtacaccttctaatgcatacgcagaccatggaaggaaagcaaggtgcagaacggatgtactgagtcccatggcaatcactacacgactatgggtgctaggctgaatgaggagaccttgccacaaatcccacctgctccctccctatcattacctatatcctccagatatccaagtcaaaagcttgtgtgagtgatgaagaaagagactaggaaccccactcaagaccttcagagagatggccctttctgagagagtctgctagctcttcaaactatagaaagaacatgggctttgacatcaatgctttaggtttgaagtgtaaccatcccataagttaactgcatgctcttgggtgaggaccctcctctgtgaagccaaaatcctacccctcactctggcagttgttgtgaggattaaatgagacagtatatgtaaagcccctgcccctagcaggctccttttccacagccagcctttctcatatccacagcatacctggtccaggtgagtccagtactctcttggtatgctatgctcttctacacataagaaatagagtaattggtaatttttcaggttatcttttcaaacatcaaaaaaataaataatccttgggcgctaaactacaaggacacaaaggcctaagaattatataatggactttggggactcggggaagggtgggagggggtgagggataaaagactacacacattgggtatagtgtacactgttctggtgacaggtgcaccaaaatctcagaaatcaccactaaagaacttatccaggcaactaaacaccacctgttcccaaaaaactattgaaaaaagtaaaatttagaaaataataattaaaaaaatataaataaataatcttatgctaaactattccagagccaagagaaaagagaaactttttcttttgtaactgaaagctagctgagatggaagctgctagtggtcccccacaatctgttctcccattcttccacagtagcagaatttttgctgggcaaataaagtataaagactatatttctcggcctcctttgcagggaggtatggccaaggcactacgttttggccaacagattataagcagaagcatcatttgacagcttctgggatccccttaagagatttttaagtgccctttacctcctcttctatgtcgctccttccaccctgctccctggaatgcagatcttgccatctgggatgatgaggaagggctattccttagggatggcatcctagtgtgactcgaaggaactcaagacccaagagtctacccacaatacagttgccacaccaacccaaagctgctgacctgaagatgctgtttacatggaaaaaataaatatctatcccattatgtcattttctgtcacttccagaaatatgatgtctaggccacagccagacgcatccttgtgtaattacctcccattgggtgtgggaatatgacatgcttccaaccaatggaatacggcaaaggtgacaagatatatacgactatgtgtatgtgattacactacgtaagacggtaacatctgttttgctgagaaacactctcccttgctggctctgaagaagcaggctgccatgttgtgagctgcttatggagatagccatgtggcaaggaactgagggcagcctcccaccagcaacaaactaaggtctttaatctgacagcctgcaaagaactgaactctgccaacaaccacatcagtttaaaaggaaatgcttcccagtcaagtgccatattagaccctagctccagctgacaccttggactacggcaatgcagaggacccgacaaagtcacacttggactcctgacctacagaaagtgtaatataataagtgtgcattgttttaagccactaagtttgtgagaatttgttacatagcaatagataactaatacaatgaccaaaaacatttatttcagaaatgtaaggatgattcactactagataatatataaataaattcatcaacctatggaagatatcatatttagtggtaaaatattagaatcattccctttaaagacaggaaaaggataaggatgtctactagtatttcaataaacactgtattaaaggtgctagacattgcaataagaaagagaaatggaggataaagattgaaaagaaacaaaattatttttatattaaatgatacgattatctacaaataacatccaagaaaaaatgtaaactattagaactaataagacatcagcaagtttgttggctataaagtcatataccagcaacaaacaattataaaataaaaacttgaaaattaacctctttacaataacaaatactatgaggtaattaggcataacaaaagagattgattcactacctatatggaaaaaattatgatgttttattaaaagatgtgagaccatctaactggaaagacatatcatgttcatgaacagaaacacattttataaatatgttaattctcataaattaatctatacatttactgcattctagcttaaatatccagtgttttgttgagcctcacagagtatgcctaaaatccatatggaagagtaaagcgccaaaaatatccaaggcaatttttaaattaataaataatagatgtacatattttggggatacgtgtaataaatttttaataaatttaatttccgggacacacgtacaggacatgcaagtttgttacatgtaaacatgtgccatggtggtttgctgcacctatcagcccatcacctaggtattaagccctgcatgcattaactatttatcctgatgctctcccacctcttgccccccagccaaccaccccaacaggttccagtgtatgttgttcctcttcctgtgtccatgtgttctcattgttcagctcccacttataagtgataatatgtggtgtttggttttctgtttttgcattagtttgctgaggataatggcttcgagctccattcatgtcctgcaaaggacatgatcttgttcctttttacagctgcatatgtaccacattttctttatccagtctatcactgatgggcatttgggttgattccatgtctttgctattgtgaatagtgctgtaatgaacataggcatgcatgggatacatgtgctatttattacattcatataatttgtaaatatcaaatcagtataattgggatatctatcaccttaaatattcatcttttttttttttttgagacagagtttcactcttgttgcccaggctggagtgtaatggcgtgatctcggctcaccacaacctctgcctcccaggttcaacaaattctgcctcagcctcccaagtagctgggattacaggcatgcaccaccacgcctggctaattttgttttagtagagacagggtttctccatgttggtcaggctggtctcaaactcccgacctcaggtgatccgcccaccttggcctcccaaagtgctgggattacaggcatgagccaccacgccccaccttgtcttttctttatgctagaaatattcaaattacattccagttattttgaaatatattatacaacagattattgtaaactatagtcaccctactgatctagcaaacaatggtgctactgcttctatcaaactgtatatttgtaactattaaccaacctctcttcatctcctctttcccctacttttcctagtctctggttaccaccaatctactctttatctttatgagatccacatttttatctactatatataagtgagaacatgtgatatttgtctttctgtacttggcttatttcacttaacataatgacctccaattccctccatgttgctgcatattaaaggatttcttttattgtgtatatgtgccacattttctttatccattaatccactgatgggcattttggttgattccatatttcagatattgtgaatagtgctgcaataaacatgaatatgtggtgatttctttgatatattgatttcctttcttttggacatacacccagcagaattgctggattatatggtagtgctaattttagttttttgaggaaacttcatacagttttccaaagtggctgtactaatttgcattcctaccaacaatgtacccctttcaccacatcctcaccagcatccattattccctgtctctttgataaaagccatttaaactggagtgagatgatatcccattgtgattttaatttgcatttatctgatgactagtgaagctgagcatcttttcatatacctgttggccatgtgtatgtcttcttttgaaaaatgtctgttcagatctttcgcccatttttaatcagatttttttttgctattgagttgtttgagccccttatattttctgtttattaatcctttgtcagatggatagtttgcaaattattttattccattctgtgggttgtctctccactttgttggttgttttctttgctgtgcagatttttttttttttttttttttttttgagacagagtctcactctgtcgccaggctggagtgcagtggtgcaatctcggcttactgcaatctccacctcctgggttcaagcaattcttctgtctcagcctcctgagtagctgggactacaggtgcgagccaccacgcccagctaatttttatgtttttagtagagatggggtttcaccatgttggccaggatggtctcggtctcttgaccttgtgatccgcctgcctcgacctcccaaagtgctgggattacaggtgtgagccaccatgcccagcctgtgcagatttttagcttgatgtaatctcttttgtctatttttgctttggttgcctgtgcttttgaggtcttacacacaaaaaaatctttgcccagaacaatgtcctggagcctttctccaatcttttcttttgagacagtatcttgctctgtcaccacagctggagtgcagcagcacgatcacagctcactataaccttgaattccagggctcaagcaatcctcctgcctcaccttcctgagtggctgagactacaggaatgcaacactgtgcccagctagttttattttttatagagaaggggtctcactgtgttgcccaggctggtctcaaacccctggcctcaagcgatcctcctgtcttgggctccccaaatgctggaattacaggtatgagccaccacacctggtttccaatgtttattctagtagtttcataatttcaggtcttagacttaagtctgtaatccattttgatttgatttttttgtatatagtgagagatagaggtccagtttcattcttctgcgtatggttatccggttttcccagcaccatttattgaagagactgtcctttgcccattggatgttcttggtgcctttgttaaaaatgggttggccgtaaatgtgtggatttacacctgggttctgggttctgttccattggtctttgtgtctgggttgttttgttggtttgtttgttttgttttttaccaatgccatgctgatttggtcactacagctttgcaggtgtttgttttgagacagagtgctctgtagcctaggctggagtgcagtggcgcaatcttggcaaactgcaacctccacctccaggttcaagcaattcttccacctcagcctcccgaatagctgggactacaggcgtgtgccactatgcctggctaatttttgtatttttagcagagatggggtttcaccacgttggtcagactggtcttgaactcctgacctcaagtgatccacctgccttggcctcccaaactgctgggattacaggcataagccactgtgcccagccaactttgtactatattttgaggtgaggtagtgtgatgcttccagctttgttctttctgctgaggattgctttggctatctggggtcttttgtagttccatgtaaattttagaatcgtctcttttatttctctgaagaattgcactggtattttgatagggattgcattgaatctgtaaattgctttgggtagtattatcattttaacaatattaattagtcctatccatgagcacggaaactttccatttttgtgtgtcctgtattaaactctttatgctgctataaagaaacatctgagactgggtaatttttacttatttatctatctatttattttgaggcagggtctcactctgttactcaggctggagtgtggtggtgtgatcacagctcactgaggcttcaacctccccaggctccagtgatcctcctgagtagctgcgaccacaggcgcgcaccaccacacttggcaaatttttatattttttgtagagatggggttttgccatgttgcccacactggtctcgaactctcaggttcaagtcatctgcctgcatcagcctcccaaagtgctgggataataagcgtgagccactgtgctcagctgaggctgggtaattcataaagaaaagaggttttattttggctcatggtactccaagatatacagaaagcatggtgtcggcatctgattctggtaagggcctcaggaagtttataatcatgatataaggcaaagcaggaacaagtgtctcacatggtgacagtgggagaagggagcagtcccagacttttaaccaaccagatctcatgtgaactaactgaggaagaactcacttatcaccaaggaagtggtgctaaaccattcacaagggatttgccccctgtgatccaattactctcccaccaggccctacctctaacactgggaattatctttctttttgtttttccctcatgaataaagtaggatgcagaggattatctttcctttttttttttttttttttttttgagacagttttgttcttgtcatccaggctggagtgcaatggcacaatctcagctcactgcaacctctgcctcccaggttcaagtgattctcctgcctcagccttcggagtagctgggattacaggtgcccgccaccacgcccagctaatttttgtatttttagtggaaatggggtttcactatgttggccaggctggtctcaaactcctggcctcaggtgaaatgcccaccttggcctcccaaagtgctgggaatacaggtgtgagccaccatgcccggccgaggattatctttcaacatgagatttggaggggacaaatatccacactatatcatgtccaattcaattttttccatcagtgttttatagttttccttttatagatctttcatttcttttgttaaattgattcctaggtattcttcatagctgctgtaaatggaagtgctttcttcttttccagattgttcactgttggcatatagaaatgctattggctggaaacgatggccaagcctgtaatctcaaagctttgggaggccaaggtaaactcttggcctcaagcaatcctcaaggagttcaagaccatcctgggcaacatagtgagaccctatctgtgtaaaaaaaatgaaaatattagccaggcatggtagagtacacctgcagtcctagctactgaggtggaggcaggaggattgtttcagccctgaggttatatagggagctatgactgcgccattatactccagtatgggcaacagagaccctgtctctaaaaataataataaagaataaatgctactggtttttgtatgttgattttatatactgccattttactgaaatcgtttatcagttctaacagttttttttgtggagtctttaggtttttctaagtagaagatctgttgtttggaaggctaaggtgggaagattgcttgagcccagcaggtcaaggctgcagtgcaccatgattgcaccacagcactccagcctgggtgacagagtaagtctcagaaaaagaaaaaagttcactttgtctaaactgtttcttcctttccaatttggatggcctttatgtttctctcttgcctaattgctctggccagaacttccagtattctgttgaataaaagtgatgtaaataggcatctttgtcttcttcctgatcttgcaggaaaagttttccatttttccctgttcagtacaatgttagctatgggtctgtcatatatggcctttattattatgaggtatgttccttctatatccagtttgttgagggtgtttatcataaagggatgttaaatttcattgactgttttttcagcatccattgaaatgattacatggtttttgttcttgattctggtaatgtgacatatcacatttattgatttgcatatgttgaaccatccttgtatccctgacccaaggcaattttaaacatgaataaggatgaaggttttgttctacttgatgtcaaaacttatataaagctacagtaattaaaataatatgagattggtgcaaggatagaaaaagagaccaatggatcagaatacaaaccaatacaaataagagaattcagtatatagtagaggaacaattatacttcactggggaaaagatagactctttagtacataatgccagaacaactagttggccacatgataaaaactaaaattaaatctatatctcacagcatacataaaaataaatattaaaataaaaacccgtcaaaactttatactctcagaagataatataggcaaatatctctatacctcaaggaaagatttcttaaaacacacagagaataaacttcaagaaaaagatggataattctgactttctaaaaatactttaaaatgtctgtaacaaaagcaacataagcaatgtgaaatgacccgctacacacaagaatatatttgctatgcatataattgacaaaagacagtatccagactatatataattcatgaaaatacatatgaaatatataattacccagattatatatataatatataaatgccaactaaaacataaacaaaagactctatgggaaaaaatagggaaaagatattaagaggcaattaaaaaagatggctgtattgaaaacacacaaaaacctacataatccaaaccaaaaaatctcagagcaatctgtatagtataattccaattgtctgtgtgtgtggggggggaaactactcaatttatatagtagtcaggaaagagtaaattcaaaagaagaatgagatactataccatacccatcaaattggcaaaaaatagaaactctaatacaaaacattgacaaggatatggagaaataggaaccatcaaacacagtatgagttttttgaaacatagtggtttatttccactagcaaccactttggaaaacaatttggcattatctagtggtactgaaaatgtgcatataacctagcaattctactttaaggcatatatcctagggacatacttgcatatgtacccaaggagtcatgcacaaggatactcattgcaacattgtgtataacagcaaaataactggcatcaatctaaatgttccttaacaaaggttttcaaatagtgggatgctaaactaagctgtacacggagctacatgtaacaacatagaaaactactaaaacactatctgtgtgtgtatgtggtaggggggatacaatgaagacagatatatatgacaaactataaagaacagatactgccaggcgggcacagtggctcatgcctgtaatcccagcactgtgggaggccaaggcgggtggagcaagaggtcaggagtttgagaccagcctgaccaacatagtgaaaccccgtctctactaaaaatacaaaaattagctgggcgtggtggcgggcgcctatagtcccagctactcaggaggctgaggcaggagaatggtgtgaacccgggaggcagaggttgccgtgagccaagtcgcgccactgcactccagcctgggtgacaaagtgagactccgtctaaaaaaaaaaaagaatagatacaataggccaggagtgatggctcacggctgtaatcctaggactttaataggctaaggcaggcctatcacttgagctcaggagttcgagaccagcctgggcaacatggtgaaaccctgtctctacaaaaaatataaaaattacccaggtgtggtggcactcacctgtagtcccagctacctgggggactggggcaagaggattgcttgaacccaggaggtcgggctgcagtgaaccaagatcatgccactgcattccagcctgggtaacaaaagtgagaacctgtctcaaaaaaaaaaaaaatagatatgatacacaccaaattcagaacagtggttacctccgggggtgaacaaagggaaatacaaaggattatgaaagggtcatcaactatatctaatatcttatttctttaaaaaatctgaagcaaatatagcaaattttagtttattaaatctgggtagtgagcgtaagattttctgaactcctctttgaaatatttcatatttttgaaataatacaaaaataaataaatactcattgcagaaaaggctttactaagtatctcataaaaaaatagaaaccatgaaataagcatccattttctctaaataaacattttaaacttccatatagaaatgtatcataaataaggatgaaagagaaatacaaatttggggaaatatttgcaaaacagaagattaatccctgaaacataaagagctgtattgttttcaacaatgtcctagggcacaaattgctccacaaatgaatcaaatcaactttgccccctttgaaggaatagttgctgaggttactgtttgatatttcttctgatcctaggagggctccttccaactggcttactccccggttccctcctgagaactagcccacgtatagtttgattctgatgctatatccatgaatctctcccagtttcatttcaccacaacctccacagttcttcaaagtgtccttaggtttgaacttctgcatgctctgttgcaaatgcagtcagttccttcgggaagagattaagagctatctgttttatggcctaactcaggccaaacctctgagttaggaccctggagctagaggtggaaacaataacaaggttctgagtgctcagtgagttgggggacagcagcccaaggcccttcgtcacatggaaccaccatctcaggagctggggaaaggcaattaggactctagtattctctgtgtgccacagccaagatccaagatagagcttccattctacaagcaggagatgagctgaagaagggactctcccaccccccaactcccaaactctcaaatgcagttgcctgggacttggccttagcaacaggtagcaaggggcaggagagaagtgttaacagtctgctccttctgggaagcaagcccttggacttgggggaaagggagctctgggtgcttggctgcagcagtttggaatggcgtctccacttcaccaagctggaagcaggcagtgagggagacgtcttatgtgagataacacagactcccacctttcacaccaaatttcacagatttccttgagcagatgtttctttatttactctttgcccttgggactattcccaaagactaatttttaaataacgtacacaagttttactaggagtgggtcaacaaagctcctcacactgtcaagacagaagatgatgtctcctgtatcatttaaatattttatgatgagcatatatattatctgcaaaaccaaggaggacattaaaaataaaaacagagaaagagagagaaactgaaagctggtaggaggtaagaaagtaagaacttccagaacagtaagagaagcccatgctggctggtggcctccttgccagtctctgtagttccattcttctctttgcttcaataaatgaattatactctttctaataacctcagcccgtgaacaggaccttaatgagaaaacaggcacacctgaaataactccaactttgggaagcacagtggatttttccttgaatccagatgtctaacgggaggtgagtggaacaccaagagaggaatgttgtaggcaatggaaccacagtggaaacagctgtggagaactgatgaaaattatatcaaacagagcctagtgtcaggccaagcaactaggctaagaataccaaaagcactgtcttccctctttccccactcctggtactttgcagctaatctgtcttcattattattcgcctgctttaatttttaattattagtttttgagatagggtcttgttatgtttcccaggctggtcttgaattcctggcctcaagtgatccttccacctcagcctcccaaagtgctgagattacaggtgtgagccactgtacctggcctctgtttttataacccagtctttctgtggtttcactgttaccagaaatggatttctcctgaatcactgtgcatgggattcagtggatttcctgaatcagaattcatgtattttatcaatttaaagaggtttggaaaagtatcagccaaacctctttaaatagaggtttattctctttattcttctgaaactcatgtgagacctttatattcaaatcttcacatctcttaacctcttttttcatttttctgtctatgctgcactttaggtaatttcttccattctatactctagtttacttaattactcttcagctgtgtctaaccagctatttaccttgtctactgaattcctaactgcaattagattttcaacttcaagaagttctatttgtgaatcaacctaactgtccattaatgaatgaatggataaagaaaatgtgatgtacacacacaatggagtattattcagccagaaaaaaataaagaaaaactgccatttgtgacaatacaaatgaaactagaggacattatgttaagtgacataagccaggcacagaaagacaagtattgcatcatcttgtgcatacgtggaatctaaaaaaatttatctcataaaagtagagtagaatggtacttaccaagggctggggtaaaagataggatgtcgggccaggttgctggggcaggggagtattgagatgttggtcaaaggatacgaaatttcagatggacaggaggattaagtccaagatatctatcatatagcatggtgactgtagttaataacaatacattgcattcctgaaaaatgctgaggcagggatgttaagtgctctcaccacaaaaatgataacttatgtgagcaagattagtcattccagaatgtatatatattttgaaatatcatgttttacaaaataaatacatataattttatctgccaagtaaaaaaaaattttttttaatttaaaagaagttctagttgtgtcattttctaatctgtccattgtcacttttgatagcctattgtttttttgcccatacttttgataaaatcttatttaagcgtattattttatattctgttttctgtgaattttactacctataattttttaaatttttatttatttatttatttattttttcttccttttttttttattatactttaagttttagggtacatgtgcacattgtgcaggttagttacatatgtatacatgtgccatgctggtgcgctgcgcccactaactcatcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtatgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttttttttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagacagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttcattgagcagtgttttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgctgatcagcttaaggagattttgggctgagacaatggggttttctagatatacaatcatgtcgtctgcaaacagggacaatttgacttcctcttttcctaattgaatatcctttatttccttttcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattggtttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagttcctccctgtacctctggtagaattcagctgtgaatccatctggtcctggactctttttggttggtaagctattgattattgccacaatttcagctcctgttattggtctattaagagattcaacttcttcctggtttagtcttgggagagtgtatgtgtcgaggaatttatccatttcttctagattttctaatttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgaatttagttatttcttgccttctgctagcttttgaatgtgtttgctcttgcttttctagttcttttaattgtggtgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagcttccatgtagttgagcggctttgagtgagattcttaatcctgagttctagtttgattgcactgtggtctgagagatagtttgttataacttctgttcttttacatttgctgaggagtgctttacttccaagtatgtggtcaattttggaataggtgtggtgtggtgctgaaaaaaatgtatattctgttgatttggggtggagagttctgtagatgtctattaggtccgtttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgcgttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaacacagcacactgatgggtcttgactctttatccaatttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtactggttgttcctttccatgtttagcgcttccttcaggagctcttttaggggaggtctggtggtgacaaaatctctcagcatttgcttgtctgtaaagtattttatttctccttcacttatgaagcttagcttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttcttgaggagcatctttgtggcgttctctgtatttcctgaatctgaatattggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattactgataccctttcttccagttgatcgcatcggctcctgaggcttctgcattcttcacgtagttctcgagccttggttttcagctccatcagctcctttaagcacttctctgtattggttattctagttatacattcttctaattttttttcaaagttttcaacttctttgcctttggtttgaatgtcctcccatagctcagagtaatttgatcgtctgaagccttcttctctcagctcgtcaaagtcattctccatccagctttgttccgttgctggtgaggagctgcattcctttggaggaggagaggcgctctgatttttagagcttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgatgtgtcagtgtgcccctgctggggggtgcctcccagttaggctgctcgggggtcaggggtcagggacccacttgaagaggcagtctgccggttctcagatctccagctgcgtgctgggagaaccactgctcccttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagattccgtgggtgtaggaccctctgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcccgcaccgtgcgcgcacccactggcctgcgcccactgtctggcactccctagtgagatgaacccggtacctcagatggaaatgcagaaatcacccatcttctgcgtcggtcacgctgggagctgtagaccggagctgttcctattcggccatcttggctcctccaatttttatttattttaaaaaattattaatagagacaggttctcgctttgttgcccaggctggtctcaagctcctggcttcaagtgatcctcctgcctcagcctcccaaagtgctgtgattacaagtgtgagccactgcaccccatctagctatagttttaaaagtttgattatctgtttctgctgtctttcactcatagtgccttattttttatgtgctttgtgatgttttggttgtgagctcatgatcataggaagatttttgtttgtggggatgctctgaggcctggatgtgagttcctccaaagaggatttgtttctgcatctaccagtaacccagaaattctgccaatttcaaactacgttttaaaaaaaaccttttcccatggaaattttcatgtatatactaaaatacagagaatggtataataatccccatggactcttcactcagctttcaaaattatgaagtcatagctagcactattttatctataccccgactcagccacctacccacctcctcagatctcaaaataaagcataatggagacatcctatctttggtttttgttgttgttttctgagatggagtctcgctctgttgcccaggctacagtgcagtggcatgatcatggctcactgcagcctcaacttccattctcaggcaatcctcccacctcagccttctgagtagctgggaccacagaaacataccaccagacccagctaaattaaaatatttctttgtagagacggggtctccttatgttgcccaggctggtcttgaactcctgggctcaagcaatcctttcactttggcctcccaaagtgctttgattatctatgaccatgctaccctgaatgtgcctgatctcatctgatcttggaagctaagcaaggttgggcccggttagtacttggatgggagaccaaagtgctggcattacaggcacgagccactgtgcctggcccgacatcctatcttttacccataaatttttcagcatacttcttctctaaaaaggctcttttttacaaaaacaaaacaataccattttcacaccaaaaatttaatattatccttcatattatcaaatatcaagtaattgtttaaatgttcccaattatgtcatgattttttcttttttctttttttgcagattgctgatttggtcaagatgtaaacatatcgtagagctccagcatgggggctcacgcctgtaatacaaacactttggaaggccaaggtgggagaatcactcaagcccaggagtttaagatcaacctgggcaacaaagtaagaccctgtctctacaaaacaataaaaagtaaaaactagccaggcatggagcatatgcctgtggtctcagctagacaggaggctgaggcaggagactgagtctgcagtaagccgtgtttgcaccactgcactctaggcttgggtgatacagcaagatctgtctcaaaaaataaaacaaaaagtacatacattgtaactataattggctgatattcatcttaaatatcttttaatttatgggcttcatcccatctctttatttttttctcttgtatcttattttgtgaaaaagccagtaatttgcctgctctacggttttccacagtctggtctttgctgattgcaagtctattatatcattgaacctatcacctgtccccaatatttcccttaaattggacatcagatctagaagtatgttcaaattcagattagattttctatcaagagtgcttcctatgtggtgttacactgttttcagaaggcatgtcagactcagtttccttaggaaacagactgaagatctgcaggcatttttctcccttccactcaaagccaatttgccttaataattcctttttagtggaagattttcatttttctaattatttcatggcccctaagctttgtctcttgtcccctaaattatgattcctgttgaaaccaagagctcacagtcactagggaatagcaaatgttcccaggtcagctgtcaggttcagtgttttgtatctcttaggatttgagctttccattatatttgctttagaatttctctcactttcttacagggctaccacataaagaatatgacattattaaattcccctgcagttacacagagcagtggctctacagtttcttgttggctgaattaagcatttaaagaaatgtttaagtatttaatacaacatcttcaggtatttgaactaagagagtttcttgggaaatgtgctatttgatagattgagaagtctcccagtgctgttttgctttgtttcatcactcactatttaaatgttaattacaaaaataatacatactcactggaagaaaaatcaaacaaactcaaagcacagaaaaattttaaagcctccttgctcttggtggctttctttctcccaccaatttttggtgacttcaatttttgtgttagaccatttatgttcaaagcatccacatgaaacttaccctctataaggtgctgtgagcaccacagacttgaataccagttcccatgctcaagaagccttcaatcttgttgaggagatagatgaaagaactggcttacaacagagaagtagatgtattaaagagtcagttttcccagcactctgggaggctgaggcaggtggatcacctgaggtctggagttcgagaccagcctgaccaacatggagaaaccccatctctactaaaaatacaaaattagccgggcatggtggcacacacctgtaatcccagctactcgggaggctgaggcaggaaaattacttgaacccaggaagcagaagttacagtgagccaagatcgcgtctttgcaccccagcctgggcaacaagagtgaaacttcgtctcaaaaaaaaaaaaaaaagagtcagtttaggagtccaacaacaaatgctaataaagatgatgataaaacaaagaactttgtgtgctgagagttatgtaaggaagaaattaagaaggggatagtagtgaaaaaatctgaagacagccacatagaggatgtggagaaggcagaggtacatcacaaagacaaattcaagcgaaatgctgaagggacaagtttattaagcaaagtggtgcctccctccccagaatgaaggcttagtttctgcagtactcaggatagctggtcagagtcagaggtcattttccattcgtcattatttgccatttgaaaaaagtaatcagactttgaatgtagcttaagagagctatgactatccaatttcctaggccaatctcggttaatatgctaatcagtttatcagatgcaaaaggcttgagcacctctcctgtcactataagagtgtggaaaaatgagctactagagacaagaggtcagacaagtcctaggggtcacatttgaacttttattcaaacactggcatctccagtgtgtgacctcatcccaatctccaaccttctattttctgggccttcagccagtggggctatacactcatttccatggccttagattttaaagggtcaaggtgcggtatctgaatcatccatgattacatcattaataataaaaacagcaccgtccactcagcctccaacgttctctgaaaaacaattcatgtccaaggtatcaatttattcctttgtttttcatgtattcattcaataattatttcctgagcacccacccaatactaggtcctatgctatatattagagagacagcagaataaagatagaaaagagatcttatcccctaagtactatctaataagggagattaacagtaaacaggtaaccaaccaaatatataactgcaaattgagatgaatgctatgaagatcaacaggatttttttttcatttaaaagatctgagagggattttggaaatatccagatgaattcatatcaatatgaatatatgctcagttgcaagtaatggaatcatgattaacattgatcttaaaaaacaaagacatttcattacctctcataagaaaaatctggaagtagatggttccaaaatcacgaaagtggctaaactacatcataaataacccagtttcctcctcctgtctttcgcctctattatcctcctcagcatgttggctttttgttcttgtgcttctcacctcactggtccaagatagctgctgcagctccaagacagctgcagtcaaggcaggaagaagtgggtagggtctccttactatgttattataagaacaaaatccttcccagaggcttccaagcaaacatctctttatgtctcattggtcagaactgggccacatggccatctctaaactaatacacatccatagagaatgggatttccatgtttgctttagaccattcatagcgcatttcctagaactggggaagggaatcttctgcctaaacatgttgctgccctcacattatcgaggttccttagtagatgaaaaagggggaggccaggcacagtgatgcatacctgtaatcccagccactcagaaagctggggcaagaagactgcttgagcccaggagttcaagctgtagtatgctatgatcacacctgtgaagagcccctgcactccagcctgggcaacacagtgagaccctgtctctaaaaaaaaaccttaaaaaccagaaaaatggggaatgattgtctagtagacaacaatagtagaaattaaaatccacaggacttgttcactaagttaatgagaaagtgaagaaggaagtagactcaaatatcactcaaaagtttcaagcttggagaactacaatagtcacaatgccaagaacagataaaaagagaatgtgggaggaaaaatctagtttgtgaaacaataatgagttccactttcttgagtttgaggtgcgatgagacagtgtggtagaaacgtagaagaccacaggagaaaggctggacttaaatgtagacactagagtcatccacagtgaggttggattcgaaaccacaggaatagatagtaccattatgggagaaaatgaaaagagagaaggaggacaaggctggaggaatctttgtgaatagctacaattattaacagaagatagtaagatgatgatgttgccaaaaaaggaaaaggggagtgagtgattaattacaatcatccccaaaccaagggactataatgacatggcagccaagaggtaaagttccctaaggaaagtggcagccaacagtttgactgccacaaagatgccaatgatgacaaagtactcttgaaaaatttcagggatagtactcttgaaaaatttcagggacagaaaccagattgtaggaatagtagtttcaagtacattaatttaatgcccatgtgcactcatttgtattcctttctgtctactcttttttttttcccccctgacagggcctcactctgtcacctaggctggagtgcaatggtgtgatcatggctcactgcagccttgactttccaagttcaagcaatcctcccacttcagcctctcgagtagcatagctgggaccacaggcacatgctaccatgcccagctaatttttgtattttttgtagagacagggtttcaccatgttgcccaggttggtcttgaaccctggctcaagcaatccacctgccgtggcctcccaaagtgctggaattatgggcgtaagccattgcacccaggttcaaagagttaaaattaattggtaaaccctcagcaggaagagcacaactaaggaaattaagagagccaacaaagcatgaggtgagaggggacaaggttgggggagggggatacgttcattttataaagggatatatataacccaaaatctgccaaggaggttccaaggatgatgccaaggataaagggggaagaacagaaacctgttctggggatccattgtaaaagtacataatctcaccatgactaatggcacatgtacatccttttttgtactaggttcagttccatgacatcctgcaaactgtggaaagttcaaaagtactgcaaacatgaatgcttataagcccatgtaattgcatagtaattcatacatgtgcagatgagaacatgggttattaaagaaggatacaggactccaaaggtgactgaggcaggggcatgagaacagcaaagtcagtgttacatggggcaggcatactagttacttgatagtttaactcctgacggttacgaggtaaaggagatatatagggagctaagaggaaaacaaaagcaggcggctagtttgctaagaaccaaaaccagattacagaaggctgcctggcctctgaaattcacaaagccttttcgagactccccttatacagaaacacaaatgacttgtctggaactccagagactcctggtaggtcagactgcagacagacacacacaagtgccattatgagattaaatcaggtcacagaaaggccaatgaaagtatttacttgaagaaggagaaagcaggtttgagataaaagaaaaaccattaaaagacgaagctgctaaaagcatcagcacccctacccctgcatatctttttatgtaagagcttgacctgccttatatgtgggcaaaaacaggaaaatgaacgtgtgtgacccatatataagtgtgaatagtatttaaataaactttatttcagtggtcatgtaacatttagtagtcatgtcaattacatttacatgtactctctcttctcgatcttggaataattgcttcatgtttaacaccaggaaatagatctcttcatccacacaaatgtatatcaaaaccttattaagcaattaacccaagcaggcaaataaatgccctcaatgaagcagcaggattagcaacaagagaccggacatggtggctcatgcctataagcccagcactttgggaagccaacatggacagattgcttgagtccgggagactggcctggacaacatggtgaaaccttgcctctacaaaaattataaaaattagccagatgtggtgccgcgtacctgtagtcccagctacagagatggctgaggtggaaggatcacctgagcccaggaggcagaggttgcagtgagccaagatcgggccactgtactccagcctgagtgaaaagaatgagaccctgactcaaaaaaaaaaaaaaaaaaaagggtagcaccaagagatacatggtagaatataagcgacttaacagaagagaaaatgaggaagataaaggtttttattgcagaaagaaaagaaataagaattactatagcagaaactcatagtataaaggacacatcctgatgagggggatgatattgataccatcttgtcactgacaggtgctttacaaccgttttcacaggtcattgtatattatttgatactcactcaattttatgaaatgcagagaacacctattattgttccctgttaacgtaagaaaaaggtgaggcttagaaaggttgtccatgggcacacagataggaaatagtagaaactaaacttgaaactagattgactgtaggtccagtggtctgcctaatcctcctaaatacccaaacatctggactgactgagcagtattcatgcccatcagcagaaaactagaaagaatatcttctagatactatccccagtgctaggactccatgattccagagtgctcactatcatctgaacaccctcttgataaagagcaagctcatcccatcactgtgttgtgtatttgtgcacatgtgtggcaggtgtatacacacctgtatactagaagcggttacagaggtgcagagccaatacttaagacatgaagagtaaatgatgaatatcagactagagtactgaaacctacctctccatgtagaaatatccttaccttgcatcaagttcctctttgcagaaaacattgacatttccatggtgtttgggagcctgctgttggcttccaaaagctctggcgccataccatgctgtcacggtaacagccctccagtgagccatcaaaaacctagctagaacattttgaatacagcagtttgcttgccaccaaaacactaaattgcaatattttatatttatctctatttaaattttagttgatgctgcataaatgttaacatggtcttaagctaatacaatcacagaaaagtcttaataacaccacacattggcacagcccctgggtgagttacgggtctgcaaagcaggcccaacgcatgtttctcaagtcacttaattagtcccctttaactaggatgtgacatgaaaatgctacacagtttcccccaagtaatgtatttccagaagcaacggcaagggacgtataggataatttgttcatattaaaggtagaataaaagtactcgggagtaaggcaaagatttccaaaaagggtctggagagaggttaataatgttggatttagttcttttctggcctgagaagtaaaaagtgagctttagtaagttctcaagcctctaaagccttataaggctaagaccctggatttcctggacttcctcatgactgaaaccgcagatactaacgtcaaacatgcagattttccatctttccagtggctgcacaggaggagatttccctgggcttcctgggagactttggttctgggaggtgagaccaagggaggtggagttgcccttgaggccagagccttgactgtcaacaccaccaacacagggagccagggcttgaagatccaggcagagtggtgataacggaaacaaaggccggcagtgcctctcctcatggaacaactcctccagctttcccagctctgcccttcaacttactaagaaaatatgctgaatgcctttcagagtgagagagcatcagactgagattctgatttaaaaaacaagcacagataaagcacaaaggaaatcttctcgaaacaaagcctataatggtaaatatgttcagaatagcttttctcctgtaacatcgtgacctgcatctaagcatctaatagcctccacccatgcccttgcagcaagaatcagaatatttgttcctgttttaaaggcacaaatggtcctaagagcagattttcaaaaatgggaggaacaatagctccaatggaccaattgcagcatgcagatatcttgacctttgcaggtggtgtagaatgatgtggtgcctacatatcttttggcatctactctttcgagatgctacctccccactcctcttgccttatcagtcttccatcacaagccagactaactgaaattctcaacaatttccaacctagagagggcgataatctgacggcatgtacattggttccagacaactagggcaagacacattcctccctgaaagcacccccttggtcaggctcatcatttattcgtcactagatgtagctttactgccaaaagacctactcttgtttattcccctccctctctactatttatagttggtctaactttttacaagctttgaataaaacagagaatgtgacctaagatgtgttattaaatgtccatacacataagatgggggaacagagagtcacagatggtgacaacatgggtaaaaattcctatctacttggaataagggcagaatcaaattttactctagtttcattgagatgacactgaaatgtcagtagcaacaggcacattcaagtgtacccttcttccaagcagatcaggccaagcaattctggccattgggacgtccattatactgctcacctggaaaaggcagcgcccagcacaaacgcagcatactccttcacgaggggctctgtgctgttcagcccattgatcaccacttgaagaccaccaaaggaaagcaggtcctgcgcattgtccatctgcaacagagccactgcttagtacagcatagccatcagggacaggaaagctgttcttagagcctttcttttggtgactacccaaaaacaaattaaaaagccatggaaaaatcaataatggcctttttgactaagaaaaggtttgtaaaaaccaattttttaatactcttaaatttgagaactcctaattcatctaacacgattgatgagcacctgcgtgggaatcagcagaaatgacacctagctattgcttatgccaaacatgtcctggaaaattctaatatcataatgagtcacaaagcttgctcctaatgtacaagctgttaacacaaagaatctggcgtcatcagcaccactaaatggtgccatgcttcctgctgatgtccaatcccaatggggacagtggaggcagatttttaaagctgattttaaattagaagctagggactataaaaggagccctgttattgggaggggggttgccgtaagagtgctggggaggggggaataacaatagtacctttctcttgcatctcaggttgactgcatctgaagacattcatgataaaatatgcaagaaaatcgctctcccaaaggtttctgtctaagcctgtgctactggctagtggctatgtatcagacagtgcagaacatttctatcattacataaagttctattcaacagcattggtctaggctatcatttaagctccaaatccccaagtccggattctctcttttactctatagcggatctcattacccacagtttattagtaccctggaacaagacaactcgctttcctcagaaaggtcactggatcctgttttctacatgtacccgctacagtctccctcgaatatatctttgttgccacaaaggctgcatcttgcccatatgctaatcccacgctatcaatcatgaggaaaactcaggaagctgaagcccaacaactgtggctgctacccatctttctcctccagattccacagggccccttcccaactgcatccttgcctctctgaactaggagaggactctgacagagaaatcaagtgtgaggattggtatttgactgtgctagtgttttgtggtggcctagcctgttgttgccacttgaaaaatcatattcatacacatttggatggaatctccatgacagcaggggttttgtctgtctgtccacgcttgtagctccagggactaggatggtgctgagcatatggttaggtgttcaatgaataactgttgcattaatgagtatgaatttgatcagaaaagaatgttcctgaaataaagctccagtgtgaataaaaaggcaatctggggtatctgtgccaacaaaatgaatgggcctctggtaccgcagacatgaagtaatggctaaaccaggttgtgaagtaagcatgaagtctgctctgccatgtggccccaggccatggacatttttctgccccaaactgttcttatgaagaggaataactggttgagccacagcccagctaactagggagactcagggttgggtgctttgctgacataagcaccttccttccttccctacatgctctaattttacaatgtaagaattcactacctattctttggttgtccttcctctgggttttctggatacaaaactatggctcagaatcctgtcataccacgcctggaatggccacttataaagctggtatgagttcctagcagagcagctgccactcggtcagctccaaagcaacacagcccagaatcatggaccttctgttctagagtcagtttatctactattactacaatgataattcagcatgatagaaatgcagacatttatataagcacttcagcctttttgggatgttttctcatggtttacttcactaacagtgaggaagaaacgattcattctgcccagtgcacatcaaaagctgggcccccccctggtgacatacaggagaaaccatgaccatagcccaggtccacagctccccatctcggtctggggccaaaactgttctcaggctgccttcggggtggggtgggacaggcagagaggaagaggaggagggagtgcaggagggaactatgccaacaccctggaggaaaggaaagaagcagggcactgataagacaatgagagaatgggaaacagcgaaggggaaaaatggtggcacacagctgaggagacacgtgggagaaggcaaatgtactgcccgaggtagatggggcggacggaggccgctcctcataaataactcaccatctgtttccacacacaaggttttgcttttcacatatcctgtttaataattcaaatatggctgtgaggaagcctggcagacctggtttgggtccttggagcctacagctcctcaaaccaccattcagtgagtctggaatgagaaaggactggggaagttcctggctaggaaagtgccatcttccttaaaactagtactacatcaccccaagcccccatcacaactgggactcgggccgagttgtgtcttacttaatcccccagtgaaatcacagcttaacattgctgcatggcagcctgatgcaccagcccttccagtcaaaacaccaatgatccagaacatttctctgccaacagacaaatttggcttctgccagggactgattttgggatgacctcaggatgggtctggtgaggtggcctgtgaaagcagaatggggatgtcaccttagggaagacactgccaagtgacaaagagcctacaagggaaaacaaagaactttgttggggcaatgctagcccaagcctcctgtggactcacacccttccaggtatgataagctctccagtcattttggtgtttcatgtgcaagagcccatggtgacctgatacctaaagattcatccaaatatgttaagatgagaaaaaatagaagctgtcaacatcaaaggaggactgagttggcaaataaccccttatatccttaatcctttaaatatctctaatggaaaagctgttggagttcttggtttttaccctggagagtaagactggaaaggggaaagagaaccgaggttcattttttttctctaagaggatcagagtcctgctatttgaggcctgagaaagagttatgagcagagaaagaagatgaagaggctgccccataattcctatggatacagtgcatactcatcctctttcaccacagatgctggcaaaatcctaaaggaagaaagcatgtcttttagcccagtttacagagaacaagggcactgtcgtgcatggtgcatgggaggacattgaggatctgtgtcttgacaaggatctcaaacaagcctttgattatgattacacagcctcctgggccactgttgcccctagtctggattactgcaatagcctcctatctggtctctgcttctaccaagccccccacctgcagtctaattctcaacacagtagctggaggaatccttttaaaagtaagtcagatcacatcattcttctgctcaatatccttcaataatatgcaagttcactcttttccatggcctacaggccctctatattcttcctcccattatctctctgagctgtatgtacttcttctctgcctgctctcagctccagctgattcaaacacactaggcatgttcccaccaccgggcttccacacttgctcttcctccagccagagatgccccttctcaatgctgccagttcctatctcgccatagtttctatttttctacagtatttattacctacaaacatattacatataattacttctttcttatgcttgtctatctgcttctgctagaaggttaagccctaattttgttcatagacgtatctcaagtgcctggaacagtgcctgggagttagtagacacttgatttatttattgaataaatcaatggcttttattggctccttgttagctccaccttttgagcttaattcaaaaggtaccagttgcctttgagaaacagagtggccaaaagttttagagcacagagtttagggtcagacagaccttgctgcaaattccagctctaccactcactaggctggatgatcttgagcaattacataatctctctgtgcctcattttcctcggttataaaatgggattaatagtggtacctactcatagggcagccacggaagtcaatgaattaatgcatacagagcacttgaagcagtgcctggtatatgacaacactcaacaaatattagttattataagtctgatcagttacttccctgcttcaaactctctagtggttcttaggatcaaggctaaaatcataaagagcatgatatctccaacctcacctctccagcccccgaaccttcccacttcatctatgctcccctccaggccgctgtgctccagtcactccaatcttttccaggccctcaatctccccaagcttgtccctgccctagaatctctgcacatgttgtttcctctagctggaatgctctaatctaaggattggcaaactttttctaaagggcctggtagtaaatatttttgactttgtgagccatatggtctctgtcacaactactcaattctgccattgtggcataaaaacagcaataaacaatgcatgaacaaataggggttgctgtgccccaataaaattttatttaggaaaggaggtgttgggccagatttgacctatgggcagtagtttgccatcccctgctctagtcccccctcttcacccagccaaccccaatcatcctataacgcttggcctaaatgtcacatcctctgagaagcctcccttattgtccatgactaggctctaagttctccagttacatattcttacatcaccctctggagccctcattacaatcttaaattatctcattatttaattaatttgttcaattgttcattattcaattacttcctcttccaggctataagctgcataactaggactatgtctattttatctctgtggtaccctcagaggtactaaagaaggtaccactccacatgaaaaagaggttggctggccaggcatggtggctcaagcctgtaatcccagcactttgggaggacaaggtgggtggatcacttgaggttaggagttcaagaccagcctggccaacatagtgaaaccctatctctatcaaaaatacaaaaaattagctgggcgtggtggtgcacacctgtaatccctgttgctcggaaggctgaggcaggagaatagcttgaacccaggaggtggaggttgcagtgagccgagatcgcgccactgcactccaggctgggtgaccgagtgagactctgactcagacaaaaaaagaaaaagaagttggctctggcctctaagactgtatcttactacaaaagataacaagactagattaaaaatagtctgtgctctgggagagaagtaaagatgttgatgctattttcttagggcttagggaagggggatttatttttggagctgttaaaagtctgacttatggacgaagaaatacagtacctgatggacataatattcaagatcaaagagcgcagcaatcttctcttccaaactggagctggaactattgaacttgttgatcagccgtaccatgatctgcatgtcagtctcaatgacaacattcagctcatcaaagtctttcttcagttcctcaatggggcggaagagccgctttacctcagcctgccttgcctaaggagagcagcaaagaggtgattaaattggttggagacatctgcccaagatgtctgtggtctaccatggatgcccatcctcaaaaaactgctgctccaagactcacagtcttctctcatctatgctatcaaaaatactaatactttctaagatgcccagagaagacagccctcaaagtctgcctatataggcctcagctctaaaaacacactcaagatgttccaagattcgcttattcaagtccgatttccaatattcaggaagaatagaaaggctttttgtcacaaccactgagttaaggggaagtaatgcaagttcatcttcaacctcaaaccacatatgaaacagctgagacctaaggtagaataacccacaccctacttctccacttctcacaatcatagactatcttggccttgccctacccaatccaacaacattttagggaaacttggacatagaaaactatgggtaagagctgtcacagcaggagcaatttgctgatgaaaattaaatcactgtcattactgtcaatctaaccacaggtgtacaatttgttcaactgtttgaaatggctaaattactatatgtactatactcaaatctcgaacaattttctctgaatccttccccactccactcacatataaaaactttaaaaatgaagttacattagaggtgaataaaagactttaattaaatattttatacatgtgacactgttttcttcccaatttgagaagatagtgcctataaagagagtctgaaaagtcacagtggcttatgtatctgtcttccaagaaaaactaaaaggcacagatatttataaaaagccggatgatgaacagctgtcagctccaaattgctcatctattacctatgggtttttctccccagttacaagcactccatagaaacaccaaccaaagaaatgaatcagcctctcttaaaaaagaccaagctcctagcggagcaatcacatccatggggcgccacatcctgattctctgggctaaaataatatgagatactctccctgcacccagctagaggtctctggatggctgccaaagccaagcaaagaggtctgggaaggctgagtcactttctagaactgtgagatgataggcaagtgagcacaataagaaactagtgacatctgtctcacaaaaacgatgtgtgcctggctctcaagaaggcctcaaaaaaaaaaaaaggttttggccgggcacagtggctcacacctgtaatcccagcactttggtaggccgaggcaggcagatcacgaggtcaggagttcaagaccagcctgaccaatatggtgaaaccccatctctactaaaaatacaaaaattagccgggcatggtggctcacacctgtagtcccagctactcgggaggctgaggcaggagaatcgcttgaacccagaaggcagaggttgcagtgagcggagatcgtgccactgcactccagcctaagcgacagagcgagactccatcacaaaacaaaacaaaacaaaacaaaacaaaacaaaacaaaacaaaacaaaacttttactttgaaataattataaattcccaagaaataacaaaaaatagtacagagagtgtcatgtacccttcatccagcttccctcaatgttaacattttacataaggatattacataaggatacaatgtcaaaatcaagaaaaggacacaggtaccatactgttaactagactaaacaccttgtttggatttcaccagtttttacatatactcacttacatgtatgtgtgtatgtgtatcattctatgtaattttacctgagatgtagacttgtgtaactaccagaacaatcatgctagagaactgtcccaccatgatcacataatctactatgtactactcctttacagttatactttatcctcccatgctactctcttacatccctgtgccctggttgtcactaatttattctccatgtttataattctggcatttaaaaaatgttatatacacagtggttcatgcctgtaatcctagaagtttgggaggccaaggcaggtggacaacttgagctcaggagttccagaccagtctgggcaatatagtgagactctctgtatttatattttttaaattctatttttttaaacagagaactggccagcaaagatgaaagcgcagcaaataaatgaaaggtggtaactttggcaatgaaatttgaattgaatgtacatggagttatagaagaaatggctgactgtgggaatgttaacactgccactgttgatgagctctagatgtgcagacagagggactcagcaaaggcaaacttacagacacaaattaggaaagtgataaaaaggatgaaatgacactggcaaaaaacttcacattacaggaactctctgagaaatttcacaacattgaaagtacgaagggtgaaatgttggaggctcatccatacttagaaagatgtatgataattagccaagagagaaaagatgcttgctctatgtcataatttttttggagtcagggtctcgctctattgctcacgttgaagtgcagtggtacaatcacagctcgctgcagtctcaccctcctggactcaagtgatccttccaccccagcgtgagtagttaggactacaggcacaagtcaccacgcctggctaaaatttttagttttttgtagacatggggtttcgccatgttgcccaggctggtcttgaactcctggctcaagcgatccacccacctcagcctcccaaagtgctgagattacagatgtgggccaccatacccagccaagtttttagttttctgtaaaaactaaaaattttagccaggcatggtgatgtgtgcccatagtcctaactactcaggctgaggtgggaggatcacttgagtccaggagggtgagactgcagtgagctgtgatcgtaccacttcaacctgagcaatagagtgagactctgactccaaaaaaattgtgacacagagcaagcatcttttctctcttggctaattatcatacttctttctaacgagattaggttataattagattataatctcagcactttgggaagctgaggtgggtggatcgcttgagccaggagttcgagaacagcctaggcaacatggcaaaaccctgtgtctacaaaaaacacaaaaattatttgaattttttggccaggcgcagtggctcacgcctgtaatctcagcactttggaaggtcaaggcaggtggatcacctgaggccaggagttcaaaaccagcctggccaactagagaaggtgaaattagagagaagatgaaaccccttctctgctaaaaatacaaaaatgaccaggcatggtgacacatgcctgtaacttgggaggctggggcaggagaatcacttgaacctgggaggtggaggctgcagtgagccaagatcataccactgtactcccgtgtgggcgacagagcaagactctgtctcaaaaaaaaaaatgtattttttggtgtggcatggtggcacacacctgtagtcccagctacccgggaggctgaggtgggaggatcacttgagctgtaatcctgccactgcactccagcctgggtgacagagaccctgtcaaaaaaaaaaaagcaagaaagaaaaaaaaaagaattcttttttttggggggtagaaaaaaactattttttgtagaaaacatagaccatttccgggctatgttgcccaggctagtctcaaactcctagaatcaagcgatcctcccaaagtgctaggattgcaggtgtgagccattgtgcccggcataattctaaatgtttctaatgttttaaattacagtgtgctaaataaatattactattgctttttcatttctatatatacttataaccaatagcaatgtagttgctttaatgtctggcaaaacatttcaaggatcatggaacaatcataatttttcccttgattatgttaagattgttttgcatagtttcagtgtgcacattttcacaattccacataacataaaatgaggactgctggtatatgatatgcaaatatttccttccagtagtttatcttctgatcatcttaacagggtatttgacaaaacaaaactttttaattttggtgaagtccaatttatcaatttttttcttttataaatcttacatttggtgccatgtcataagaactctttacctggtcctagttcccaaagatgttctatgtttcattctagaagattttttttttctttttagtttcacattttacatttaaatctatgatctattttgaattaattttttttaaggtatgaggtttaagtgacagctcattttttgcttatggatgcccactatttgctgaaaagactatttgtcttccattgaactacttttgcacctgtcaaaaatcagtcagttgtattagtgtgggtctatttctaggttctctactctgttccattgatctatgattctttctctccaccaataccacattgtcttgattactatagctacagagtaagccttaaaatcaggtggtgtgttttcttccacttattcttctttttaaaattctagctattctagttccttcaactttccatacaaactttagaataagctcatctacaaaaaaatcctgctgaaattttgataggaattgcactaaacttatacattcagagagagttaacatttttactatgttgaatgtttcaatccatggacacagtgtgtcactccatttaattaagtcttctttgatttaactccatcatcatctttcacccaacttttatacttttgagcatatagatcttatatctgtcttgttagatttattcctaaatatttcatttttaggggagcaactgtaaatggtacatatgtttttaatttcaatttccaaatattctttgttagtatatagaaatacaattgatttgcattgtctgtatatcttgtgacattgctgaactcacttattaattctagaagacttttttttggaggctctttgggagttatacatggacaactgtgtcatctggaaaatgagatagttttattttttccttgccttgccttactgcattggctatgactgtgttgaatgagtggtaagagtgaacatccttggcttgtttctgacctcagtggcaaagtattcagtctttcactgttaagtataatattccatgcagactttttgtaaatgcttgttatcaagtaaggtttctattcctagatttctgagttatcatgaatgggtactgaatatggtcaaatgctctttgtgtattaactgacataagatgatgtgatttttcttctttagcctactgatatgttgggttatactgattattttttgtacactgaaccagccttgcattctggtaataaactccatgtgattatatataatgcataattctttttacatattgctggatttgattggctaaattttggtgaggatttttgtttccatgttcgtgaggaatgttgctatgtagtttattttgtactctgtctggttcaggtattagtgtgacactggcctcataaagtaagttgggaagtgttcctccctcttacattttctggaacaaactgtgtagaattgacgccagtggtttttaaatgtttggttaatatctccagtgaaactatctgaacctggagacttcctttatagaaggtttttcactacaaattcaagtttttttaatggttataggactactcgtattatttcatattgggtaaatttggataatatgtgcttataaaacagctggactatttcatgaaagttatcaaatttatatgcatagagttgttcatagtattctcttactgtattttccttttaatttctgcaggatctgtaatgatattcctggtttcattcttgatacaggtaatttttatcttagtgctttatgtgtttgtcagtcttgtggattttttgtttttgtttttgttttgttttttgtttttgaaacagagtctcgttctgttgctcagactggagtgcagtggtgcaatcttggctcactgcagcctctgtttcctgggctcaagtgattctcctgcctcagtctcccgagtagctcggactacaagcgtgcgccaccatgcctggctcattttttttacttttagtagagaaggggtttcaccatattagccagactggtctcgaactcctgacctcaggtgatctgcccacctcagcctcccaaagtgctgggattataggcgtgagccaccgtgcccagccatgtttgtcagtcttgatagaagtttatcaccttttggtttcactgatttttctctactgttttcatgttttcaatttcattgatttctgctctttatttccttccttctgcttgctttgagcttgtttcgatcatcttttcctagtttcttgaagtaggaccttccattataggtatgagaccttacttcttctctaatataagcaaatttcccttccagctttagttggatcctgcaaattttgataaagtgcattttcatttttaatcagttcaatgtatcttttttttttaacctcccctgagatttcctctttgacttgactggagattttcttcctatctatgactggtttctagtttgattccattataatgagagaacatactctgcctaatttcagttcttttaaaactgttgagatctgtttgattactcaggatatactctattttgaggagtgtttcatggacacttaaaaagaatgtatattctgctgttgtagaatggaatgttccataaatgtcaattaaatttttctggttgaaggtgttattcagctctttaatacccttactgatccgctgtctagtagttctagcaattctgagaaagggatgttgaaatccccaactgtaattgcggatttgtctgtttctttcttttagttctgttagtttttgcttcaggtatttttatatacaaataaaagtggtacatacacatttagaattactgtatattttaatggactggcccttttatcattatgtaaattgctcttgttcctaataatttcctttaatctaaagtcaactttgatattaatatagtaactcctgctttttaattaatatctgtatgatatgctttccattcttttactttcaacctactgtctttatcattatatttgaatttcttgtagaaagcatatttttgaaattcatttaaaattcattatgaaaatctgtttaattggtatatttagaccaattataaaacattttacaattattatacatttatgttttaaggtaatatttttatatgttagagcttaaatacaccattttatttattttttttgtttcctccagtttttgttcctgtttcccatttctcaccttcctgtgacaaaccaaggtacattttatataattcctttttggattacctatgcttttgagtgtaactgtttgtatagtttttaataatgattgttctaagtattataatatacataagtaacatcataatctactggtatcaatgttttatcactttgagtgaaatgtagaaaccttacctccaattatgtttaatcctttcttcctcctaattgtcttcaaaattcctcactatacattcagaaacagatcttgtcataatttttgcttcaactatcaaacaattttaaaaactcaaaaacatatgcatgtgtgtctttataacagaacaatttctattcctttaggtatatacccagtaatgggattgctgggtcaaatgctatttctgtctttaggtctttgaggaattgccacactgttttccacaatgtggaattaatttacactcccaccaacagtgtataagcattcctttttctctacaacccttgccagcatctattattttttgactttttaacaatagccattatagttggtgtgagatggtatctcactgtggttttgatttgcttttctctaatgatcagtgatgttgagctttttttcatatgattgttgcccacatgtatgtcttcttttgaaaagtgtctatgtcctttgcccacttttcttttagttgtcaaatgaacctttattgaaatattttcctttgtgcttaactagctgggcattccactgcaccactgttgatgtcatctatgatgtcatgaggtgacggccatcaacactgcagcccacaaactgagcagtccccaggatctctttaatggttctagagagttctctggctaaagattggtgccgcatctgtcaagtaatgttgacaatctcatcacaagtgatatttccactgtgtttgatgtttttccatttctttctgtcccttggcagttccttgagggctttgacgatcagggcagaggcagaaggcactgcctcaatcagggcctgtctgttctgaatggccagtttcactgtaatcctcagacccctccagtcaccggctgccttggcaatgtcatcaccaacctttttcggagacagacccagggggccaatcttgggggccagtgccagataccagcaatgatacctgtgccagcacagacatggcgcccatttcaccctccgtgcatctcaggtatacaactttttttttttttttttttttttttgagatggactcctgctcagtcgccaggctggagtgcagcggcgtgatcttggctcactgcaagctccgcctcccaggttcacgccattctcctgcctcagcctcctgagtagctgggactacaggcgccaaccgccacgcccggctaattttttttgtatttttagtagagacggggtttcaccatgttagccagaatggtctctatcttctgacccgtgatccacccgccttggcctcccaaagtgctgggattacaggcgagagccaccacgcccggccaggcatacaactttgatgtcgctggggtcaaacttcagcagtttgcccagtttgtaatggggttgtttttttcttgtaaatttgttcaagtttcttacagatgctggatatcagacctttgttggatgcatagtttgcaaaaattttctcccattctgtaggttgtttattgatagtttcttttgctgtgcaaaagctctttagtttaattagatcccatttgttaatttttgcttttgttgcaattggttttggcatcttcgtcatgaaatctttgcccatgcctatgtcctgaatggtattgcctaagttgtcttccagggttttcatagttttaggttaagtctttaatccatcttgagttcatttttgtatatggtataaggaaagggtccagtttcaatattccgtgtatggctagccagttatcccagcaacatttattgaatagggaatcctttccccattgcttgtttttgtcagatttgtcaaaatagcaaacacatggaatcaacctaaatgcccatcaaagatagactgggcaaagaccatggaatactacgcagccataaaaaagaatgagatctatcccttcaagaaacatggatggagctggaggccattattcttaacaaactaatgcaggaacagaaaaccaaataccacatgttctctcttataagtgggagttaaatgatgataacacacggatacttagaggggaacaacacacactggggcctattgggtggaggatgggaatagggaggggatcaggaaaaataactgttgggtacttgggcttaatacctgggtgatgaaataatctatacaacaaacccctatgacacaagtttatctatataacaaacctgaacatgtacccctgaacttaaaagttaaaaattagaaaataaataataaaaactcaagaagaaaaggataggctgcattttccctattttttattcattacattgttctttctttattcctgatatttcaagtttctttctattattcttttttcattctatttggagaatatcctttagtcattctttcagagtaggtctgctggtgagaaattttcttaattttcctctctctaaaagtgtcttgacttccctttcactcctgaaatatattcacggctataaaattctgtgtggacagttcattttttcccccagcaattgaaaaatattccacatacttctggcctctatggtttcagataaaaaattcaatatcgctcaatcattgttcccctatagttgtgttattttttctagttgctttgaagatttttctgtctttagttttcagaagtttaactgtgatgtatcttggtgttgatttctttgagtttatcctgtctggagttcacctggattcactggattcactttatgaatctgtgagtttatgcctttcaccacatttgggaatttgttagcccttgtttcttgattattttctagccccatattctttctactctccatctggaattccaatgacacaaatgttagatcttttgttacagttccacaggtccctaaagctctgttattttttttctccaatctatcttctctttgttgttcagactgtgtaatttttatttatctgtctttaagtttactgattcttttctctgtcatctctgttctgctactgagcctatctggtgacttttaaagttttagttattatattgttcagttctataattccatttggttcttttttcttatcttctgtttccttgctgagactttgcttcaagggtgctcataattgcttgctgaagcaattttataatagttgttttaaaattcttgttagatgatttcaacttctgagtcatttcagtattagcatctgtctcagtcttctcaggctgctataacaaaatatcatatactgggcagcttaaacaacatacatttatttctcacaattctggatgctggggaagtccaagatcaaggaatgagtcgacgtggttcctggtgagggtcccctttctggcttacagataatcaccttctagctgtgtcttcacacggtagagagagagagtactggtctctcttattcttctaaggacattaatccctcttgagcctaaccctcatgacctcacctaaatctaattaccttccaaaggtcccacctccaaacatcacattgcagggttagggcttcaacttataaatttgggggagacacaaacattcaatccataacagcatctgttgattgtctaattcaagttgtgattgtcctggttcttggtatgaaaagtaatttttaattatatcctagacattttgggtattaagttatgaaattccagatcctacttcatctttttcagtaggtagacatcctatttaggcttagtatactggttctggcttacttgtgtgggttgtggctccaacaacaatttagttttcagagcattgtagtgctattctggtctgcttcctttgtgtgctacccagaggccaatctaaaaacctgggcagcattccacactatagttcagttcctaaactttttgttgtattaattctggtcagtttcttgtatgggtcactgaacgggtatgtctaggacttcatatgcaaaatccctttctctagctctcctctctcccaaatcgtacccctactctctagttgagaagggaaacaacttcacctgccaccactggatgctggccactgggagtggaagtctaggttcctccctgggcctctactgacaccactttggcgggagaatcgagcactgtttcactgctgctggcctgagggtggaagttcatacttctcacttattccactggccccgccccagagagggaagcagaatgctgcctcacactgtctcactgcctccaagttgggggtggaagtacagactcttcattcaccccaacagacaccatgttatcagggaaaagtaaaaaaccatgttggtgctaccaggcagaggacagatattcaagttccctgcttagcctctgctgacaccactccagcaggataaacagcctgctactgtcagatgggagatggaaaatcagggtgcacacttggtctgttggtaatacaccagcaggggaagcagagagtatccattgggcagaggatgaaaagtcaagctctctgctcagctcccactgacaccatcttggtggaggaagcagaacactgccttctaccactttttactgccttctaccactttttgctgccaggagcagacgtgagttcaggccgtccacttggctcctggcgaccctggtggaggaatcagagtacagcttgctactaccaccaaatagcaggcagaaatccagactccccacctcaatgtccactgcactggcactaagtggggtggggagattttcattatctttggcaggagttggacaggtattgtaaataaggtttctatcctgttaggatgccctttgctcaattctttgtctagaaatagcaggcttttcttataactttttaaaatctgcaccagttgacattttcaggatgtgggatttgccaacactcagtctaaaatatatagaggacaaaaagaaaatccaaggaactcactgatgtcattccccaagctccaaggtccctagccagtctgctgccttctgactgtgttttagagtcttcctacatttgcctttagtattatgtccagggtttttagttacccttagctgggggaatagggagaaataagtctattacatcttgccaagaatcaaaagcttaaaaaggccatatcttaaaaaacaataatttgtagaatacaggtgaacaatagcagacataataaaacataaaagcatcaagcaatttgtatggaaatagagggataagtagacgagattcaaccataacaaccaaatctgctgggagagacagcttttccaagaaccaaggaactccgggaaagactgattcacttaaacctaccaagctaccgatggatacaatataattgatgttctcgtccccaaaaacatccagttcccaaaaacccactcatttaattaagaggatatggccgaatatctgacagtattgtctatataaatcacaaaagcaccatcctgtactaacaagacaccacataggctaggtttaaagattaataaacaaaaataggatgatatctgtagccaaaagcttgatatatgtaagaaactccccaaccaatttcaaatccatttatttgccaatcccagtgccagctcgatgagcacattggcagtgagctgagtcagtccagataggctccaaatgaaaagcaggagaaggatgccaggacttagcacctcagtgatggtgctaacaacctaagttccacataagtaaggaaagagtatgatagccagacctcagaggtgtgcagctggtgcaaatgagctggagcttgggtcttgcatttgggtgctgatattgggatccccttgcaaggggagaggagtattttttcttttttcttttttctttttttttttttttttgagacagagtttctctcttgtcacccaggctggagtgcaatggtgcaatctaggctcactgcaacctccacctcccggtttcaagtgattctcccacctcagcctctggactatctgggactacagacacataccatcatgcccggctaatttttgcattttcagtagagacggggtttcaccatgttggccaggctagtctcaaactcctgacctcagatgatccacccgccttgtcctcccaaagtgctgcacccagccgagaggagtatttttaattacaaaaaccagcaactaaaacttttaagtaatctcttggttatacattttgaaatacttttataaatattcatacttttctacactaattgaattactggggtggggggaaatgccatcacctgagaaaagaaaagccaaacacactcccagggaaagcaaagagaagagaacaaggttaagtgggtcctccatccacagagaagacgctgaataggagctgtttaatgttcccatcagtcccacatggaaccgacagtgggtgggaaggagccaaagccctggccagtccctgtcctaggcacccaggcactcctctgctggcctcacctgtaccaggcagaagatgtgcttctcctcagccccttggctaatacatctgtggtaggacacaattgcgagcattgccttccttcacccactgctgctgccaccaagccacgtgccctcccacaccacatacactctccgtgtaggagaagtgactttggtaagatgagtaaagacgtggagactgagcctgcatttcacacttcttaaacaggtaaacaccagtttcctatcccccaaaaaggttcattttcccagaaatatttagttctaaaggatcagaacaacctatggcttcttccagtaatacacaagctgtcaagaggctaatgctgtctctctaggacattacctggattcaggggaaggagtgaagaggtaaataaaggcaaatgagtgcccagcacggtggttcatgcctgtaatcctagcactttgggaggccaaggtgggcagatcatttgaggtcaggagttcgagagcaacctggccaacatggtgaaaccccatctctactgaaaacataaaaattagctgagtgtagtggcaagcacctgtaatcccagctactcaggaggctgaggcaggagaatcgcttgaacccaggaggtggaccttgcagtgagccaagatcgtaccaccgcacaaacaacaaggccatctgggcgacagagcaagactccaactcaaaaacaaaaaaaaaaaaaaacaaaaaaaagcaaatggggactgtaaggagaagagggagggagaacttaggtctctaaggcagccatcagagaaggttctttcaaaaactgacaggactcaaacagaaatacagagaaatgactccaagagctcatgatcttcctggtatagacctgcacctgtgagccctcccagacattaggggcatggccaaggggctgtaattcttcaccttttcctcctctcattcccttagcttgtagagaaatttagagctggaggaaacctcagtcatcctcttgttccagccccatgttttaaatttaaggaatctgaagcctagaagaaacacatttgctacatgttcaaaggacaaggacaaggattccggcttcttgcttcctgggccagctcctctgttcttttggaacaagcttgtgtctaatccaagtgtaagtgaggcagagatctgggccataaagtctactcactccactcaggcctgtgataatggagagaatggctacccctgctcagtgcctcaatttctccaaacatggggagctgtttgaagacatgggatggcaaatagaattctaacctaaaccatgacagaaatgctcccagcactttttttttaatagtctaaaagggtttcttatttgtcattaatgttctttaaattattttacaatattgttatcccatgtttattgcaagagttcccataaaaatgattccattctctgcaaagacaacaaggccatgctgcaggcttatactcacaggaaaaataatcacacaccttgtcttcctttgaactctccatctctgccccctccttgaattttgccagtgcactcttgagatcctgagatgtgtaggtgttggtgttgatatccagcctgtccaaagaaaactgagagtaaagagggaggcatggctaggcttggtggctcacagttgtaatcccagtactctgggtggccaagatggaaggataccaagatcccatctctacaaaaaatttaaaaatattagttaggatgtgatggtatgtgcctgtggtcccagctacgtgggaagcaggaggatcacttgagcccaggggttcgaggctgtggtaaactatgattgtgccaccatactcccacagctgggcaacagagtcagaccctgtctctaaaaataaataagaggggagcatcatattccccaagaaagaaaatgtccctgggtgaatggcaccctaaggtaagtgaggccaggccagctgagtgtactatcatacctttgtcttcagtcagccaagggtctaacagagtgaccttaccttgaagctagaagaggaaagacgcagctgaaaatgggatcatttcatgaaagaggaagcaatggcatggggcagacagaagccatccacgaacagagggctctcagccagcttctcaggaagaaataagcctggcataactgtgcaatgctctccctcagcacgctgccagggcaggacctctcagagggaagtgggcccagccacaaggagtagcatgcacccttatctattaatatatttttccatgaaaggggacaacagggccctgagccccacagtgtgtgcctgaactgattagacaaggcagcctgtctttacaaaaacaagttggatagattcacaccataagaccaacctatgagcacaaaggagaggcaggaggtatgtctcaacctgaccaaggaatggatttgagatactaaggagtagaatcaaggtcagccccttccacagccagcctccaaagggaggagggaaaggaaccaatgtggctataatctcaggaacctgccaaagaccagaatggtctcctcacaaaattccctggagctgatccaagccacagctacacatcttgaccagagagaggacatccatcatgtgggagcaaggttttaccactagcattcattttagttcaatgaacagaggtaagcacaagaatgatgtgcacgaagggaagagtggagtatggaatgtgcttaacaagactgtcaggttggtgttgggttcaggattccatatatcctggaatgcccacaagatttcagaggtgaggaggaaggggctactggcctgctctactccaggcaggaagagcacatcagtctcatagtctgagattccagcaggcctcagctctcatgtaccaagggctttcattcttcctagagaccttttagggctctgagaagaacactcgtcttctctaaacctcagtcctcctaaactaattaataatagctagtaactcatttattgagcatttagccatgtgttaggcagtgtgttaatcccttcaaagtaatatttcattcaaatagttatcacaatgctacaaagtagggagagaatcctgaatccctctccctacagagcatcatccactgccaatgtgtgaggataccactgccccaccccacatacccaagagggagctaagtattcaggaaccatagcttgaacacattatctcctccctcttgtaagacttggtcaggactaatcccattattccgtgcatctctgtttacgccttaagtctcaactctcccaagccatctctcatcacccactctcagtcccaactacatacacacaagcatgcacatgtgcactcaagttcacgcacacacacgaaacagtcatctggtgttcttacttcattcttcactaagaaaaatagaccaaaacttcattttcccatgatcagctctacaagccaacctgcacctaagtctatgttttctactttccttcctattataatggatgagtgtccctgatcctattaaacttagttccagatcgcagttgcctttacaaaagctttaactcccataattacaccgctccctcctgcctgcatcatcaatttctcccttcagctggattattcccatcagcacaccaattctcctgtcactccacagtctcttctggttatcctgccatttccctgctctcactcagagtaacactttatgaacacattgttttcactcactatccccagcttttttattcctatttatattgccatttactgtaatctggattctgtcctcacaactgtactcacactactaatcaaaattaccaataattgatgaccaaatccgatggacccttcttcactcacttcatgttcctcaaccactaagcagcatttgcacagttgaccctcccttcttgaaaaactctcagtcgggtgtggtgggtcatgcctgtaattccggcactttgggaggctgaggagggaggattgcttgagcccaggagttcaagaccagtaagggcaacatagtaagattctgtctctacaaaaaaattgaaaattagccaggcaaggtggtgtgcacctgtggccccagctactcagaagcctgaggtgggaggattgcttgagcccaggctgtagtgagccatgattaggccactgcactccagtctgggcgacaaagcaaaaccctgtctcaaaacaaacaaacaaacaaaaaaaacctcctttcctggcttgttacctcactctcatggctcttcctcttccttactccttctccaactcttgctggttcctcatctcctacctgagccacatagcccagaatgccttggagttcagccctgtcaatcttctccacctcgacatcctcccctagttactttaaaaacctatctgccagtaatctccacatttacatctccagcccaacctctcccctgagcaccaatcagactcttgtacaactacctgatagatctgtatctcaaatgtttaacaagtatttcaaacttattgaatctaaaacatggctcttgattcttctccttataagtctgtccccctcccaacttttctatttcaataaatagtaccaacaaccacccagttgctcaagttccaaaatgaggctttatcctgaatctgtgcccctccctgcaccttccttcaacctctacactgaaatcataagcaagtcctcttgagtctacctccaaattaaatctccaaattcattcagtctctgttatgataccctagactaagccaccattatgtcctacctgatctactgaaatgacatcctaattctgtcttcttttgtccaccttcaatctcatctccagacacatagtaactaaatcactctcctgcctaaaatcttccaatggcagctgggcgcggtggctcatgcctgcaattccggcactttgggaggccgaggcgggcagatcacgaggtcagaatttcaagaccagcctggccaacatggtgaaactccgtctctactaaaaatacaaaaattggctgggtgtggtggcaggcacctgtaatcccagctactcgggaggctgaggcaggagaattgcttgaagccaggaggcggaggttgcagtgagctgagatggtgccactgcactccagcctgggtagcagagcaagacaccgtcttatggggaaaaaaaaaatcttccaatggctttccattacaattaaaggtgaatgaagaacatacaaaatcttcctcaaaagccacatgatctggcccccacatacctctccaatctcatctcctatcgatttccttccttctctcttctcctatagtcaccttgatcattttcttgcttctcatacttgacaaagccttttccttgataaagcctgggacttcctgttgttccatctgtctgaaatgccctaactcctaaacctataaacctaaccctttacataaagagttaattattctttttgtccatatcatccttgttcttacctctgttccctgaattgaaataaggactagtggtaaaaccttgctccccaatggatgtcttctctctagtcaagctacatggctgtggtttggatcagctccagggatctcagtgaggataccaatccagtctttgacaggttcctgggatcagccacattggttcctttccttcctccctttggggccagttaattaatctatgattaattcccaatactttcatgttttagaacagggtcagcaaactatcagtaatgaccagataatatcttacttctgtgcttatgtacctggttttctgtctgccagccttgtggaggctgttttgtttattactgtatcccaatgcctggcacgtgggcactcaataggtttttgtgaaataaataaatggaggaagtaaatggccctgtccttagcccaaccttttaaccactataccatattggaccttggtaaatgttcaacccaagatggcacaacttgaacgtggttttaccctcagtcctccaaacctaggaggaagagtccaagaagctggttattccagggcaaaaagagagatgtactacgttgacagggatatggactaaaaccactagagatggcaaagcctaaagcataaatagcaagtggaaacctgttgctaagggccaactacatgcaatgaaataaggcagtgctaaaggaactctctgagacaagccagagtcagggtcttctgtcccaggctttagagcccacaagcattgcagctctaggtagcaatgtggccagccacacaaccagtaaaaatagtagaaagactgccatgaattttggattaatgggctgtccccatctccctctaggccaatggttcttaactctgtgggatcactaacttcttggacaatttcatggaaagctatggattttgtcctctaaaacagaataaggatataagcaaaatactctaacaatttcagggaactgaccctgcccttaggcctctgttcctattccagtgctaaggggccaggaagacaccatgaaatggaattggaggagctccatcccagaagtaggaagtcaccatcaaaggctcactgagctcacagcactgaatgttcacaccaccttgtcagtgcctttggacttctattcagataggtttgccattagctataaatgctgagaaggaagaagaaaggtccagcatatgctaggggccatttcaggcagagactctccaaaggaggaaagtaaaaaggcaggagtagggacaaatatttctcccttatggtgtgtctctacagttcacatggacggctctgctgtctattcgtaaaagatatgagtaacagacaaagcagtacgtgttcacactgataatctatagtcaggtggtagagaagtgagttctcatagtataaaaaccaacaaataaactccaaattaataaaattcctcagtattatttttgtaaagggattttattttttatttatatattttgcttatttattttttcagatagggtctcactgtgtcacccaggctgcagtacagtggcataatcacggcttattgcagcctcaacctccccaggctcaggtaatcctcccatctcagcctcctgagtagctgggactacaggcataatacacaccacacacccagctaatttttggttttggtgtttttttctgttttgcttttttttgttgttggttttttttttttttttttttttttgagacagggtctggctctgccacccaggctggaatgcagtggtacgatcttgactcactgcaacctctgcctcccaggctcaagtgatcctcccaactcagccccacgagtagctgggactacaggcgtgtgccaccacctccagctaatttttatatgttttgcagacacacaccctgtcgctggtgtgtgtcttcaaatcctaggctcaaacgatccacccgcctcagcctcccaaaatgttggtattacaggtgtgaaccactgtacccggcccctaactcaatattcataagctaagaaaagaatagattgttttcttcagaaaataagacttggattacatgtgagaaaagacttcctaaaagtactttgaggcactgaaatatgtgtgtattgtggacgaaagaagtttggcaggggccgtgacaatgacagctgattatttcttacatggttgttagaaaggagtaattgtctgacctgggccactccaagtataggcctacctggaggaatgagggaagatgaaagatccttcccaatttggagtgactgtaaggagaacaaatgcctctatctcaatatgaagtagaattttctaacagtgaaaactgtctaaatctgaacaggctgttttgtggggtgagtgccacctgaaaaaagtgcacatggaccagctgagtgaccttctgacaggcatgtcaaggaaaagactagggtaagaagtgagtctctaggacctccttctgattacatctaactgcaaaatactgggtttttgttttagtttttctgagacagagtctcgctctgccacccaggctggagtgctgtggcaagatcttggctcattgcaatttctgcctcccaggttcaagcgattcttctgcctcagccttctgagtatctgggattacaggcacctgccaccacacccagctaatttttgtttgtatttttagtagagacagggtttcatcatgttggccaggctggtctcgaactgctgaccttaggtgatccgccggcctcggcctcccaaagtgctgggattacaggtgtgagccaccacgcccgacctgcaaaatactgtttaaattataaaatccaggctgggcacagtggtccacatctgttatcccagcactttgggaggccagggcaggaagatcacttgagtccaggagtttaagaccagcctgagcaataaagtgagaccctgtctctacaaaaaaatttaaaaaaattagccaggcatagtggcacacacctgtagccccagcctactcaggaggttgagacaatgagattgcttgagcccaggagtttgaggttacagtgaactatgatcacaccactttactccagcctaggcaacagagcaagaccctatctctaaaaaaaaaaaaaaaaaaatcatcatcatcatcatccaaggactgagtaacactaaccacactcaatccataactaataattcccagtgcttacacgtgttagcacagggtcagcaaactgtctgtaatgactggatactattttaggctctgtgatccatatggtgtctgtcccaattaatcaactctgtcattgtagcaagaaagcagccatagacaatatgtaaacaaatgagcatggctgtgtcccattaaaactttatttatggacatttaaatctgaatttcatacattttcatgagtcatgaaatactaccttttgatttttttccaacctttaagaaatgtaaaaaccaatttcacttgcaggctgaaccaaagcagggagcagtcccaataaggcccacaggccataatttgctggtccctgtgttagaaatttcatggctggtatttctactgagctttcaaaatgcacaatttcagcaacccctgcaactccatgcctcaacctccttccccctcattcaggaaatatcaagcaaagaaagcatgctaattcaaggcaacaaaagaaaaatagtgacactgaattctctaaaattgaataatataacctggttattgagaaataaggcaacctctagccagtggagaatggcagtagcttctacttttatactataagaaggcctgttttaatactgactaatgagaggaaaagttagcctgaattaaagactttaaaatgcaattttattgttcaccaaggaagtattactgcaaagcagaaggcctaacaggcctgttttaatgaatagatgactcatctgtaatcagtgcattaattgttgggattcaaatgggtgctcttaaagtactgggaaaaatagtttcatttttaaagcaggttaagcattccccctacagccttttttaaagtatcaatttgctttgcaaactatctctttccaaagactgtagaagtaaactttcataaaaccctgacagatttatcacaaattctatgctattaaatttcaaattaaaaaaagccacatgaatttgggtaacattttaagtattacaatacaaaatcaacgttatcacttagcctcccagtccctagggttgacactgtaccttttgcctttcaaattatttcggaacttgtcctcatattggagttttgcctctctttccccagtctgaagattcagccgtacgtgggatcctgcagggacagcctgccctaaaagccaagaagagaaaaggctcatgaggtacaaggtctttggaaggctgtcgggatggccagcaagccaacaggacttactagttcatgaagacacgactcagctgtgttcagttacctcctcaatccacccatccctctcccttgaacacacacaccactcgcataaactcactttgctaatctataaggaaatctgtaagggaatgacgtaagatgggcaagaggattcacacttgaatctagagaccaatgtcccccagttagaacctgcatatttaagctcttctatgtcttcttgagctaataaaagctttgtgttacgtgcagcaggtaagtggtagataactactcattcctcaggacatgctactttaccgtctcttccatgacacccttcctgcccctcctcgacagtcagtcccacagggccccagacagcctgccatcccagcaagcttacacctcaccacctgcatctgtttaattaggctccttctatgaggctctctccttcctaagcacagggactgtatttcctcctttttgatttcccagcccttaggccagggcttggcacataaaagtgtggcacttaacgttatgaaaaggaagaaggaagagactggaaggcaagaggacagagcaagccaaggaggcagggagtggagccaagagaaactgaaaacctacacccacctatctatggagctgatccacagctgggaaaaacaagtgttgtgaatcgatgggctattcctatgcactgcacaaaactactcaagtatagttaaaaagcaactgtgcagtagcacatactacaaatggaatgctacacacattcattcattcatgaaactgctgtagggatggagaatttcagggaaaaggtttttcaggagatgggagatttgaagcaaagatggtgcttctgacaacctggactttgactctgctttctcctgccagaggacagcattgccttgctggtgttaagtttgatttaagaacccaaatcaatgactttcagaaaaaattcctccgaaggaagcacacagcacaagttctctcaaataatcaggtaaactcaagtatagaaggataatgatataggcaagtattcaccagttctcgcaattctgggaggcccatagagaactctgagttccaccagtcactctatccccaatcaagatgccagggatatcgcacaccatgctgttgctgttcctgccgtcccacttcagtagggagtttctgtatgttttactttaaaaaatgggaacctacatacagtatatagaagtatgtgcataatgatctccctctaaccccaaccattattttcaaggataaaaaatacattcaggccaggcatggttgctcacactttgggaggccaaggcaggtggatcacctgaggtcaggagttcgagaccagccttggcaaatggtgaaaccccatctctactaaaaatacaaaaattagccaagtgtggtggcaggaacctgtaatctcagctacttgggaggctgaggcaggagaactgcttgaacctgaatggtggaggttgcagtaagccaagatcacgccactgcactccagcctgggcaacagtgcaagactccgtctcaaaaaaaaaagttcagagcgcagtggaaaaatccttctctggggtggccctcctgataaagttggggtcaaatgaagaaaaaagcgagtcccagactaggaataaagggaataccagagtaaggaagccccatgtgcaaatgcactgacacggaacccaataggccacagaagctgaggagagactaggccacagaactaactggaagggctgtgggggctgctggcttggtaccaccaggaagcctgggttcatattcctaggatgggaaaatattcatcaaacagcggcggaagatggttctgggaggagaggaggctgaatactggcaagaataacaaagaactggcaacttctatcctattactatgatcacagggcaagaggtaatttctttagtactaatctaatctctgaatgtgtgaaggggagaggctgcctcacctggagagatcccaaactgacaagacaatagtcccttcctggatgaatgctaaacaagacaatagtcccttcctggatgaatgctaaacaagacaatagtctcttcctggatgaatgctaaaatgccagccccctttactctaccacattgatacccaatctacctcccaaactggttgatttttcctgctatgtatgtcttgaatgcatactcttctctccatcttcccccactgcttttgtctgaaccatcaccatctctgatctgcgccctatcacagctttctaactggcctccccgattcacctcccaatcaaactgttctttaaagcgaatgatttttcttttccaaaataccaaacctatgtcattctcctgcttcaaaccttttcatggcttcctactattctgaggataaaaatgaaaatcctcaccctggtccatgaggccctgcagtatctggccccagcctacctctccagccttgtccactcctcattcctgtgctctaggcacactggtctttttccatccttctgaaagaaccatgctacctcctaccagggggccattccatctgctgttccctttgtccagaagagtcttcccaccctcagcctccatctcctcatccttccaatcccagctaaagtcacttcttctgaaaggcatcctctattttctcagactagatttacctgcctccaaaagatttcacagcaccatgaatcctttatagcactcaccacaatcagtaattacacattagtttttttatttatgtagtgaatataaatgctcaccattttatcctcagggcctataacatgacctggctggcatatagtgaactctcaataattatttgttggtcaagtgaggaggcccttgcctatagtcccagcactttgggaggctgagacgaggggatcacctgagcccaggagttagagaccagcctgagcaacacaatgagatcccatctctagaaaataatttaaaattagctgagtgtggtggctcacacctgtaattccagcactttgggaggccaaggcaagtggatcacttgaggccatgggttgggcaacacagtgagaccccgtctgtacaaaaaaattaaaataaaaaaattagccaggcacaatggcatgctcctatagtcctagccacttgaagtctgaggtgggaagattgcctgagctcaggagttcaaggcagcaatgggctatgatcatgccactgcactctagcctgggcaacagagtgagaacttgtctctaaattaaaaaaataataattatttgttaagtgaaaatgtttaaaagaaagagggaattcctagctgatctagagttatatggaaaggccaagaaggatttttactagggcaggttgagttataatagtaattagtcatgttaatagttatttttagtaataatggtactaatactagtaatataataaaaatagtatttaaaattttcaaacttttgaccaaagttagaaatggaaaagaaaaaagcatgtaagtgtataagcttcagaagtaataggttatagtgtgctaagctcgccaaagaagagactaggttcttatgtgaatctagttattttgatgaaaattccaaaattactcccttcacataagccaccacagggggcaagagcaaccacaacagcattaactcaaaatacaggttgtgttcatttaaaatatactaaacacgtcatggcagcagcagtggcaaaagcaacaggaaatgcagtatttcaaatacttctccactggggaaatgtccaagttagaaagatagtataatctgacctgtatccttcgagagcccctgtgacagatgaaaatgtaccagaacacaggggaagggcaaatcagagcaaagagaaaacaagatacatacaggtaacaagttagggggatggagagcaagggtacaggcagaaaataatgtctggatccaggaaggcaaacaggcctgcaaagcctacagtgtctgttttcccacctccagctccttcagagctgatcccaaggctgactatcctagcctagaaaacccatccatattaagcagaagccctgtccatattgagtaaggccacctcatgcttgaattttgactcccactgacactgtcactgacttcagtcacaggccaggacccagataacaactcttgttttctgggttgggggataatctatggtagactgcaacatcgtcaccaatttttttcctccctgcttgtcacactctctgccatgtgactttacagttcctcctactgcagagtgtgccttctcacaccttgactttggattttgcttatcacatgcattggccagtgggatgctagcaaatgggccgcaaacagatgtttgaaatgtgcttgcatggttgtatcatgttctgctattgtcatgaaaagaacatcactgactctccctctccctctccctctccctctccccctctccccctctccccctctccctctccccacggtctccctctccctctccccacggtctccctctccctctctttccacggtctccctctgatgcctagccgaagctggactgtactgctgccatctcggctcactgcaacctccctgcctgattctcctgcctcagcctgccgagtgcctgcgattgcaggcacgcgccgccacgcctgactggttttcgtatttttttggtggagacggggtttcactgtgttggccgggccagtctccagctcctaaccgcgagtgatccgccagcctcgacctcccgaagtgccgggattgcagacagagtctccttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcttggccacccatcgtctgggatgtgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctctgccctgccgccccgtctgggaggtgaggagcatctctgcccggccaacccgtctgagaagtgaggagaccctctgccccacaaccaccccgactgagaagtgaggagcccctccgcccggcagccaccccgtctgggaagtgaggagcgtctccgcccggcagccaccccgtccgggagggaggtgggggtcagccccccgccaggccagccgccccgtccgggagggaggtgggggggtcagccccccgaccggccagccgccccgtccgggagggaggtgggggggtcagccccccgcccggccagccgccccatcaaggagggaggtgggggggtcagccccccgcctggccagccgccccgtccgggagggaggtgggggcgtcagccccccgcccggccagccgccccgcccgggaggtgaggggcgcctctgcctgcccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatgggtgaccttacccccaaccctgtgctctctgaaacatgtgctgtgtccactcagggttaaatggattaagggcgctgcaagatgtgctttgttaaacagatgcttgaaggcagcatgctcgttaagagtcatcaccactccctaatctcaagtacccagggacacaaacactgcggaaggccgcagagtcctctgcctaggaaaaccagagacctttgttcacttgtttatctgctgaccttccctccactattgtcctatgacccagccaaatccccctctgcgagaaacacccaagaatgatcaataaaaaaaaaaaaaagaaaagaaaagaacatcactgctagccttctggtccaagaaggatgagacacccacggagaagaaacaagtcagggcttcatgtgcacatggtttattaaggggtgctctccagttgacaggaaatgaggaggcagggaggactttgtacccccacctgccccctcctggcagtcagaggccgcaggctaccagagcaggtggaggcagaagctctgggcaaagaagctttggctcctcagaggggtccaggaacaggtggcaagagtgagtcttgaacccccacagaggctggggaagaaacaccccctataggaaaaggagatcccaggaagtatgggcagggaaccaaaagcatctgctttaatggctgtcttagagtgtgtcctagtccattaggaatcctataacagagtaacttagactgggtaatttataaacaatacaaatttattgctcacaattctggagactgggaagtccaagatcacaccagcagtttcagtgtctggtgagagcctgttcctcacagaaggtgccttctaagtgttttcacatggtggaaggggccaggaggcaccctcaagcctcttcactaatcctattcatgaggcgtggaactctcatgacctcatcacctcctaaaggccccaccttctaatactatcatactgggtatcaggggacaacccaaatgtccatcatgtgataaatgaattaataaaagtagtatatccatataatattattcaccattaaaaggagcaataaatactgctacatcctacaacattgatgaaccttgaaaacattgtgctaagtgaaagccagatacaaaaaagcatgtatcatatgattacttttacatgaaatgtacagaataggcaaatccatagaaaccgtagattaatggctgtcaggggctgtgggaaggaaggaatgaggattgaccactcgtggtctggagttagacagtggcagtaattgcacaacactgtgggtaaactaaaaaaaaaaacaccaaattaccaagaaaaaaatcatgggggaaatactttcagattatacaaatccatcccttgactctaaaaaccattgcatgccattagaggaatccatctgcaacatttaccactgtggtaatcatctaatgggaatttgctacttccctccttctttacacatttattaattgggatttatttcactccaagaaaaaattgtcactcctctaattatttgtatgagtatgaactcatggatattttattctatgggtccaacactattattatttattttgttactcaaattgtttcagccttagcaatcagaagtgccttcaggttggctcttacattcctttgaaaaacccttcctccccaccatcattttctttttaaaagtatttccttactttctggttccataagatgttccaggttcatcttgtattttcatttccccagccctggaatcagccacttctaacgagccctagttttttttctttttctttcttttttcttttttcaattggagaacagtgtttagaagccaagatctggatgctaggtgtgttcattaatactagggtgttggtatttctaagccctctcagtaggcggagctagaaatgtgtatgtgtgtgtgtgtgtgtaacaaaataccttagactgggtaatttataaacaatacaaattatatatacacacacaaatgttaattatatatatgtatatgtacacacacacatagacatacatacatttgtatatatatatgtggtgataaggtttggctgtgtctccacttaaatctcatcttgaattgtagctcccttaattcccacatgtcatgggagccacctggtaggaggtaattaaatcatgggggtgggtctttcctgtgctgttcctgtgatggtgaataagcctcaggagatctgatggttttataaagggcagttcccctgcacacgctctctttcctgctgccatgtaaagacatgactttgctactcattcaccttccaccatgattgtaaggccccaccggccatgtggaactgtgagtccattaaacctctttcctttataaattacccagtctcaggtatgtctttattagcagcatggaaactaatatatacagcttagaatattatattacatatattctaaaccacatatacatatatgatttagaataacattcaggccctccatgtaatcatcaatcattaatgtttaagggacactgagttcactttctctaataatctgtgccaaaagtaacaaaagaggacatcaacagatgtacaatatatatacatacagacatctatatacatgcacacacctatatttcttgctatattattgttgtgtgtatatatccacacatctatatttctatatctatttatctgtatatatttttaaaactacaagtttatactgatagttcagattccaatctaatacacgggctcatttgtcttctcactttacttatttataacttctttctctaacactgagaaacctgctcttattatctacaatatatttttgttctagtatacaaataaactagtttcaaaactgttaacccatatccctgtgagaaatacatttaccaaactagattacagcatgtatgtacagttctgtttttagctttacagtacctggtcaaaatattgcttcacaaagtcacttgggttagttcttccctgtccaattcattaaggttatgttattaattagtaatacttggttcatttgttagtatttgtattccattttatggctcctgcccctccatatcctgattggcttaactgtttatttggtgagcctatgaagagtatgtgaactattactgtggttctaagagtcggagctataaaaaagaacagtgttctgttctcttacatactttttttttgtatagttactgtttttttaagccaccaggatttgaggtgtttattgtggcattcattccaatggtcccgaaacaagaaattaaaagtgcccaatataaataacagttttttctgaaattatatagttgcttttttgtgttaaaatgtccttttaaaagatgagataatgatagtagatagtgtgttgtttccatgttaaggcccttaactcagcaaaataaaaagttggccttagtcctccaattttttttttttttttaagtttttctggtccataaaacaccatagcctagaaaccacctctccattctaccaatcttccctaggacatttgagaattattcccattgtacactttaaataggtgaattggatagtatataaattatatctcgataaagtggttgtagaaatatattcctccaccatctctttttaaatccttgaacagcaattagtctatcagacacagttcaatgtgacagtaaatatttctaggggccaggaaagagaactaaggctcagggcctagacacagacccaggaatgaagttcttggaacgttaggaaggggaaaattagcctaggaagcctgaggccatgaagcaccaggacaagaggaaccctggcagaaggacaggtaagaaatagtgatcaggaggtaggagccatgtcaaatgcccacaggaggcaggaggcaagagagtgaggaggttcatctgtaagaaaacatgaatggtgagggctgtgaaaaatgccccttctaaaagtattccaccttaaatacagaaaaggcaaacaaaacatatggccagtttgtaactgctgaaatgatagttttacctattaacaaattatacctggctctgtctttgccccaactcatcccagtgtccagtgcttagaaacttgtccctcctggactcccagtgacagggcctgctcaggtggtgcccacagtgaggttgctgtggagcctggctgccctgcttcaacgaagacaggccaactggaatgaatgcatggtgctcttgggtctgccttggcattaagagctttggtagttatgggacttcaggaggggtgaaaaggacaggatgtcctccataggctcctgcctggaaacttcctgctccagggacttccagtcatacgtggacacaatggcagaaagccagaggctgccccggctggccatgccgcaagccctgggactctgctcctcacttggctatctttgttggctgggtgactctagccaaattcctttatgtttctgaatcttcatgcccttatgtgtcaactgaaaagaatttatcgtgtctgttttccctaatgtgctacattgttgtgaagaacaaatgaaaaaagaactgtgtcagtgctcagaagaaataaaaagtacaccagaaaaagcagtcccaaaaacaacccaaaaaggtaaatgtcaacccggatgaagcaaagacagcttatttgtcaagtcctacaggtaggtgttaagagtaaaaactcccggttatgctgagtttctgaagggcaggaaccaattattggtgcccacagctcaagctcagctcaaggcacacagtaggcctccataaaggtcagcttgaatgccagctccctcttccccagaccaaaaggaatacaaaaatatagaacaggaagcaatgccactcacctcgctggggcctccaagctcctaatagggctggtcagagctgaggctttacaggcccagttgccatgactactaaagccctctcctcctgcttctttattcaaaacccccgaacaagtcttggcaagatccctgccttacacaaatgagcatctatcctgtctccaggacttgaacggaaccagtaacaaataacgtgcacaaacctctctagggtgctgaaccctgaaacaacacttaatgttattgtgtttttaagggaaccaaaaatggagaccttttttttaaacagcaaaatacataatgagccattctggatcatagtcatatttatgtattttttagaaggactaaacaatgacaaactgagaaaaataggaatattctccaaatgtatttttactctgaatcacagagaatctagaatctgggccgggtcttagaagagttacccagcatggcttccaggcaagggtagaaatccccaagctgcatgaaagccgctcagaaaaaaagacgccagtttcccccagggaacagctaccctgacagctcccaccatacccttgcaccactaccccactaccctccaaaatctcatccacagcaccctaacccatgtctcctttccagtcctcaaggaggacaaactacagctggtgaccaaccattctacacagaattcacaagagtaacgctttccacagacaaggactatcaatgctacttagatttcctgtgttctagtgagagaggtaccttgaaccatcatcagcacaaggctcaaagtaaccacatttaggacatggtgagcctctttccataagtggctagtccacaagcatctcctgaggactgggcaagagtctgctcttttccaggcattccttctgccacagcttaccatgtgcccacaaagggccactgctgtgttgggcactgggaagtatactgggaagtgaacaagaccaatgcctgccattgagaagtatgacataaatggggagagaagtagcaacacttagatttccaagtccagagaacagctttcaagcaagcaatgaggaactccatatgaagcacctggagctcagcatataaaacaggcagacaagaagcagggaggccacttggcaggctgttatcattgtcctaatcagacataataaaccctgacccagaggaatgggtaggaaatgaagattgagacagcagtaaaggatgatagtattttgaccagaaaaactaggaatcttgttgtggccctgccagccctcctactgagaaaagcatcagacctttaagcatgtgcagttactcactccttccaccagcctagggggcctaccacagcccccaaatttaataaatccagggatggaataaagaaaactggggctaaagggggccactttcatgtggagacccatcctgggcatctcacacctgtttcctagctagttgatgcctccactcccctttgatctctaccctcaatgtctcccatgttcctccaagaaaccaaaggtcaggcagttgggagtataccacagcatggctatagctcttccggctctctaatcccacttggaaattactgagtcaaaaatacatttttttaaattctcactataattgaagttaaccctgagatactgataatgagctttacttcataataaggagggaaacaaattggaagtgaaggagttaaatgtgtctgtttcccagaggccttagcaccactactgctcattttctggagaagactcttgaggattccagagtgcctgcatttcccacccaggtacaatttcattagcagctcattagcaggagtggtgcaaccatttctgactcttgtttttcataatatttattggttaattgacactctgaatacaggttgactgagacccaaatgaaagtgctaaaaccactcattagtcaaatttaaaacagagattgtattctaaacataccctttgttctcatttattttcctcaaacagaagtcatgattgaataaaagggttaaaaaagcaaagtgccaagatattgtacttcaatttttaatccttttttccccgtaccctatcagtccccaggaatcctgtcatcataattggctcttattgttctcgtttacagcacctgttacctccacagacaaatatggttctatgaattatttcagaccagtatcagctactactgacttctacaatttccctagtggccctgccacaaaagcccctcagtttggatactcccagcaatgaaaaggggaaaaaaatccatagggatgcctgcagcaaaattcttagggtagaatttctctctagaccagctctaaaggatgggactccacatcattctatttattgttgtggggtggtgtgtgcagggatcagggaggtgaaaatgacaatcagagtgggagaagaggcagatggagcaacaggtacagtgcagagacggcagtcatataaacaactggtcctaagtccttgtccacctcccattgggggagcccaccctccttaaatataggcaactttaacaaaacgaggttattcacctgagcctcctttcacctgtcaaagtgtaatgacaatccaaattttctgccttttagtttaaagttttggatcgttggtattgagagacctactaagtagtgttgtgctttgctttcttcacttgtattgctggtttcactagaaggaattgcagcctttagcactcggatgacctaggcaattgttcagctggtggcagagggcacagactcaggaagatctggttccaggtccagttccaccacttaatagctctgagaccttgagcaaataacacctatgactcatctgcagaatgggcatcagagtacccacttcacagggctcacagggttcactgccaggaataagagatcatgcataggagatgctcagagctgacaccagagagttctcaataatgttctctgcctggctcttgcctctctgtgacttgttcagttttcccagctatgagaaaaagaccagggccatgccatgatagatgctcaaactgagtgttaatcggctctcaatacatacttgattgagttctgcagaggaaagaagagtacatgattttttagaatattcatgtcaggctgtcttgttaaggctgcaaaaaattcagtaacaatgagggctgcggggcatccaaactgagagggcagcaaatgagctgtttaaacttagcctgtaccacatcgaaaacacccactacagctttccttggctcagccaacctgcaggccaccaaacccacttaagatgggtcagtctctgtctcactccccaagacatcagaatagaaatcaaagaggccatatccagcagcaaaactgaagcaaatgtggggaggatttaaaggagcacaactgccagctggcaacaaggaagaagggcttcaggtttcctgataaacttagctcagtcacaaacttaagccagttttgcaacaatgcaccaaagagcttataaaagcagctaccctgctctgggtttctgctcctcagagggctgtgctgacaggtgcccacccaagcatgggcaaggaggcctggatgttctaggccaatgcacacaaggttggtgctccagcaaagctgctgctgtgcacacttccaacaagcagcctgcctcacacctccaccccaccttcacaacagctgatgctgcccccaactgcacccccatacacccaatcctgggcaactaatgggaactctgtgctgtcacttgatgagaaacactctacccactatacactcctgagtcttctccaagtacccaggcagaagtatatggaacctctggccttggtgctccctcctattcataggcagattcaggccctactgactacttgtggtctggatcacttttgacagaagtcgtctcccaacaagtcatctctctgatatcctctttcaaacttccatttcagatttataaaagagaaggcaaatccctcataacttcaggacctcagcattctgagctagaaagaacttcaggagatcatgagacccagcccccactgaaaagataaatgttccctccttgtgccactgcagttaagtacagcatcccccaggacaggcttgttggcactctccttcttacaagccttcagtggctccctgctgccctccgaagtaccaataatactatctcatggtgttcaaggcctgcctaacctaatgaaatccttgctgatattctctgccttatcgcccctcatccacagctaccccacgctctggctaaactccccctatgcttttcttagtccttaatgccatctctttccttgctttttgcctgtcaaatttcaatgctttttttttttgagatggagtcttgctctgccacccaggctggagtacagtggtgcagtcacagctcactgcagccttgacctcccaagctcaagtgacagtccattttttaataggctagcttgagcaacaactccatgcagttttatacattatctttccatcctttcaatctctagtgccttgcttattcttttctaatgacacttcctctattcattttctcttagtcatttggcttcttgttaatcattaaacagacatttactgaccatctactatgtgccaggttttaggaaaattaaaagtgagacatggcctctctactctttttactttacttttatttattatttttttgagacagggtctcactctgttgcccacgctggggtgcagtggtatgatcacggctcactgcagccttgacctcccaggctcgagtgatcatcccacctcagcctccctggtacctgggactacaagcatgcacaccacacccagataatttttgtatttttgtacagacagggtttcgccatgttgcctctctactcttgaagagatcactggtctagtgagggaaacaaatccataaaaattataatacttgccaagttttccccaatagattgtattattcttgaagtcagaacatctttatattccctgcattgctgaacagagtgcttggtacatagcgaatgtccattgtgtatatgttctaaaacaaagatgagtgagcattatggaaagaaaaacaatttcctctttctgaaatgtggggcagaaggatgttgcaaagatagcctttaacttgggataaggggaaaataaacttcttatttttaaatgtattttaattccacagcatcactcctcaacccacaaggaaaataagagaaagatacaaagactgagaattgcaaagacagaaacaagcaagcatcaaaatagaatgggatagaagtgttgtttagttcttaactactactaaaccacacacatcagactttatcatgggcttcagagtattatcacctctgataacaggatttgatgaactattggtcatagctctacaactgctctttatccttaaacattcaagtatttcctagttcatcaagcagaagtggttggtggttaggaaaacaagaataagaacaatattactagagaccagctggtgaagcctctgagattatatgtgaaagttttaagtacacatttacatttttctaaaaaggtccataggtctcatgagtttcttagagaaaactgtaaatcactctcaaaacacatacataaacactcataccttgaagagcctctgggccaataatggcaaggccttgcagcaaccggcatcctaataactgtaggtaaggataaattagtgcaaggcttttgggcatctggcaacatctatcaaaactgtaactgttcattccatttgacccagcagatgctatgtctaggaatttatctaatagaaatgttcacagaagtgcacaatgatatatggatagagtgttcactatagcattctaataattgtaaacaatgagaagcaatacaaatgtccatcagtaggggatttgttacacaatacagcatatcccttcaatggaatatattagtcttcaacaaaaaagagggagctttgtactgacataaacaagatcactaaaactaagcaaaaataagttgcatatatatgatttcatctttctttttaaagaacatatgttaatgtggcaaaagcaacgtcgtctaatctaccaaatcctcacataaaaacagactgactagagagcaaaactaaacccatgagcaacatttctatcaaaaccaagtgcaaaggtattgggaagcaacaagttggctgagagacctaagaacaagaaaacacctaagtagctgataggcattcactaaaaattatagtgggccaatgggtaacagcaagtgaacctatgtctaacagtggacaaggacaagaagtctggggtaggacttcaaggggccacagctgtctagtcccctgaactctcaaaattaaccagtgctccctaccaggacagggccccacactgagaaaatacggctagaagtgaaatcaaaactgagtagacttggacgacagaaataaaggaaacagagtccagataaaactggaggagtaaaacagagccaggaaacctcataaagcaagctgccatgtttttgaacactacctgaaaacaagagaagagaaaactttctcaagcttgactcagaatgaaaaggaaaaaaaaaaaaaaaaaaagaagagaaagcactatggatttagaaaaggtaattaaagccatgcttttttctaaaagttcaagaaacctaatttcacataaaaatgagcaatagaaagtattatggtacaatcctatacaataaaattataataaaaagaagaagaaagaaaagaataacatccctacatacaatgaaagtaagccagaaagacatggccacaaacatataaaaactgtaacttcctgtttcaaaatgcactaaagacatttgttaaatggtacaagatactcaataacaaaaatcagaaatgaggtgctagaggctgtgtatggtgactcacacctgtaatcccagcactttgagaagctgaggcagcaggatcacttgaggccaggagtttgagaccagcctgggcaaccaggatttcaggatcagcccaggtaacacagcaagacctcatctttactaaaaataaaaaagtcagtcaggaatggtggcatgcacctgcagtcccagctacttgggaggctgaggtgggaggatcacttgagcccaggagctcaagattgcagtgagctatgatagcaccactgcactccagcctgggtaacagagcgagattctgcctctaaaaaaaaattaaataaaaagaaatgaggtgctagaactcaatgaagaatcagaaataaaagaacaaataatcacaacagaaaatgccttaagataaatagaacatgaaaaggaggaaagttggaaaaaccaaacagaaatggaaaaagtaaggtttgtaacaaactaataaacaatgaagaaagacaaaagaagacccaacataaatataagaaaccctaaacaagcaaacagaataccaaaaaccatgtttctttttaaaagctcaagaaatctaatttcacataaaaacgagcaacaaaaaagaattataattcaagaaagctttcctgaaatgaaaaaaatacttaaaactatgtattgaaataacacactgtatacctaagaatactgaccagggatgtccaacagtaaggcatattctagtaaaataattggattttaaaggcaaaggaaagatcacttgggcatataagcaaaaatcagcaagtaacttataaagaaaattagattgtcatcagcatttttaacagcaaagcctactgccagcagaagatgaagtactcaaagaaagaaaatgtgagccaaggattttatatcctaccaaagtgctttgggatgtaaagaacactgacaaagttaacatacaaaaacacagagattactgtttcgatgggctcttcctgaagaatttactagaaaatacatcccagacaatgaaaataagtaagaccggcggtaaacattacatatatagttatttgtataaatgccttaaataagggctaaaaaggaagtatataatggctactctgagaatatacatacaacacagctggttaagaacaatgagagcacacacaaaaaaatgttttaaactattttcagtaatcatatcagggatagtattactgccattctgaaactgttgcatgtacaaaatgagacagatcaaatcagtaaaattattacatattctaattgtataatcccctgtgtccagaatcaggactctcggtgtgggaaaaaaagaggcagatgtaatatcgaagagattaaataaaaaccctgccagccggaatatgaataggcagtacccacttgaatgtatgaggattataacatatatttcctatctcttgtcaacagaaaaggcctagaaacaatgaccaacacagcagtaatgagcgacctaatggccagaatgtagtcttaaaacttcttagagaaacagctaattccagtcctgggaaggaaatgtacaagacgagcttagaatatcttgtcaaaccagacagcaagaaaactatcaaagactattagagtaacatgaaaagaactcatttgaaaaccttcaactgaccaaaaatcaaacaatttcaacttcaataaaagtaataattacaatgaattaaagcccataaaatatgctttgaacctgtgagtttgtaaagggaaaaaaaacatcttaattggtcatcttcagaggatcaactcattatcttgaaaactggtaaataaggaaaaaagaaccaaacatttatcctgtctttcctgtatgaattttaccactgagtaacaaaataatatatatggggaaatacctctttataaaagtagtgcagctaaaaataaaaaagaaatgatagatttgagtatcaccctcttgcaatcccacaaaaagagaatcaatcagacattaagcacttcctaatgaaagagcacaaaactgcctatagttttcccaaaggaatggaacctgtgtccgattgagcccctggatccagctgacaatttgcaagaaatacagaggttggagaaacatgccgaactgcatcatttatgaaatcagcaaaatttagcctgggaaatggcctgagctcttcaacagacaatttataagaagaagaagaaaaaaaaaagcagggggtgggggtggggaatagataggtaacctgtagattcaaagagacttaaaggatataacaacgtttcttaaatgggcaacactatagtcttgggtgcaaaacttagtcataaactatttgaaaatgcaaaggagcaattattgtaaaaatcaggagagtggttacatttggtaggagggaaatattacagttggagggacctgctgaagtgctcggcaaagttctatttcctgacttgggtgtgacttcacctggtaataactcattaagctacatattttgtataattttctatatctgtgtttaactttataataaaaagagtcttaaaggagtatatgttatctctggtgaagaaactggacttagaaggacttgtacttcctaaattatacatttctataattaggatttttttatagtgagcattcataccttttattattagcatttttttttttttttttttgagacggagtctcactctgtcgcccaggctggagtgcagtggtgcgatctcagctcactgcaacctccaccttcccggttcaagcgattctctgcctcagcctctcaagtagctgggattgcaggcacccaccatcaaatctggctaatttttgtatttttagtagagacggggtttcaccatcttggtcaggctggtcttgaactcctgacctcatggtccccccgcctcagcctcccaaagtgctgggattacagtcatgagccaccgctcctggcaagcaaatttttatttatttaatttttctgggattacaagttgctaaaaacatgacacattcatggaaaaaatacataattccttttctaggcacaaaataaattacttcaaaactattaaaagtataaaactgtggcatatattttaaaaagaaaaaggggaggtagctgcaaaaaacaaaccaatcatttggtatcttttattataggaagggtccatttgggcttctttaaaatatgctgttataattggggtctattataaattatatacctaaaacatattaatacattctaaaatgaaaaataactcagaataccagtcataaataacatacactattcaaacacgtactaacacatcctgcgaaatagagatgaattcaacgaatcaaaagtatattgcgaatataaaaccagaaataaatccatacatgcatttacagccaattgatttttgacaaaggtgccacaaagataaaatggggaaaggacagtctcttcaataaatggtattggcaaaatggaatatccacatgtaaaagaatgaaattagacccttggtatatttgtcatataccatatgcaaaatcaaatcaaaatagattgaagacttaaatataagaccccaaaccatgaaactactggaagaaaatacagtgggaaagctccatgacattagtctgagaatgactttttagatttgacccctaaaagcacaggcatcaaaagcaaaaatagacaaataggattacatcaaactaaaaagcttctgcacagcaaataaaacaatcaatagagtgaagagacaatctacagaatgggagaaaatacttgcaaactgtacatctgatagtgataaatacccaaaataaatatggaactcaactcaacagcaaaaaacaaataacctgattttaaaatgggcaaaggacctaaataggcagttgccaaaagaagacatacaaatggccaacaggtatataaaaaaaagatcaacatcactaatcatcagggaaacacaaattaaaatcacaatgaagtatcaccagacacctgtcagaatggctactaccaaaaagacaaaagaaaagtgttggcaaggatgtacagaaaagagaagctttgtacactgctgatgggaatgtgaattagaatagtcattatgaaaaatagtatggaggttcctttaaaaattaaaaataaaactaccatatgatccagtaatgccactactgggtaaataaccataggaaataaaatcagcatgtcatagagacgtctgcactcccatgtttactacgttattcacaatagccaagacatggaatcatcctcaatctccatcaatgcaggaatagaatacagaaaatatggaatactgtttaaccataaaaaataaggaaatcctgtcatttgcaataatatgggtgagcctagaagaattatgtgaagtgaaataagccaggcacagaaagacaaatacacattatctcccttacatgtggaatctaaaaaagttgatctcatagaagcagagagcagaatcatagttaaccaggactgcggtagttgaggaggtggggtagaggctggggagatgttggtcaaaggatacaaagtttcagttagataggaggaataaattcaagagatctattgtataacatggtaactatagttaataatatattgtggctgggtgcagttgctcacacctgtaatcccagcactttgggagaccgaggcaggtggatcacctgaggtcaggagtttgagaccagcctggccaacatggtaaaaatacaaaaaattcgccaggcttggtggtgggcacctataatcccagctacttgggaggctggggcggaggttgcagtgagccaagaccacaccattgcactccagcctgggcaacaagagcaaaactccatctcaaaaaaaaaaatacataaataataataatacattgtattcctgaaaaatgccaagagaaagaatgtaaagtgttctcaccaaaaatatgataactatgtgaggtaatgcatatgttaattagctagatttagtcattccacaacatagctatactttagtttgttttgttgtttgagacaaggactcactctgtcacccaggctggaatgcagtagtgcaatcacagctcactgcaaccttgaactcttggactcaagagatcctcgcaccccagcctccggagtagctgggactacaagcatgcatcaccacacccagctaatgttttaattttttgtagagacaaggtcttactatgtttcccaggctggtcttgaactcctgggttcaagcaatcctcctgccttggcctcccaaagtgctgggattataggcatgagccatcatggctggtctatttatactttaaaacatcatgttgtacatggaaaatacatacaaattttcctgtcaatttttaacaaataatatacataaataaaaatataaactatatattcacaatgaaatacctgacagatattttgctagggttaggctttacaaggaaatggtccagaagtctgggaacaggggccttgcacaaatgcaaatcaacgaacaagatgctgagttcaacctcaatgcctttattccacatgaccttgaacagagccctcacctgaccagccaatctgaccctcaaggatcgcacagtgaagccagagtgaaagagaatgtgtacttcaggaggatttgctcccacattggccgtagtttgtgaggtgggagtggaagggattaaagagttttttaaaataggaatcatttcccttcatcccctcttgccttcagaactaagcatctctttctctctctgtcttttttatttttattttttttgaggcacagtcttgctctgtcacccaggctgcagtgcaatggcacaatcttggctcactgcacctccgcctcccggattcaagcgattctcctgcctcagcctcctgagtagctgggattacaggcacatgctaccatgtctagctgatttttgtatttttagtagagatggggtttcaccatgtttgccaggctggtcttgaacttctgacctcatgatctgcccgccttggcctctcaaagtgctgggattataggcgtgagccatcgtgcctggccagaatctctttttatgaggttatgtttaatactaaacacccattatgactgagaagcagaaattaccaaccagagtctgaaagcactatccacagaaacctctgaaagaagagtgtcctaaccaacctggacagggttcagtgcagttctgcctggaggcagatggatggaagcatgacattttaaaaactcccatcccctagaactttattttccctctgcagcaggagatatctcaaaacaaggacattagtccaaactactctatagaggaaaagcaataatccaaggacttttctgagtatgtagcaaccactgagatgcatgaaaatgatacgtgtgcctagtttttatgtctactcctactaactatgcaaaactgaaactagttccttaaaaacaaactgctcctggacaccctacacagtcgctgccgcctccctgactctgcagacatcagtaacagagcatgtcatagggaataaaacacaatcataaggtaatgctacataaacgctagtgtgtttatggggaataaatgtcaaggtaaagcaggaatatctattttctatgtgggagatggtgattctgtgtgtcaatgccccattatactgaattgattttagttttgccaaatcactaaaatatttcacaatctccttttggaggctgtggctgtcataatgacagaatctgcaatgacctttcacaaggtctactttccaggcatctggacttcacaatctcctccattctaaggttccattttcccaggaaagaggcacagtagggcatggaaagctggccagttgtgattcattcccaatacgatctgccaagcaggcccatccatgctcttggtatcttgaaattccagagaagctagacttcaagtccttcccaagaccctaatgtcctgtcatttagtcccttctgaaagttgcttaaagtgacataagggaagcagctaatttacagtcctattcttttaatcttggtcagccagattttcacagacatcagtttatttcactttataatatattagacaaaacaacagtaccggaatcagttccaaggcagcaactcactctcaggggttctgctgacatttataaactgatcctatttctctcttgtgttttgttatcagctaaacctgtcaacttaaattattgccttgtaacaaaatcagagttatctattactctggtatgtgtacatttctgaagctttgtacctatatcaagttttgcaagggtagaaaacaagaccataaataaacaaatggaaaacagaatatgttaccatttcactttagtaacagaagctaaaagtcaaatgcattacatggaaagccactaaaacagccaaatatatagaccttgggaatagcaaagctgatactgatacagtcatttgcgctttgccccatcctgcaatcaatctctgggctacagtacctcagagttcctccatttccaatttggaggagtaaatctgattattcctagggcctgtaacaagtgagtagacataaaaaaactgaggacacaatgtcaaaaagctcaaatttatagccacttcattatttcaccagtacagtggactaagaaaccaattccccttctattggtatggctaatggtcactcttactcaaagaccgcagtgacctaaactgagcaacaaaagagtcaccagaaagaaagaaaaaagcaattctcggccgggcacagtggctcatgcctataatcccagcactttgggaggccaaggcaggcggatcacgaggtcaggagaggagataagaccatcctggccaacatggtaaaaccctgtctctactaaaaatacaaaaaattagctgcgcatggcagcacacacctgtaaacccagctatttgggaggctgaggcaggagaattgcttgaacccaggatgtggaggttgcagtgagccgagaccataccactgcactccaaccttggcgacacagtaagactccatctcaaaaaagaaaaagcaattcttccccaccacctctgaccctgccccagggctaattcttattctttaactattccctcccccacattcaatctaaaaacaagttgtttcccaaatttttctgggatttcatgtggcttaatacataatacctttatgaacaaaatacaattccttttttggatacaaaataaataaatcacttccaaactacaaaaagaataaaaccgtgatatatatctcaatttcccctacatttctactatccaaacccaagccaagattttcttgttattttacatttttagacactttacagtgacccaatctacaacaaaactccatctccctaaactgttgttttacggactgtgattccagtctagcaacctttttaattctctcaggaactgactgtttaacccccttagcttttcccaacagctactaccttacctcttaagctcagaaacagagatctcaccatacagcaagaactttcccaaaagcctcctctttgagaaaacctcaacctgaaagggcagagtagagggcacagttccacacagaggcaccaaaacagtcactggagtgatgggagttgagaggtatcaaaaagacacttgataaccccaacacacccaaaatcctactaatcaaatctcattgttacagagtcagctctttgatccaaatcttcagattatgctaggccaaatcatatgctttagtgcaccctaggaggaggagattatagtgttgcgggggagtggtatacatgattgtgcttcctcatcatcctcattctctctatcacactccagacaaactatagcacagagcaagaaggcacccatccagaggggaactgagagatgagatatttagtttgggtcctgagccacttgtgcaatatggatgtatttttccatgcaaaatctcacattcacatctctgggtacacaaacaatatttggttactgcacacttttctttgaccaatctcaccttgcctaaaaatagttacaaagggctaagcctggtggctcacatctgtaatcccagcacttcgggtttccaaggtgagaggatctcttgggtccaagagtttgagaccagcctgagcaacacagtgagaccatatctctaccaaaaaaaaattttttaagttacaaagaattataatgggcaaaaattgtaattgacaaaaaacttcctaattctcattccaggtttcaaaggaatttaaaaaaaaaaggggaggccttaatttctggaatcatctctcctgaagccctccagacttgatttttagaatataggtcttgaaagctaagcattttctcagctgatcctttaggtttcaccagacctgctttctccaccacttcctgctggggagacgcagaacagcaggagaaggcaaggcaacttgcacaggccagctgcactaccagttgtggcttctctgctcggcctcacaacctgcatgtcaactcttcccgatcccagtggataaaaaaccactaccacactgcacacatcaaatgccaggcacgaggcagagacctggcattattgccagtggctttagctagaaaaatctagcacttttcacttgatgactttcaattaacaaaactgccaaataataatgatagtcaccaagcagctgtttaagagatacagtgagagaggggacactgtgtttccacatcagcagtcaatgaagctagaccagtattggccattcactttctagaccagcactgtccaatagaactttctgcaatgacagaaatgttctatatctatgctggcccttacagtagcccctggtcacatgtggcttttgagtacttgaaatgtgactagtgatactaagaaactgaatttttaatttttaaaatgttaattttaatttgaataatcacaaatggttagtgactaccatatcagatagcacagaagtagatcttcatttcacaaatagtgcatccctggaatattgtgggggcccagtgaaacatcagatgaaaaggggctttgagaggcatggtgggcagcacaagcatgagtggaatcctggcgccttgcagcaaaggcccctttgggggactcaaatctggtttaccacactgagtacctcctgccagttccaattcaggagaccctgagccaaggagtaaaccagagcagtggctctccagagtagtcagctaggacaccaggggcccattagcactacatctcttctgaggacaagaattatgggtaattcgctctctccatagctaattgttatagcagatacccaactccctgaaacaaaaaagctcaagggccatctccacaattgaaaggaaggctgagtataattgaatgcaaacataaataatggataaaaacaagtacagaatgtgctgccctcccaaacaattcaagagaactctttcagagatggaggaagacaggatagaaaataacttactaacaaagggcaaagggacaatgaactgcactgtattttagttcaagtggctgcaaatagaacaaaatggaaagttaaactctactgaataatgtcttataagactaactaaaaccaaaagttcaaaaaagtaagaaaatcacttcacaaccattttattcaaatacagcccttggggttttccccatttctgaggtttgaaggaatcatctccattagcaaatatgcactggctacaccaacattttacaatgacttttttcttccccacacaaagtccaactttagaaaaccaaaagcaagtacttgaaaacctgggattcctactttctctcatgtagccacagctatcatctctcagcaagtctccaaaacctatatttacacttctgatcttaaacaaaataatttcttacataactgaaagctaccaactttactgggggtggggggtggcacatattattgtacttggcaatagaccgtgaatgatgtatttttctccaaataaaactaaatataaacataaaacttgctggatacagattttaccacccattggacacactaatgaaaacagttaaatcattaggttttttaattaagaagtcaacatacgtccattcattttcacacaatgcatacagtgtggacacaaatggatcattccacagaaaaagctgtgggctaatgttgtcctgaaagattgaacactggctagctagattatgccaagtcctggctagagcttttaatcttaatctgactactgttcagtctctgccaaaaaccaacctgacagagcagatatttgagaaagatagcctaaaggacaggctcttcatgtattctactaagaggattctatattgcactctagtaccagcttaagacagaagcatacacattagatttgtcccataaaagacaaactcatacaacaccacttgtatgtcctcaaattttgttcagggtctattacataaggaacagactgcaaaatccattcctgtcttttctgaaacaagcttgtcattgtccagtacatggttaatctctatgataaaaatgcttttagatcaattcttaccagcaccaggaaaaagctgctttctcagcagacaactgactgctgagaactattagctttttaattaagtgacaattatgtgattcatcatatttccctttttgtcttggctaccaggatgttcagaaactatatttaatatttggaacctataaccaaagtagccaagttggttatgatatttgtttttcgccagtcccatacccatagaatttaaattagtttcaatttatatttaagcagtcttccatatatgtgtatttcactaaaagctaattaaaatcctttttattagcaggcagccctaaaaaagagttggactacctcactaagcacagcattaaccactgttatcgcaatatggcgtcaatgttgatccacgtgataaattcctgtcctacgacagacattcaagggaagggaagtgggtgcaggcagggcactgggaagggcagcatgctacaggacacagagtcactcaagaataatgaaggtgagaaaatgccctttcaaaaacaattagatgtggcctgcaatataaatttttttatttatttttctgagactgggtctcactctgtagcccaggctggagtgcagtggcacaattatggctcactgcaacttctgccttctggactcaagccatcctcgtgccttagcctcccaagtagctaggactacaggtacatgcctccatacccagctaacaatataaattttagacagggcagatattttctacaaataagaaaacatgacaaagagctcaagaaaccctccctagttcttggccctctacagtgtaccaccctgctgtgccatgaaccactgtcatgaatggagcctccgtagactatgtgaatggctacaagaaccacagaagaccaggcacggtggctcacacctgtaatcccagcactctgggaggccaaggcaggcagatcacctgaggtcaggagtttgagaccagcctggccaacatggtgaaaccccatctctactaaaaatacaaaaattggccaggcacggtggcacaagcctgtaatcccagctactcaggaggctgaggcaggagaatcgcttgaacccaggaggcagaggttgcagtgagctgagatcgtgccactgcactccagcctgggcaacagagcaagactctgtcttaaaaaaaaaaaacaaaaaaaacaaaaacacactgagaccagcccaagccattctcattgcagcctagtaaatatgtacagaggaagtgagaagacttctaatctttaacagcataagggggaagagggcagaattctaaaagaaatctagcattacaaattaccacttggtactgggcatcagaatagctgctatacacacatcatcttgtttaattttcacaacaatcatatggggcaggtattcccattttacagatgagaattctttggttacacaactagtacaattcgacaaatgtttaccaaacagaaattaccaggcattttgtatcctgcaactcacagtggtccctgcctagagcagccttcaggctgatgatagaactgagtctctaaccaggtttgtatggcttcaaaagcagctcttccattgcccaacactgcctcttctctgtgtctgagccagtgtgagggtatgctgagtctgacagcacctcaggaacaaccaaatcctgactagctgtcaacaccttccctgcccaccccaagaaagctgattgaaacaaaataggaaagtctctccccatgtgctacaagtcatttgatacaaagaccagaatctatgttccaagatagggcctggaagcccccgcaaagcagacattattaaagctcaaaagagaaattggtggagactggtataataatggattccctaagggctgaacagctcagcccctttggtccaaagcccttctatcattcttcctgtcattcttggaaggcagcaatccacacttcaattacttggtgtcttgatgaactgctgaactgaatttatctaatgccaggttagggccaaggttgctatgtgggaatggattcctctagagatcagtaggaacacacgtgaaacttccaatcacgttcttatcaatcataatcagtgagatcctagtcaggaagctgatcatggattaagcccatcagatcagccccatcagtcatatagctccagccatggaaagtcagtccctcccgaactagacgaacaggaaggccccaggatacccaggagagagcaggccaactcaaaaagcactgaagcagcagtctttgagcatgggcactgggccaggccctgcaggggctcaaggattcaaatgataccaactgctcctgatttaggagcaagaagcagggaataaagcaagtccataaattactgtaacctgaggcttgatgtgagcttcatgaaagagggtgtggaggggaaggggaatataagtaagagcacctgccactgggagaaactagggaggtgaaaattcagatgtaccttgaaggttgaggacaattttttttcttgctttatgttttctcatcactacaaaaatacacaaacattatttttaaaaaatcaaatgtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggaacacttttacactgttggtgggactgtaaactagttcaaccattgtggaagtcagtgtggcgattcctcagggatctagaactagaaataccatttgacccagccatcccattactgggtatatacccaaagggctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctgggaactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaataaaaataaataaaaaaaaataaaaaatcaaatgttacaggaatatattctcacactgtaattcccataatcatcatttctcaagtatagtaattaacaagggcacagttttgatttttttctctatatacatttacacttatcactaataattttttctagaatggaatcataccatacatactgttgtgcaacatgcttcaccatctagcagcatgccgtgaatagcattctgtggcaacaaatgtacatcccaacagtgccacagtattccattgcaatggatataaaagaatatggttttaacaggtaaaaatgatacaggctaagggacgggggagtggagaaggagagaagagaaaaagctacagggtgaaaagtagcatgaacaaaaacagggaggaaggaaagtccagggcacaatcaggggaaacagaagcagtcccatggctagaaaatgaagtgagtgtgtacaggaccacagtggaaagaaagggggaggtcgtggggcctcacagttcaggttgagaagttggatcttaactctaaacagtgggaaaccacttcggtttcttcagggaaaaatcttgtgacaataagaacagtggctttgaaagactaatatggtggccagcaattgtatgatgcactgagaggcaaatacacctggcgttgggaaaactaggtagggagctgttggcatggctttgaaagaagtcatggagtggaaacgagagcagtgggaatggaaataagtgatgggacagagcaatgcaagtgactaggctgggagaaaggaaggaaggagatgcccaagtttcaaggtgaggtaactgggagaatgctgatgtcatgattcaacaggaagaacaagtttggagggaaattatcataaggctggtttagaagactgtggagcatgaatgggacaggcaaatatataccaggggctgaaaacatgggatggggcacagcaagtgaggatgaggctggaaacacaggcttggatgtcatctgcatggcaatgagggctcgagccagaaatctctgagggagaaagtgaagacagaagaaacaatatttatgacagccttgataaatggctacatctttccagatgaaagaagaaaaggagtcaggaaagagctaacaatggactccagtgaaacaacagatgtagaagcaatttgccggccagcttggtggttcacatctgtaatcccaacactttgggaggccaaggcaggaggatggcttgagcccaggagtttgagaccaactgctctcctgggcaacatactgaaaccccgactctaccgaaaaaaaaaaaaaaattagctgggtgtggtggtgcacacctgtggccccagttactcaggaggttgaggcaggaggatcccttgaatctgggaggtcaaggctgcagtgagccatgactgcaccactgcactccagcctgagcaacagagtgagaccgtcttaaaaaaaaaaaaaaaaaagaagaagaagaagaagcaatttgccaaatttaacttctacataaatgagtttcatttttttatttttattttattttattattattagtttttgagacggagttttgctcttattgcccaggctggagtgcaatggcactatctcggctcactgcaacctctacctcccaggttcaaacaattctcctgcctcagcctcccaagtagctgaaattacaggcatgcacccagctaattttttttgtttttagtagagatggggtttcaccagttggccaggctggtctcgaaatcctaacctcaagtgatccccctgcctcggcctcccaaagtgctgggattacaggcataagccaccgcgcctggccataaatgaattttaaaataaattattggccgggcatggtggctcatgcctgtaatcccagttctttgggggctgaggtggatcacttgaggtcaggtgttcgagaccagcctggccaaaatggtgaaaacctgtctctactaaaaatacaaaaattagctgggcctggtggcacatgcctgtaatcccagctacttgggaggctgaggcaggggaataacttgaactcgggaggcggaggttgcagtgagttgggatcgcgccattgagctccagcctgggcaacagagtgagactccatttgaaaaagataataataataattaattatatttctttttttaaaaaaattatataaatagaaatggggtcttgccatgttgcccaggctggactcgaactcctggactcaagcaatccacccaccacagcctccacaaatagtaggattacaggtatgagccactgcacctagccaatatatttctttcttcatccccaactcatactccactcttcaggccaacaatcagacatcaacaccagcccagaccccaggatcctaacttccaccctctaggcattacttcattcctaatccaacatcctgctacaatcccatctctttcccatatgacaacagggtaagggaatcaaaggggttggtaagtatcttagaaatgataggtgccatgaggtccatgctgtgtggggaagagtgaggccacaaggacattgaaagactctaagaaccaagacaggcctataatcccagctacttaggaggcggaggcgggagaactgcttgagcccaggagtttccaggctgcagtgagctatgatgatgccactgcaccccagcttgggtgacagagcgagaccctatctcaaaaaataaaaataagatgactgctgatgggctacagtcctggctccctgaggtgaaacaataggcttatgggaactgggggagcaatcatactgttttgagggagcagtcatactgttttaagttctgggagagaagacaatagaggaggtgaggctgacaggttatgagaggaaaatgtcaaaagtaggggaaggccacaggagaagtgggtatggaccctagagtttctcaggatataggagcaactgggcttaagagaaaaccttctcccttacaccaagttctcaaacaatgggaagaagaaaaagcctcctcagggagaggttaccagaccacccctccacatcccaagtggctaatgtggctagcatccagccacccacccacagccaggtgctcactccctccctcctccaaaccagccaaggcagctggcatccatgtccaccataatgtaggtacctccctggcccaccatggaacactgcctctgctccaggttctatcctttgccctctctttccatgctaagcaatcattaggcccgtggagctgctgccactggagctcagactcctctgaaaagatgacagagaatctgaccctctgcttcctgctgctgttctgcccacaatgattctttcattcacttgttcagcaaacagttgctgactgctgactaagtgccctttcctttttgtcatttctctgacaaataacagtgaagtcaaaaatatcatgatacattttcaaaatccaaatcattcctggtcagttgactggctgacaataaagcctttctaataagtgggatttcattccccatgggaacacatgccctgtcctcaaatgccagggctgagctcattctacctgaaaagcagagtgtaacttctgatgccacctccactaccccacccagctcctgtccatcagctcagtttctaagaacaatttctggggcaataatgggaagagtccttgtgaaggaagtccagtgcgcacatgcctggactccaagctattccagctggactcccaactagactgcctatactgtggcagataagcccagaatcctccatggccctttcaagggaagacttggctttggtcagcagacagtctacacttttcagctcctgcagggtctgcctcagttgcagagagctactttgcatgaagtcatgattgtttaggacagcctgtaactagtgactgagccaggcatggatataaaaacctaaccattttagcctaattcaggatcatctgaaggacaatactcacttcagaactcctcactgggatgcacaagacttcatcaggcttacatcaaagtttgactgcttcctctgcccgatcctacttcctcccccttccttttgtaggggtcgatctctaataaacatactgcattcaaacctctatctcagcatcggcttcaggagaacccaacccacaacacttaccaaaagtttttcaaatttgagaagctgctacaccttgtgggttctgtttgtggcagaactccaagctctagtatatacggttggaacactgtcttagaaaggaggaggcagaaatagtaaatatcccctctgtgactatttaacatttgaaagactcctgagaaggccttttctgaactgaaacagtgggaaaagatttcaactgtccagcaccacccataaatcataaccacattctctagttagcacatactactcactactcaatcactagttcagattcttacccttcccttgaacttctgactctccactctcagtggaggcctggccttctacatcacagagcaaacagaagctgtcagacagggtctccccagcttcccaccagcaaacagatggagtccaccttttgaagaactttacttcttacccaccctctctcctgaagcttccacctgtccctatgtactagagtctctcatcagcatttataaatagtttctttttgttaaaaaagacataaagagtccatcagcagatgaataaacaaatttgtccatacaatggtatctccatacaatgatacattattcagccataaaaaggcatgaagtattgatacatgctacatcatgggtgaacttcaaaaattattatgctcagtgaaagaagacagacacaaaaactcatgtatgtatgactccatttacatgaaatatccaaaatgagtagatccataaagacagaaaggagctttgtggttgtcagatgttagaggatagggaaatgtggataaactgctcagcgggtatgggatttccttttgaggtgatgaaaatgttttcggattaaatagaagcggtgattgcacaacataatgaatgtactaaataccactgagcttctcactttaaaatgattaattttatattatataaatttaacctcaatgtaagaaaaagaataaagaaaaacttccctagacctcttctgggtagcatcttttctcatctcctttcatttttcttatactgataacttctcaaggaatgtctagacctccttacccgccattcactccaaagcccactccacaccactccactctcacccagtgacaaccactgatgcttctcactcctcccctcctgagatttcttggcagcacatgacacaggaggccagttcctcagtcctaaagtaagtattctgccctgacttccttgagactgaatacctgatgagttcctgccactacagcctctcctttgccagctcaccctcttctacctgactgttaagagttgaaacttctcaggatgctcttgattctcttctggggctcatcagttctcatgtctccaactgccatctagatacacatacacacaaacaggagcgcacagaaataaaactagaatgacctactggataataaaacatattgcaaaacctctacaattaaaatggtttgatactggtgcatgaatagacagaattaccaatgaagcagaaaagaacattcaaaaacagacccaactgcacacagaaatttaatatacagtaagagcagcatctcaaatctatagggaaagcactttcttttttagacagggtctcgctctgtcggccaggctggagtgcagtagtatgatcactgcaacctcaaactcttgggcccaagcgattctcccacctcagcttctggagtagctaggactacaggcacgcaccactacacctggctaattttttttcttttttgtagagacaggatctctctctgttgcccagactggtctcaaatacctggcttcaatccatctgcccacctcagcctcccaaagggccgggattgtaacaggagtgagccactgcacctggccaagtcaaactttttaataagcagtgttgggataactcaacagacatactgaaaaaggtaaaaattaaccccatgtcttatgcctacatgtcaagataaattccaaacaaattaaatctttaaatatacaaaatgaaaacatataagtaccaaaagaaagcataggtcaactactctataatctgggagtagtaaataataactttcctaattataagttggtggcaacaacttgttgaaagtaaataactttcctaattataattcaaaatccaaaagaaatcacaaaaatattaatttgattatgcaaaaataaaaagttttataaaaaataaaaatgcatggaaaaatatcataagcaaaaaagacaaatgtcaaactaggtaaagtatctgcaatttaatatcatagagtgttaatatccccaatatataaaaaacttttaaaaaataaggagaaaaagaccaaaaacacaatagaaaaaaaagactacagatataaacaggcaggtcacagaaaaagaaatacaatgctatttgactctatgaaaagatgttcaactttgctcatcacatgacaaagataaaataaaactacagtagaaaactgctttccacctattaggttgtaagtactttgcaggcgagactagggaaatgaaatttgcatatacagcccctataaaggggaatttgacaacatctaataaaattataactgcatttaccctctgacccagaagtctgacttctaggaagtgactgcaaagatatgttggcaataacctggatgagcctggaagtagattcttttccagagccaccagaaagggacacaggctggccaacaccctggtttcaggctgtgagaccctgaacagaagactcggctaaccaggacctagatttctgacctacatcaactatgaaataataaatgagacggtgtttgaagccactaagttggtggcaatttgtttcacagctgtaatttgcaatacagccctgcagatgggggaaagggttcacaccaaggctggaaatgggagtaagtggactgtgtgagatcttaggccatctagtttggctgaaacagcagacaggcagagctaaggacttagaatagctgaggttcttgaggccagccctccttgcctgaccatccaacgggagtatgggagcaggaggtgaagaaaaaggtcaaggaggggaaacccctggcaggctgcatcgctggtactgataaaaagcatatgatcactaagacttcagatttaccctaaagaatctataagtacttctgtttcttctactttcccttctccctctaggcctcccctcccttctttcttggacactcagactttaaactggatgaccttgaaaaaggtaggaaaaaaattttaacaaaaagggagcccattatttggtagaaatttctcctttgtaagttttccttttatataagtctatttctgtagataaattgaacccaactgtgatatttaaatcgttttaagaaagtacattctgttttacttgcaaaaagaggggacccttggcctcttccttgagacaggcgaaatggaaggggatgcaagataccctgcttatttatctccaaaagaaatctatagccccaagcccagcccaatttttgtgcccagcaggaacaggcctttgttcagagaacaccacaggtatgatgggcaccacaccaaaaacagaaagcagaaccgctacatctttgggctcaagacaacgggaacatgaaaacaacaggagatggagagtgccaggcacaagggaaataccttttatcttacattttgttgctcctaatgaccttgttcaggcctcaaatcagtatgacttcattctttgggaagtatattctatggaagctttaaaatatattatgaggttgctatggtttaaatgtggcctccaaagttcatgtgttggaaacttaatcctgaatgtgacaatgttgaaagaggtgattaggtcatgagggctttgccctcatgaatgattaatgtcactatcacaggagtgggtaagttttcgcaagagtagtttattaaaaaagcaagtccagctgggtgcagtggtgtgcccctatagtcctagcttcccaactacatggaaggctgaaacgcgaggacttgcttgagcccaggagtccagcccaggcaacatagcaacactccgtctcttttgttcccccccacaaaaggcaagttcagccccattctgctctctctccagcacctgctctgtcaccacatgatgcctttggccacgtatgccacagcaactaggcccacaacagatgcagctcctcaaacttggatatcccagtctctagaattgtaagaaataaatctatgctctttagaaattacccagtctcaattattctgttacagcagcataaaatgtactaagacagagataaatcaagttctaacacagggagacaggtgttattgaacaggtgccgtccacaatccttcagagcgcagttagctccatctctcttcccacactaacccagtccgtgtgtgtgaaaaggtaataacctgacacaatctccataccctggccattgcgctgaggatagaagagattggttcttctccgtgatggttaatggaggtcttcaaaactctttcaatcccttacccattacatttttctaaggtacttttaaatcctttcaactctgtatctacaacacactgtgtgaggtaaattttctttcatttgtcccaaatttaattcccttgggatcacatgatgtcaggctctactgaacaggatttgttgaaccagtccacattcccactatctttaccctataaattttcagtgcatggcaaagagaagctcaatacatactgtgagtagatgaattttccttctctggctttactccacatcaaaaagtcccatgctttcccccactgtcttcaaatccacacatactccacatctgtcatgggctgaactagaatcagaaataagtgttcctcctctcaggaagccagtcctggatcatgtttcaggtttaaacatgaaatggggagggtatcatcataaaccagccctcacctgcagcggaaacaatttctgccaggaaagtagtaaatgaagctatttatttgctcttcctgctgatggagtgaacacatcgtgtttctgtacaacccacctccaacctgactctcatttccatgctgagcaaaagtggaaaagaaacaataggaatcatgtccccattggaatgggaaaccactggaaatctcaaaagagaaacaaaggcctaaacacaaactcctcacacaccttaagaataaacaggtgatacaacagaattcattctatcattcattagccaatctttattgaatacctgttatgagccaagcacagccctgggctctgaagatccagatgtgagcaagacagaccaaaatctctgtccactcagggcttacattctagtagtggaaacagacaataaacaacactaagtaaaatctatagattaaataataagtgctaaggagcaaaataatgcagggaaagggatatgaaatgttaagaaaggctaaaacatttttgaaagggtagacagagatggcctcatagacaaggttagttttgtttttggtattattttggacttacagaaaactcagtgataatacagagagttcctagaatttctgtacaacatttactcagtttcagttcccctaatgctatcatcttatattaccatagtacagttgtcaaaactaagaaaccaacattggtatattagtgttaactagactccagactctttatgtttcactagtttttccatgaatatcctcttcctgttccagcatccaattcacaataccacaatgcatttacatgtcatgtcctctctggtctatgccagtttctcagtctttccttgtttatcaaaaccatgatagtttgcagagtactggtcaggtattttacagaatgttccaccatctgggtttgtctgatgtttttctcattagactggggtcgttggttttgaggaagaataccacaaaggtaaagtgtccctttgtctcatcataccatagggtgcatcatatccacatgacaacactggtgatattaccctggctcacttgatacccttgatcacaggtagtacttaccagatttctccactgtaaagtgactatttttccttttccaaaatgtgttctttagaaatgagtcagtaagtctagcccaactggaaagatgtaagctccaccttctagaggggggagtatctatatatatatattattggaattcttttttttttttttttttgagagcatctcactctgtctcccaggctggagtacggtggtgcgatctcagctcaatgcaacctccacctcctgggttcaaacaattctcgtgcctcacctcctgagtagctgaattacaggcgtgcgccaccatacccagctaatttttgtatttttagcagagatggggtttcaccatgttggccacgctggtcttgaactcctggcctcaagtgatccacttgccttggcctctcaaactgctgggattacaggcataagccacatgcccagccctattattggaattcttctgcaagaaagatttaacttttggctgggtgcagtggctcacgcctgtaatccaagcactttgagaagtgcaaaaaatacaaaattacaaaaaatacaaaaatgagccattgtggtggcacacacctgtagtcccagctactcaggaggctgaggtgggaggactggtggagccagggaggtcaaggctgcggtgagtcgtgactgtgccactgcactccagctggagcaacagagcaagaccctgtgtcaaaatttaaaaaaaaaaaaaatttaaagaaagaaagatttaacttttgagaagacacagaacaagatggtggaatagaaggctccatcaattgtccctcctgcaaggacaccaatttaacaactatctgcacaagaaaagcaccttcatgaaaaccaaaaatcaggtgagcattcacagtgcctcttttaactctgtgtcgctgaaagacgcactgaagagatagaaaagatagccttggattgctaacgcccacccccccaacagtggcagtatggtatgaagaatgtctctgggcactggcagagggagagcacagcaactgtgaggcactgaactccacactgtcctattagagcagatagaaaaactggaccaaactcagctgacgcccacccatggagggagcatttaaaccagcccacaccaacagggaatcaccgatcccggcagtttaaacctgagttcccacaaaccttgccgccacaggctaaagtgctctgggtctctaagtaaacttgaaagcctgtctagaccgcaaggactgtaactctcaggtgagtccaaatgctgaactggaaccagagacagtagacggtggggcggcagaagagtgggaaacacaatctcctaagacactagccaaggcgcctaagggaatcctggcatcatccctcctctaaccctaggctgcacaactcacagctccaaaagaggccccttccttctgcttgagaagaagagagaaaagagtggggaggacttcatcttgcatcttgaataccggctcagccacagcagaacagggcaccagtcagagttgtgaggcacctgttctaggccctagctcccagatgacatttctagacacaccctggccaaaagggaacttgctgccttaaagggaaggacccagtcctggcagcattcgtcatctgctaactgaaaagcccttagaccctgaataaccagcaatgatgcccaggtaccatgctgagggccttgggtaagcctctgagacagctcagccacaggtgggtagagcaccaagcagggccctggggtcccagattccaggatctgactcttggatgacatttctggacctaccctgggccagaagggagcccactgcgctgaagggtgagtcccaggccaggcagcatttaccacaagctgacttaagagcccttgggccttaagggaacatcggtggtagtctggcagtactccccatgggcctgtagtggtggtggccacactttccaaaggtggcctttggaaaggggagggaagactgtgtcttgtggtttaagtgccacctcagctgcaataccacagaataccaggtagatgtctaaggttttttactctagtccctgactcccaggcggcacctctagagcgaggtgccgtctgggaatgatgtcccacatagcacctgggggagctggctgccctgaagggaaggatatgggcctggctggctttgctacctgctcattgtagaaccccagggccttgagtgaacataggcaatagccagggaatggttacagcattggaataacttaaagactcccccaaaaaactattagaattaacaaacaaattcagtaaagatacaaaatcaacatacaaaaatcagtagcatttctctttttttttttttttaagacttctcaccgtcacccaggctggagtgcagtggcttgatctcagctcactgcaacctccacctccccagttcaagcaattctcctgcctcagcctcccaagcagctgggactacaggaacacgccactacgcctggctaatttttgtatttttagtagagacacggtttcaccatattggccaggctggtcttggactcctgatctcatgatctgcccacctcggcctcccaaagtgctgggattacaggagagagccaccgtgcccagccctaaaaatcagtagcatttctatatgccaacagtgaacaatctgaaaaagaaatttaaaaagtaatctcatttacacactaaaattaaatatctaggaattaacttaaccaaagaagtgaaagatctctacaatgaaaactataaaacactgatgaatgaaatggaaaaggacaccaaaaaatggaaagagattccatgtccatggattggaagaatcaatgttgttaaaatgtccatagtacccaaagcaatctacagattcatgcaatccctattaaaataccaatgacattcttcatagaaatagaaaaaccaatcctaaaatttatatggaaccacagaagaaccagaatagccaaagctattcttagcaaaaagaacaaaactggaggaatcacattacctgacttcaaattatactacagcgctatggtaacccaaacagcatggtactggcataaaaacagacacatatgccaatggaaagaagagagaacccagaaacaaatgcacatacctacagtaaactcatttttgacaaaggtgccaagaacatacactggggaatagatggtctcttcaataaatggtgctgggaaaactggatatccatatgcagaagaataaaattagacccctatctctcaccatatacaaaaatcaaatcaaaatggattaaatgtttaaatctaagatcccaaactatgaaactactacaagaaaacattggggaaaatctccaggacactggtctgggcaaagatttcttgagcagtaccacacaagcacaaataaccaaagcaaaaatgaacaaatgggatcatatcaaattaaaaagcttctgcacagcaaaggaaacaatcgacaaggtgaagagacaacccacagaattggagaaaatatctgcaaactacccatctgacaagacactaataaccagaatatctaagaagctcaaacaactataggaaaaacaaacttaataattccatcaaaaaaatgtgcaaaagatttgaatagacttttcttactctttttttttttttttttttttttttgagagggagtctcgctctgtcactcaggctggagtgcagtggtgtgatctcagctcaccacaacctctgcctcccaggttcaagtgattctcctgtctcagcctcctgagtagctgggattacaggcacccaccaccaggcctggctaatttttgtattttttgtagagatggggtttcaccatgttggccaggttgttctcaaactcccaacctcaagtgatctccccctctcagcctcccaaagtgctgggattacaggtgtgagccaccacacctggcctgaatagacatttcttaaaagaagacatacaaatggcaaacgggtatatgaaaaggtacttaacatcactgatcgtcagagaaatgtgcatcaaaactacaatgagatatcatctcatctcaccccagttaaaatggcttatatccaaaaaacaggcaatagcaaatgctggagaggatgtggaaaaaagggaaccctcatacactgttggtgggaatgtaaattactacaccactatggagaataattggaagttcctcaaaaaactaaaaatagagctaccatatgatccagcaattccactgccggatatatacccaaaagaaaagaaatcagtatatcaaagagatatctgtactccatgtttgtagcagcactgttcacaatagccaacattggaagcaacttaagtgtccatcaacagatgaatggatttttaaaaatgtggtacatatacacaatggaatactattcagtcattaaaaaaaaagaatgagatcctatcatttgcaacaacatggatgaaactagagatcattatgttaaataagccaggcacagaaagacaaacatcatatgttcttacttatttgtgggatctaaaaatcaaaacaattgaactcatggatacagcaggtagaaggatggttaccataggctaggaaagggagtggggaaggggaacaaggagatagggatggttaatggatattaaaaaaatagaaagaataagtaagacctacttttgatagcacaacacggtgactgtagtcaataataatctaattgtacatttaaataactaaaagagtataactggactgttcataacacaaaggataaatgcttgaggggaaggataccccattctccataatgtgattattacccattgcatgcctgtatcaaaacatctcatgtacctcataaatatatacacctataatgtatgcacaaaaagtaacatgaaatttttttaaaaagatttaacttcttctcccctagtcatttatttaaatgagtttagactcatgtacatttattttataatttgagttataatccaatattaccttacttattttgttgcttcatatcaatccagctttggacactggaaaagaagaaagtcacttctgaggaaagactaagggaagtgagggagctagccacaaagccatccagtagaagaacattctaggtcccaaggtgtgacagcctgatgtgtttagggaacaagagcaagaccagagtgactagaggagaggaaatataagggagagtagcagcaaatgaaatgacagaggtaatggtgagccgcatcacagagctgtgcaggccaaagaaggagctaacccttactttatgtgagaaggaacaccagaggatatttctaagcacaggaaggcatggtagaaggatcactggctgctgtgttgagaaataactgcaggtaattaggacagaatgagggaggctaattagatgtctattcaataatccaggtgagagatcatggtgatcacacgggtgatgagaagtggtcaaattctggatatattttttgaagacagagctgttgggatcggctgtcagacagaatgtggggtcttagagaaagaaaggggtcgagaatgactgtgaggattttgacctgaaaaattaaagggatagaatagccattaactgaagtggggaaagctgcaggagctcagttttagacatgttaaatttaagatgcctatccaagtaaaggtgtctagtaggcagatggatctgaagttcagagaagcctaggttggagataaaaaaaaaacctagcagtcatcagcatacagatgaaacatgaagccatcagactagatgagtcaccaacgccttaagtgtagacagagaagagcagaggtccaaggactgagcctggggcgttctggcactgagaaaaatcaagactttcttaccttccctttaatcagatacaaatgtagcaagttttttttctcatccactgtgtacctagtactgctctggattccctaactctcagaatataaccttaactctccctcacctctctgtaattctccatcctctgttctgtgctgccgtacacctggtcaccatcataagacagtcattactgccactacctctttgcaagctgctcctcccacctggaaaaccctttatactccacctcatcaaataccagcttttccaagccccaattaatctcctatcttttctctgaaatttacctaattactctcatagtgaatgagcttctccaccaaagcaaccctaacacttcaatgactaccaacgttgaacttaatgtctgtacaatcagatatttatcagttattgacctgtgtggctaactgtatataaactgtgtataaatgctgtagcttcctttaagaagaaaagcacatctaccttttctcttccccccaaaatagcctagaacaaatacctaccacatagcaagtgctcaataaattgtgtgtgaattctttcatgttaattctgttattcaatcagtcaccatgctccctgagagtagagacctgttttgtatctcctccatttgattctgggttagacacaggtaggtaggcattcaataactgcttgctatcaaaggggatgatgacaatgtgaggtctctggggaccttacgatcttggcacaaaacaatgagaatgtgtattctgttcttgctacccatctcacctgaacccagctatttcctggacaaagaagaagaatccagggaccacatagagaagaaattccagggcatctgatgttagtgcagagagatactcaaaatcatggtattatctaaaacgcctggaaaagagtttgccctcgctgaaatgctgggtgaaaagaatcagaaaagacacgcacttgggtgtgaatcctaagaacacagagaatacatcaaaataaatacaagtatattcactaatgaattatttacaacagtgaaaaactggaaaccatctaaatgcccaaccgtaagaattaagtataatttggtatattcatacacttgaatatattaaagaacagcacctggaaaatgttcactttatgcctaaggctcactttatacctatatgctggaggctctaactttcagtctccatttctaaagggaaagtatctgtctcaaaatagtctgtacagtatgactgcacttttgtgcaaacaactggaagaacacaagccataatgttaattttacatctgcacagtgggatttgggtgattttgttgttgttgttgttgtctccctttgtgtttttctatgttttccaagtattctgctttgaaaacatattactttgtcagcaggcaaaaaaaaaaaaaaaaagagagagagagagagagaaagtcattttaaaaacaaacatataagagccaaattctcaactctctaggcatctgactgctgaaagtatcctacttccaatataatatgcaagaatcctaaggtccagccccctcctcccattccttcccctcccatagcacccaagacagaaaacagatgaaactaagatcaagggctgcttttttctttttttttttttttgttttttgagacggagtttttgctcttgttgcccaggctggagtgcaatggtgcaatctcagctcaccgcaacctccgcctcccaggttcaagcagttctcctgcctcagcctcctgagtagctgggattacaggcatgcaccaccacgcctggctaattttgtatttttagtagagatggggtttctccatgttggtcaggctggtctcaaactcccaacctcaggtgatccacctgcctcagcctcccaaagtgctgggattacaggtgtgagccaccatgcccagcctatcaagagcttcttaagggaaagatcctgtccttttgatctttggtctcccacctcaaaattctcagcaccctgtgaggcattaggcgctcagtaaacaagaaagggaaggaagaagatgtagtgaacttacaaggcatagataccactaccgcaatgacatccccacccaaggtaccgctccaccctattctaggtctgatccctttctctcctatctctgagcattgcacaggcctgtcaagcagctcttagaataagagttctgattctttgcaccacagcaagtattcctcttttgcctttccccctgcccctttccttcctccctctttttaaaaggtgatcttgcctttcggctagtacaatgtgctgcactgaaccagcgtgccagtcagtctgtggagaatcagagagaatgaatttgaataataaaagccagaacaaggcgataccttggagagagacttggtgtagtaccttcaatttagaacctcatttcagtggctaatgcagttgttggagacattagcctaatttttgccaggagagtccagcaacacagcagtactaaacatgggcacagtggaccctgctcatctcagagacaaagtgtggagaatgaaattagcagcactgcacttctggtgcagaggaaagcaaattctcactcccctcccccaattcattaccaatcatctttaaaatgaaaaacacagacatgtgtgtgggagtcagcataagcatgaagttcaagggaagccaggaccctgaagaaactcccaggaggcacttatggaccatgggaaagttaatttcaaaggacatccaataaatgctgccctaccacagatcttgtcattgccaagccctatttgctgcaggcctgggaaggctccagaacctgctggcaggtcagtttgttgaggccagaaatgggaaggagagcccacaaaggccaaactggaagaaagaggctcagctctagacacatctacacagactggggtgagggttcctacaacaagtgcttcctattggctaggttaaaaagaagccacacctggtctggtccagatttgtcctaagtctctccctgtgtgtcagcctccatgctgcaggagccaagcagctcaggacctttcactctgctgtagctgtgagcctttaaagacggcagcacgtggctcagaggtagcaacaataattgtaggtaacagactgggcaggggcctcctggctcctcctagaccacgccaacaatgggtcgagcatgggtgtccctggctagccaggctgaagaagggactcctttctcttgttctaacaggctggtaggccagaagtcctctctctgttcctgctggtctctcactgcctctgattccccaaagtcccactctgctccctactctgttattcagggtccttttgtcttgtccagagatgggtaaaaggaagacaaagtttaaccaaagtcttcacagacaaggattttctagaacctaatgccccttttcctctcctctcccctagcagagggcaaaggaaaacccaacgttaccagtaactcactttcaacagtatcacagcatcaccagcactagcctggaggcctcaacgaccctgacatatcaacataatgacagacacaaggacacctgtatatccagatccttgagtgggttagtaagactgccaatctttttgtttgaattgattcccaggtaggctgtggttaaggattaagacttaaggcccaggcactctgctatgacctcactgtatttaatgcagcagtaggcacatggcaagtacccaaacacctcaggacttgaactcttcctaagggtctctctgtgaagtcccaggaacgtgagagactgtcctcttttcctgacagatactgaaggccaatcctagagaagaaggaagggctgcttagaggaaaagcggaagaaatgagaggctaggcaacccagactccacccaagaagcacacgcaatgaggggagcagggcagggatagggcggcaggactcgctctccgtacacacagcctgcctgccaaaatttactggatggcaggaatcctagatccgtgggtgaggattgagtcatgttatgaatctcctttttctaagcagcatgtgaaaaaactcctccatctcaggaagagaaggtggggaagaggggggcgatatgtggggaaggtggtggtcggcaactggaagcccagatttcattctaatgccagaacagcctcctcaaattacaaggggtccattccagaagaagctaggcaggccaaggaggctggactgtggctttggatagtcaaaataccactgacatgaaactgtatcatcgcagtgttgataatttccctggaagaagcaaatcctcccataactataaatcaatccctcactgcaattgcagaaatctatcaaaaaaaaaattcagctgttaccagaaattctaaatgcttggcactagaagcataattaggggagattctgaaaggtgtcctgaggcaggccatacaagaacagagtagaaaggagttatatacccttagaaagctcatttagggaatgggctgtgcataatgcatgcaggcccgggagtgcagacattccctcccggcggcctgctcagaggcaggctgtgagccgcgacactggcagatggctgccccggtagcaatcgtgcacgctccaacggccgcctcctccagtccacccttgagcacaggcttatgttcccaaaaggggtggagagcaccagcaaacattacccccaaagaatagtggctttccctagggaaggtaaacatttccatcagaaggcagaagccggcacaaggcaatttctctctgtgcagggaaaaggagccgcaaacataaagttgctcagtcaaaagagacagatgatctctgcaagcgaagccgtgccaaactgtctgtaaaggatttgcacatccatcagcataagtggctgtgtaggggagggggacgcaggagtggggaaggcccactcatggtgcaggattctcaggactcagaagccccaggagaggagaagccagttatttttctgctagtgctctagcctgagcaaaggtatagcaaaaggcttgatttccagcagattctctctgctctctcaatcctcccaatccatactcaaggtctgtccacttcaagcctctgcattcacaaggttttggggccactggctattcaatcttgagccagccacttctccttcccactggcatcctccacctttttaaagtcacgtgtgactaaaagagaaatggcagttcactagtcttatgcctaaaataacctacagaaaaatatggtttatgaactatcctgtaatataatacacaattcggagcctagccatttgtcacagcattgagtaatccacatacatcccaagggtctgacaataagatgtgtaaatcaacagcaaaaagcagcatagcttagccattgagttaaaatacaaagaatgttttttagcattgattttttttaacttagaaaatatgggcttctgagggtaaatgcttgtaagggagttgtgtgctagaatgaaagactctatactttccagaacccccgatacctgacttcaaagcaaaaataaaaactccaagactcacattcttccaatgatgataatggctttcttctacaaaccctgctattagcatgacagggatggccacatcagtcataagaaaagcacatgtaccttttacacttaagaaaagcaagcaaaatacctgctttgtgcaaaagcaagccacttggcaggaaagaaaataataaattactgcaaaggcttgaaattatttttctttctctggatgatcaaacaatgagcgtaggggtaggcatcacaatccacaaacatactgccatagtgattggtgcttaggtaggataaaacaggcagaatttcatttatattccaaagaacagagacaagtgccctgatcactcagccctgcagagagtcctaatgccacatgagtggcctcctccccagttgctgtatggccccgctgcaggatctgatctggggtgtgtgtctgcattgctatctgaccaattatctgcctagaacagaccttgcctgaggatgcagcaggtgtgcaggtgcttaagaggcaggtgttgggatccctgagtaagagccctccttctgacatgggaggcaagactgactcaggtgttacctgttatgctgggggcacagctataccctggtgagtttctcctttacttaaaaagatcacttagacattattctattttagctttttattttgaaacaattttagacttacagaaaagttgcaaaaaaaagaaaaaaaaatacagagtttcccatatactcttcatccagattttcctgctattaacgtcttacaaaactataggacaattatcaaaactaagaaattatacaacagtagtaactaaactatagactctacttggatttcaccagtttttccactaatgtttttctctcttgcacagtctaatccaggatatcacactgtatttggtcgtcaggtctcctttgtctcctccaatctgtgacagttcctcagtctttgtctttcatcacctggacatacttgaaaagtgctggtagttattctgcagactgtacctcaatttgggttcatctgatgtccactgatttttaatacaacagaaaaaacaacagctaacatttactgagctattactatgcacctggcatcacagtaaacatttcatgtttaccttatttactatttaaaataaccctctgaagtaggcattattactacccctattttacagagagggatagttcattaatctttactgtaattaagtaacttgcccagctactagctataaaagacagagcagaggtgtgaacccaggtagactgactctaaaacactatactacatgctatattcaaggcacggcagcaacaatcaaatgccaaaatacaatctgggctcagctcttggccattccctctccgaagaatgtgtctcattgaagaaagggcattataggctttatctttcttccaaagacgacgaaatactccacttgaatttctgcccatagaaccagaagattttttttctcttgacaagaagcaccttcctggattaagggtaaagaaaaggccattgttctcctgagacctcactctggactggtgccagatggagggaaaaatagatgagcatgtaggtgtgctcaattcaagagagttctattccgaagccttttcaagcctatggaaacacggaggtcacaaaaaggggaaaaagctcctgggattgctttttttcccatgttatgcccagaaatatccaatgatgggcaacacaaacggacaccttgtcgttagtattaggatctttgggaaagttgaggtacaaactattcatgtggcacatggtgtgtgtgtcaagggacagggctgtgggaggcaggctgggaagaattccagctgcactccaggatttgtttttaatgcttatgactttagatcactcagttccacagacttgatttttcccaaatcccctctctggcaacgctaatgtgtttttcctctagttctgactgatcagcgaaatacgtggctggaagaataggctgggaaatcatttctttgatgctagcagaattgagaaaatattcccccagctacagacctctccatctattcatccctgccacctgccagtcagctgcaggtagaggcagctaggaaggtaaggtggcagggagggcaggatgtgaaggaggggaaaagggaaaagaactgagagcatgaaaacaaggaaaagaaaaaaaaaaaagagtattgtgttcaaacggccactttagaaccaagactttcattgatatgcatcagcagtgtcagatgaagccagcaaataggtgaaaaatgctcagccttccttagaacttttcttctgctcttcaccccacaaagtacatcccttaacttcaaaactaagatggactcctgtaaatgaaacactttatctgggtgcctccattactgccagctttgtaaaagagccctctcctttgaaatctactgttctatacctaactccaaagtatcctcagctagatactttgatcaaatactggaagctaaaatgctaaccatctttagggaacaattcctccagcctctacatctacaatttaacccagtgggaatctaaagccagctaacagccctcaaatcacactgcacacagggctgcttactctgctgtgtttagggacataagaattaatccctaagatccaacttagaaacccaaacagggcagcttgataattctgtgtctgcttgaataatttccccctctcagtgtcaaaggccttcaaaattcacattattttgttcccatgtagacgtcaaataaaactgctttcagatcatgaccccgcagattccatcttcagaagaaaggaaatctgggaaaagcaatgagatctgaagcccctttaccaatggaccatgggctccaaaagagaccaagagaaaacataactactcccttatggggtatcttgaggacttaatatacacaaagcacctagcacaaggggatgttaaaaaaaaaaaaaaaaaaagcagttttcttcctttccccatccaactgctagactggaattcctgggtcctatttcccctctgtcttttttttttttttttggtaaaccccttccattctaggatcctctcagtcatttcttggtcatgagatactagacaacctcctcatcctctaagagcctgaatgacttggccaggcacggaggctcacgtctataatctcagcactttgggaggacaaggctggcagatcacgaggtcaggagttcaagactagcctggccagcatggtgaaaccccgtctctactaaaaatgcaaaaattagccaggcatggtggcacgcgcctgtagtcctagctactcaggaggctgaggcaggagaattgcttgaacccggcagatggaggttgcagtgagccgagatcacgccattgcactccagcctgggtgacagagcaagactctgtctcgaaaaaaaaaaaaaagaagagcctgaatgacttgaccaaactgggagatgatggaatagagattaaaaagatgatgtttatataacatttagagggctactggggtggggagcaggggtcgtttcttttttcccctaaggaaaaagaactttacaaatataccatattactattccttaaaaactcacccctgcccagataaactcattatggccataggtaatcaaatctgaagacttttaatccaaagaaatggttctcttcttccaaacagctgcattacacaaaccataaacagactgttctgggaattaaataaattaaactaaaactcaatctttgtttgcccaaatccacatattatgggaaataaggaaaaaccaacaacttatgagtttatgaataataacaaaacaaaacccccacatgaacagaaatataatcagcttgattagcacccaggcaacaaaaggctcacagagcccctgcacacaaggctgtgcttcatgtgggctcttgacaggctgccaaaagatcagtggctagtggggtgccacccccaccctgccctgtgcactgccagggcctcaaagagttcccttgatgttccctgtcttcagaagagggaaggttggagcaggttcagaggagcttccaaaaagctctccagagcttgccagaaacctggcttcacaaagccccatgggccagatggacaaaagtctcccttaccatacccagagacaacccaagagtccccagaatgatctgcctatcattcctcagactccagccatctcactgtccacctatgtatgcactgcccagggctcagattactcaaggaagtcaacaaacctcacccaccacagtgtcaggttgtcagatgttaactggacttttcctaatactgggtgatgctcagttctgacctcttggttgtccaagcaccttccccacagtagttcttcccaaccttccatttctcaagcacccaaatgggtacttctctttcattgctcaaagcagaagaccaccctcagcttggctcagaaaactgaagacatctaataggagcttcttcaatttctgtctatatccctaccacctttctgtgtccctttctagcctctgcttctaatttctcagtctcatcacatttatgaagccaagactgtccatctgctacctaaataactttgccccatcaatgatctcctctatgggattataaatctgtcaacactgattcctttcccctctgccttccaacatacagaaaacctctctccatccagctccaatgaccccacctcagggaagcctttccttcagtgtcctctgcattctcactgagccaccttcctgtagggggtcctccatcactataagcccaagtgagcaacctctgtcatgcccaccatggtatccctggcatcaagcactatacttccaggagttcaacaaatggaatatgaaatgaacaagttttttgatatggctatcgctaactgaaattgccctttcagttctcctcttctactatcaaactcctcaaacccaggagtttacatcatctttcttcatctcctcatctcccagcacagctcctggttggattctatgacagactaatctgttacacttaagtttcacacctctcccctctccccactccccacggtctccctctccctctctttccacggtctccctctgatgccgagccaaagctggactgtactgctgccatctcggctcactgcaacctccctgcctgattctcctgcctcagcctgccgagcgcctgcgattgcaggtgcgcgccgccacgcctgactggttttcgtatttttttgctggagacggggtttcgctgtgttggccgggctggtctccagctcctaaccgcgagtgatccgccagcctcggcctcccgaggtgccgggattgcagacggagtctagttcactcagtgctcaatgttgcccaggctggagtgcagtggcgtgatctcagctagctacaacctccacctcccagcagcctgccttggcctcccaaagtgccgagattgcagcctctgcccggccgccaccccgtccgagaagtgaggagcgtctctgcctggccgcccatcatctgggatgtgaggagcccctctgcccggctgcccagtctgggaagtgaggagcgcctcttcccggctgccatcccgtctaggaagtgaggagcgtctctgcccggctgcccatcgtctgagatgtagggagcgcctctgccccgccacccagtctgggatgtgaggagcgcctctgcccggccgcgaccccgtctgggaggtgaggagcgcctctgcccggccgccccgtctgagaagtgaggagcccctccgcccggcagccgccccgtctgggaagtgaggagtgtctccgcccggcagccaacccctccgggagggaggtgggggccagcccccgcccggccagccgccccatccgggagggaggtggcgggcgcctccgcccggccgccgccccgtgcgggaggtggggggcgcctctgcccggccgccccttctgggaagtgaggagcccctctgcccggccaccaccccgtctgggaggtgcacccaacagctcattgagaacgggccatgatgacaatggcagttttgtggaacagaaaagggggaaatgtggggaaaagatagagaaatcagattgttgctgtgtctgtgtagaaagaagtagacataggagactccattttgttctgtactaagaaagattcttctgccttgggatgctgttcatctatgaccttgcccccaaccctgtgctctctgaaacatgtgctgtgtccactcagggttaaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagaaacctttgttcacttgtttatctgctgaccttccctccactattgtcctatgaccctgccaaatccccctctgcgagaaacacccaagaatgatcaataaaaaataaaataaaaaataaataaataaataaatttaaaaaaaaaagtttcacacctttaaatctactggcttgtcagttctcctcctgatctcctccctctccctcactggcccccacctctgacagagtggatgctgcccacccccaccacctcatttttcccttacacacacctgccactccagacaagcagatatactctcacttcaggtctctgttcatattatccccaccaacaccactactcatactttgttctcttctctatctagtgaagtactgtctctaagttatagatcaattcctacctccaaggctctgacaaaactaagaatgcaacaggttctgggaaagggcctctcattcaagctctaggccagcccttgagaactactcctagccctggttagtcttaaccgtggagatgccctgggctgtcttggccagtggggtgaggccaatattagaaaaggaagcaaagtcagagctacaaaggttctctgaactaaaacaaagtctgtggcatgagggctgggactattttggcagctagttttccatcatccctacttggtctaagttttccatctcagacatttgggtgtcccaacctttgagagttgaggctatgccactctgctcagcactcctgattaaacctcagagagaacaggtggatagaagcagaggaaggggaggataagggcttcagggtgcatgttaagcatacaaatgcttgttagaaagaggatggccaacagctgctctccatcaccacccaaatgcacagattgcaaactggaccctggcctgtcccatccgggtaatgaaggccaaagccagggcagacatgctttggtgtcagagcagaactcagccagccggctgcaaagtggcctcagtcttggcagtggctgccatggaggttgcagtccttcctggcctggcctccacctgctctcccagggggctgtgggatttagctgctgaggggcagtgatcagccatcctgagaggctagtgaagagacctccctacatgagaaatgaggtctctctgcaatgaagagatctaaatgatcctcatggagcctcctggggccttcctgtattccagcccaccatctttttttctctcccagtacaggataatttgaagcctcagaaactgctcctataggcctcaagagacctggcatccttccatcccccaagtggttctccctaacaagcttgtattaccaaggagcaaaggagatgctcagagtcgagaatgcttagcaaaggctgggaaggtggaagttatagagggagggaccagaagtataggtagaagaggaacaaatgaagttctaaggaaatccccagaagactagaaagccctcaaagtaagaagggtggcactgtgcagaaagaagtagcaccaaaagtaagctctgttgaatacttcatcctgaaaagttgccagagatagcaacttatgtccaagaagacagaccaccccaacagaatcaggctgtttcttctatttagcccctgccccacatttccagcactgtgcttgagccagggtgaaacatcatccaacaaagacccctggctatccccctcccttaagtcattacttccttaacagcagctaagaagtcccactgtcacactttgatgagccgcaggggcttaggcatgaagtgtcctgaaccaacaaccttgctcccacccaatttcttgggcctcacatgtgtgtgcatgtctatgtataaaggatgggacagaagagattatactcttggggaccatggggaatgagaagacccgtaaggaagatccttccaggatcagggagggagggagggtcacctgcctcccaaccacagacctggggagggggcagaacacactgggagctttgccccccttagtctcacttttattgcaactgtggtataataaaaaatatgtgtagtctttgaccctggttcctggctcattgtttctaaaactcttggaattttttgagccataagagtgtactttgttattcctaccaaacccctttcaactatggggcttttatactgattaggtgactcttggttggaggttctaaatagcttcaggatggaggctggttgccagaaagaccaacccaggattagagggctggaactttcagccccagccccactctgacctcaggggagggaaggaggactggagattgagctaaattatcaatggccaatgctttaatcaattatgcctacataataaaacctccataaaagccctgaaacaacaggattcagagagcttcctgaactccacttgagcatgagggttggcggacacactgaagtgctagaaggctctgcacaccactccctacccccactccaatatcttgccgcatctaaactcttccgtttggctgtcactgagttgcattttcataacaaaccaataaacataaagtgttttcctgagagccattctagcaaattattaatgtcaaacctgagaaggagattgtgagaatccccaacttatacctggtcagtcagaaatacaggtggcccaggacttgcaactgccatatgaaatggaagcagtcttatggacttagccctttaacttgagggatctgagactaattccacatagacattggcagatttgaattgaattgttgcacacccacttggtgtcagaggagtggagaaccacgccgcccctccaaagctgcaaagagccagaggcccaacagaaacagtgtcacagagtcacccagaccagagtcaggtgctccttcagacagatgtccagggcctgcaggaaatcagactcctctcttaaatacttgaaaccagagtagttggtctactataaatgaggtttttaaaattcaattccctcttattgctcgtgcagatctgaaatgatctgaccagatggctggtgctctataattcttggattgctctcatcagttgttgatgatttggaatttttttctttttcttttttttccccctcacatgaacgtgttcctgcacaggcttcctgcgtgctcacattgagtgggctctttgtgctaatgccaatatttcagagactctcacagccgcctggagtcagatcaggtcaataaggagccccaggtctgctcctggctggctacgcttccctgagcccacatggggccaacatgcagcactgggtaatgagcagaacaaggggccctctgccagggctgcctccttacctccacttccccttcaggtccccaaggaaagggaggtagcaaaggtgtatatacatagatatatatttttaaaaagactatgttgccaaggctggagtgcagtagctattcacagacaccaagttaccaatgatgcaaactcctaggctcaagcaatcctcccacctcagcctcctgagtagctgggactacattcgcacgccactgtgcccagaacaaaggtatatatttttaaatgacaactatagccacttattgaatatggcctatgtgccaggccctgtgttgaacattttacatatgttaaccttgtttcattcttacatcatctctgcgaagtaggtattatattttcatccctatcatcagatgaggaaactaaggttctgagattctaagcaacctgagcaaggccacacagctcaaagagagagctgcagatggagttggagattcagcatcataaaatttgatgaactgccccacacagatctcagggttaaagagaaaaggccctggccttgccataccatctttatgccctcactgagcacaaaatacttccaccaagacatccaaaacactttggtggctgtttttgtctttgttctctgtatcctttgtaagattatgagctggatagagggcaggggtcacgtcctttttgctacacaagaagatagtatggcacagtggttaggagctggggcttagagccagacaaatctaggtttgagtcccaactctaccactttttggttgtttggctgagtccttccttctgagactcagttgtatctgtaaaaatgaggatagttatagcacctgccctcaaaggatgcctggcagagtcagtgctcagtaaatgtgagctgttacctatatctctggctatagatgatgcccagggtgcaggagcccattgaagtggctgtgaccagcattctgtaataccaactgcacaggtccaaagtcctagtgttcagcctcaggtcctcagcctcaggacaaattcctgagttccctgcccagaacccccaggacctgccagcaaacagctttcctctgcttgcttgtgaacagctaatgctgtatccaccctcaaatgcttgctgtgcctccgtaaggtgaggcagatcccaaaataaaccagaagaaagagacaggaaaatcacttctaggaacaagcagctcccagtgaggatgctgacagtaataacaggggcagatagacttcaggagattcacctgcagctgttccaggactgagtgactggggcccaattcctacctggactgcagggaaggcccacgaagtcatgagtttgtcccctggtgttccaggcagcaggcagtctggaaatctgccttcaaatgagcacagccaaaacagcccacgaaacctagttcccctcttgggagcctaaggacaacacagctgtggtcctcccttaagagccctgaggggacagaaggtactgaactggggacaataactgtccatataaacttgcaattttcttaaagtccaccgtcttcctgtgccatgccactgactctcagacaggaaacactctgctaaccccttttgctcgtgcttacccttgctccttgatcaaagtctctgttgagggagagaggacatttcatgaacatgcaagtctcttcttcacatcgtaagttccctttcccatgtaaagccatagggacagaagcctacatgctcatgtaccctcaccggcatccagtgattccacaatgggattgaagggatggccaagtggagaatttaccactgaaaatcagaacagctgtgtactgagtgatttctccatgttaggaagtaggcagagggctttgcatctaccatctcactccatacaacagcctccgcagcaggcagggcaggacacttcccccatgccaccccatgcaaaaccaaggaacagaaatattctgtgacttgcccaagatcccctaagtatcaaggctagggtttgaaccccaaactggctgaatctagtctgtcctctttaccactaaattataccacctccccatttacctacccatccagttcccaggactggctacattccttttaatctttaggtagatgtgttgggaagctcccaggcagaattcagaatgtggtaaattaagtaccataatctggttgaaggcaagtgccagctatccacacacacccttgagaggtcagtttcctaacagtatacatagaaaacatgtcaattctttactggggcctccactggtctgacaccatgacaccagattctgaatcaccccacatcagatactgaggccagaacaagcctcccacctaacctcccctcaccagtcctgcttttgagatgtagtgtaggcaaaaaatgctcctgggatggggcaggcatgaccggaaccagagttgctttgccctctgagctacagggcctctgcgtctgggtgcaactgcaacacaccagcctttgggacaactccaagggaattttgtgcagaagagtttaccagggactcttgagaaactccaaggcagagggtgatgccaatgaaacatcaagttaactgtaaaaatcagtgctctactccaattctccaggagtctctcagagtccacagtccactcttgtcacacaggctctggctgtccctccccaaggatacagagaggggctctttttagccattaatagcagccccactgcccagagggttgggcaaggggccagggtcagaaccatcaacatcgttcagtctgcaacatgaaccaggatgctactggatgaagggagctactgactcaaccacagaaacagatagagtaggagtcgaggccacaggacactgacttccatctgctccaggaacttgcctggttaaaagtggtacaagaaagccaggtgcggtggctcacgtctgtaatcctaggactttggcaggctgaggcaggtggattgctcgagcccaggagttcgagattagcctgggcaacagggcaaaacctagtctctacaaaaaatacaaaaattagctgggtgtggtggcttgcacctatagtcccagctactctggaggctgagatgggaggattacttgagcccaggaggcagaggttgcagtgagccaagatcgcaacatggcactccagcctgggtgacagagcaagaccctgtctcaaaaaagtgaaagtgatacaagcaacactatatacataaaatcagcggatatagtccgtatcttccacgccctacccctgacagcctctggttttagtccttaaggaccagtgggactaagttctcaagtgaagccaggttggcaaggggtgggtggtggcaggcagaggttggatctgctgaacccagtacctctattcctaaaagttccctctgctcaatgccattagctcccacctggcttcctcggtgcttcatcactcttctgtggcagcaactacccatgtgcaaacacagcaggagcaatattgctaccagaaagctggctggcacagcaaatgctgccctgccagcacagcagcagtgggggcagtgaggacatggtgatgaatatcagcaagaagctggtgaaactacactgtggcagctgctggggcttgccatccaccttgccactcctgagaacagtcccaagtgtcagagtagtaggctccagccaaggacagctaggactgggaagaagtgggaagagagtaggcccaggctctggggtcaatggcatagggcaagttagctggatgacataggacaagttgcttaacctcactgagcctcagtgctttcatctgaacataaggataataatagttcctattattgtgaaaattcaacaagattatgcatacgaagcacctagtacagtacctgaatatggtgaagactctgcaattgttgactattctcattattttaagccttgggcccaggctcatgaaagggttagaaaattgttccttctgaggatgcactatttaaaaaccaggccaggaccagcctgtttcttggcacaggttcctttaacaacagaatactcctgccccacaccagtgctcaggactctcccaagaacaatatttcagcagcactgagccgagcagcagagcccaaaatagcatttgcagagcaaggcacatgtcactgcctctctggtgcttcagaagtgcagggaaagaaagttttcaatcacttgctcagaaaccacggccacccaccacctgccttccttccagggcactaagatgctgcaatctctgttctgctggaaaacgaaggtccctgagccctgcagcagcagctaccactctgacggaccatgctgtttccctcccgcaggccagagaagagcagcctgaaggagcagccctctggggacaaaggacatatgcagtttgaattcaaagtgtgttttgtggggacagggctgggcctgatacctggctgaagggcctgccactcatgcgtcgggtggaacacctccaggacttcggcatccagctcctcctcggctttggtttcttttctctctgtttctttggtgctgctcttctctgggttggtcagggcaaactccttctgagaaaagaaaacacagggcatgacccactgcaactaggcgccaggtaagcagaaaaaaaatggcctagggtggcacgttcttttcctccatgcccctctcccccacagcctgatatgtctggacactcgcaattcctttcccaaggtcagcctcagaaccagcacatgtgaggtgatatggctaaatgaatgcagcatgttgtcctgtgcgtatgtggtacttttgaaaatgcacagggaatgactctagaagatcccatgtatcttgagcaggttaagggaacacattagggacaggggctggcaaaacgaaacaataagagccttttactttttgacatgctattatactgtttgatgtttaaaactcgcacatattatttttacaataaaaataaacatatttagaaaagaaaaaaacacatacatgaatgggagagtaaggcctcaaatggccactacagatgtacaaaagctggcagctaaggcccaactgattcccaagcagcccagcagggcacaattccccagtgtgcctatgagccattgcaaaccatggaggaagcgtgcaagtgggaaggagagaatccagctgggctgagggaggaagatgctcaggttggaaaccacttcctaaaacctgttgccttccaccctgtgtagaacatagaggattaatgagatggtgtctctggagcattctcagctcaggagacagcgatgcaagataaatacaaagtattattcattttgctctttcctggactctcatccttcctatcccatttttaaacccgttcttgcaaaaaaagtaataaggcctcaggaaattcgaaccagagggttccggagctctgggaaattacatttgggaaaacaaggaggaacccacattagcacatggggaggtatttcagcctgcccacctcccctgtcatcgctttttctctgcttcccaatccctcccctagtaataaaaagtatatttcttggaatcttcctatgagcccagacccgtgctgggtactttacatagatctcattttggtctcccaacaattctaaccacaactgggagatgttatatgcatacatctgtaaagttatttaactttcaactaacacctcattctcagccaggcatggtggctcacacctataatcccagcactttgagaggccaaggcaggtggattgcttgaacccaagagttcaagaccagcctgggcaacaccacaaaaccccacctctacaaaaaatacaaaaaaattagccaggtgtggtggtgtatgtctgtagtcccagctacttgggcggctgaggcaacaggatcgttagagcccaggaggcagaggctgcagtgacctgagatggcaccaccacacttcagcctgtgtgacagagcaagaccctgtctcaaaaaaaaaaaaaagtgcctggctccagataaggactccctcctgcctgggtccctcaatgtctgatctttagttgtcgaggaaaagttaaaatgttaaggtgctggtgatgccaatgtagagcccctccaagaatttttacattttaacaagaaataaaggcatgaaatttagatggcagaatttcaggccttactaaggaccaataaggaaaatatcttggcaagaagaagctctcaaatctaaccacacctgggagatgtaatatgcatagttatgagaggcactgactccagcatagtgcttaagatgctggaataactcaaatcccagtttcttgtgtctcgggaaagttatttaacctcctaagcttcagtttccacattttcaacatgaaaataataacaacatctagctcatagttagatgaggtactacattgtaaaccactggctttgggtacatggtggctgctactattacttatgaaggcagtcatagattccaggctgtgttgtgacatccaggagtgactatacaatatggcatcattcaagcaggtcacctgcgcagcctggtgcctcaaacccctcctatcccttcaacttaaagtttgcacaaatctgagctcaaaagaaaactaggaatagaagaataggtgtgcttatgagactacagagaagactgactggcaggaggcatcctccattctgaggacatggacatcaagaacttccaacagctgagtttccagagggcaggcaccatgtcagtctccttcatcacccccatgcctagcacagggcttagtttgaagctgctgaaaaaacagatgaatgaatgccccttcccataggcaggtgtgtcttctgggtgccttagactgaggaaagcccaaagcacctgagtctgctccaggtacttgcctcacattccagaacaaagaccaccctgtctgctaagtacccagagcctacatacactaggatcagccctggtcagaagcattagactgcaggaccaggagaaagttaataaaatttaccttggaggtgtgtcaatgaaatgccccaggggccaggcagggatgcagggaaatcagtggaccaggtgtaaacaatagggagtggtgggactgcagaaactggagccctcttgccttgactaagggaagcagctgctactccgctggtctaccactgtcacgcaggcattcaacttgaaaacagaaatccagatttttatgtgaaatgttcttatttttagaacactaagaaggccaaactaaaatatctaagcatcaatttgcaaccttctttttttcttttaatttttagtagagacaaggtctccctgtgtttcccaggctggtcttgaactcctggacttaagcaatcctccctcctctgcctcccaaagtgctgggattacaggcatgagccaccacacccagcctcaatccttgtttcagtttacctattagccgggtaatttctggcaggctgtaagcaagcagcaaaattctcatcaagagaagcagaaaggggtaagggagatggtgataagaaggtagcacaggaaatcctccaaaatccaggtaggctgatgttcattttaactactaagggttcggaaagcctctttttctagatttcattaacaagattaatagagtggattcaagaaggagggttagaacgagactgatgaaccaccgagctacatgcttcaagtcctaaggaggccagactcttttgcaacaatcctgtcactgttcaaaatgttttttgcacctccttttggtatcatctttgaatcagattttaagacacaaacacaaaacctgtacatttaaaagtatattttaaagtacacctcagtttttagtggagattgacacaaaattggttctcccctatctatgcttaccctgtttacgagccctggctataaaagtctttagatgctttgcccaaaacacacctagctatcctcaaaggccaagggctcagaagccttgagagaggttcaatgatatgaacaaaccacaggctggacagtgagttcaaaagcagagttccagaaaaggttttgagaaaaagcagcatcaagaggatgaggttgtaatgataacagcagctaccatttattaagccctgatcatatgtcaggcactggggcaaggtgccttccattcctcaattcatccaagtgtcatctgtgaagcacatcatattagtcccataggaggacagatatggggcttttcaaaatcacactgctcagaaaagcagagcagagattgaagtccagacctgcctggctccaaagcccatacacaagttttgactcactgctatgattctttcttggtcagatgtcctaataagttgtgccctgagagctgagggaatgacgcgggatactgagatcaccttagcatatctaccagcacatgcccttcctcggcaaagacttccatgggccaggtaagaaaccatagtcccagtaaaagaacaagcacaactagcctcactctgcctaggcagtgtcctgaacaggagagagagagaggcaggccagcccttggtcagctgtgaagtaaaccccgtgctctggtgccttcccagctggcttctcagggctgccttccacgctggatcatcagtgctctcttctccctatcaccatcattccaaataccaatttcctctcaagtgactggcaagaaatcctagctaaggtgttagctgacaacagcttaccatgtcacacttccttgcgcttgtatccgaataagagattcttaaaaaccaaagccttcaagatccaagagaataaatgaatctctaatggtgggttgacagacactgtaacagagacagactgccagggcaacgttttgggacagaagcctgcttgacacagcccaaattaaaccatagaagcagcatccccatactaaaaaacaacagctgacattcattaaccatttattggccatattgtgccagtttcaatgccaggtgctttatatataatcatatttaatctacactaaaaccttaagagggaggtaccaaccctgttttacagattaggaaacaaagctcagaaagggtcaaattgccaaagtgggaggcaaaagggatcttacgaagggcctgtgcgccttccacaaggctccactactgtacccgcctcattgtttaccacctttttcaaggccagtaacacacaaccacagcccttcagcatctacacgcctcctgagatgtggcatcccggggaagtaccacagcaggagccaggaaggaaagctggctccagatcatactgtgatacacacagccggcctttcctgggtgggcattaacctgccccaatgcctttggggaggacaattctaggtcatcaggagcacttacctggactccaggctctgaagaaaggatcataaccacctccaccccattttcactgttgtgaaggtggctggctgcataatttagattttaaatgacatcagggcagcaatttttatggtatgagagaaaagatgcttcaactcctacttgtgcttagcacatgatgaaagattatgacaaatggatacagcttaggaacagacataaggataaaagcagcttctgttgatgaaagtcagtattaacatttttctgagactagactcaatagagctaatataaatgggccagaataattatgctctgaaagctcatctatttggttggactattatccaaaagggacttcctaactcggtccttaagtaaattcatcagcatgcctttgttaattgtgcatctgctaaagctcacgatggggagcatggcatcctcatgaggtacaagttggggaggggacacagccctgggccctgaaggttcttttctgggccattccaccgccaacccatgccagagacagccccaacctcacgctgtagccagtcccattctcaggggcccctgggatcccattcttactgtccttgaagaagaggcaaataaacagcaccaacaggatctcagagggcattaaaaactcaaaaggactcgtgactcctaactgtatgttttcccctgctccacgaagtggggggaaaggcagagaggaaacaaatgatttcagagagaaggtggaagcttgccatgagccagaggtgaaccacagctaagctggattgttattaaattcatcacaattgtcatttgcacttcaaggacctcccgctccagagcttccagcgctttatccaacatttagtgggagccctgggggttggggaaggtggccaggggagggtgaaactgtcaaataactgacagtgggagcttatcaagggagaggagagggagggcattaggagctggtcaagggcaggctgttgctgggacaagccaagtaaacagggccaggaaccgtagtgtgctgcagccaggccaagctcagggcctttctgggcattctcctcctgccagtggcaatggcagaagccctgagcagtaagctctaggttaatgaagtgtggcccagaaagaacagggagctacagacaaaaggaaggaggatacagagatggagatgaactgagaaagtacaagggagagaggagtagaggaagaaaaagagtcttacttggaactgatgcccaccacacaggcactcagcttttgggaagaatcctgacattcacagctctcacaaactggctgtgtgattttggccaagttacttaatgtctctgagtcttagtcttctcctcaaaaggagaataaaaactgtagctgcctacttcatagtgttgttgggaggattaaatgagaatacatataaagcactcactacaaggtttggtaaatggaagattataattatgaatttatcatcatcatcatattttccccaaagggaaactgtgtcataagctttaaacagaggccagaagacacagggatggggaggaagaagtctacctactccatgatccactgccagccacactcacataagaaagaaacatagaagcccacaccctactcccacaacagccctggtgacagggaggccttctcaagacctcatcaagggtccctcccatttacaataaagatatttaccaggttctgatgactgaggcagaaggtgaagcaggcggccatcagcagcccaagcagcatgcccagaggagccatcctagatgaaggcaggctctggggagccatagtcagggacctgcaggtgcaagcatagacaacagaaggtcaatgaaaagctaatgcttggttcccccgcactgtgattcccatgtcgtcacttgctcacatgtcagacatttcctgcatagaggtataacgagtcttctaccacttctagataattctgaagcctccatctaccatggtgggtccagccatccaacaagagatatgccctgggtagaaccatacagtcgatcaggactcctgcataagctattacagccctagtcccttccttcttcattagaacttgttatcaggttgtggcgggtggtcttgactataaggagagagggaaactaaccaactgatctgcatgtgaacaaacatgggcacaaatccacataagcctttataaccacccacttctaaaacacacccattatcctacctgaagacagatggcatcaatatcctctaagacagcaaagttcgatattcccaagtcacaaaacctctcacatcagctttcaaacagtcaaacaaataaaagtacaagccccagtagctattaaaaggacaggcaaaggtgggaggatcacttgaggccagaagttcacgaccagcctgaacaacacagtgagaccctgtctccacaaaaaattaaaaaaacaaaaaaattagctaggcatggtggtgtgagcctgtagtcccaactatgtggaaggctgaggcaggaagaccacttaagccccagaggatgaggctgtagtgatccatgactgcactactacagtccagcctgggtgacagaatgagaccccatccctccaaaaaaaaaaaaaaaattaaaagaatataaggatggaaggacatcccatgttcatgaattagagacttcatactgttaacaacagtactacccaaagcaacatacagattcagagcaatctctgttaaaatcccaatggagaaactcatccctaaaactcatatgacatttcgggggacccagaatagccaaaacaatcttaaaaatgaagaaagggtcgggtctggtggctcacacctatagttccagcactttgcaaggccaatgggtggagtgcctgagctcaggagttcaagaccagcctggtcaacatggcacaaccccatctctaccaaaaatacaaaaatttgctgggtgtggtggcacatgcctgtagtcccagctacctaggaggctgaggtgggaggatcgcgtaagcctgggaggcaaaggttgcggtgagctgagatcgcaccactgcactacaacctgggcaacagagtgagtacccatctaagaaagtaaaagaagaaagttagaggactcactcttcctgatttcaaaacttactacaaagctacagtaatcaaagggtgatactggcataaggatggacagacagaccaatggaataaaattgagagtccagaaataatctcatatatggccaatttttgacaatggtaccaagaccattcaatgagaaaggacagtctctttaacaaatggtactgggacaactggatatccacaagtgtaagagtgaagttggggccaggtgtggtggctcacgcctgtaatcccagccaaggcgggcagatcacaaggtcaggagatcaagatcatcctggctaacacagtgaaaccccatctctactaaaaacacaaaaaattagctgagcatggtggcgggtgcctgtagtcccagctactcaggagactgaagccggagtatggcgtgcacccaggaggcagagcttgcagtgagccgagatcacgccactgcattccagcctgggcaacagagcgagactccgtctcaaaaataataataagagtacagttggacccttaccttatatcatttataaaaactaactagaaatgaatcaaagacctacatttaagagctaaaagcataaaacttagaaggaaacatagatgtaatcttaacgaccttggatttagcactggtttcttaaatatgacaccaaaagcataggcaacaaaagaaaaatagatatattggacttcatcaaaattaaaaagcttttgggtctcaaaggatattatcaaatagtgaaaagacagaatgggagaaaatatttgtaaatcacatctctgttatgggtatattgtccagaatgtgttgagaattcctaaatctcaacaataaaaagacaagtatcccaatttaaaaatgggcaaaggcaggagttcaagaacagcctgagcaacatggctagacctcttctctaaaaaaacaaattaaaaattttttaaattagccaggtgtggtggtgtgcacctacagtcccagctacttaggaggctcgggtgagaagatctcttgagcccaggagtttgagacctcagtgagctatgataatgccactgtgctccggcctgggcaacagagtgagattctgccactaaaaaaaataaaaaaaattaaaatgggcaaaggacttgaataaacatttctccaaagaagatatacaaatggccaatagggacacgaaaaggttctcaacatcattaaccatgagggaaatgcaaatcaaaaccacaatgatacaccacttcacacccacaatgatggctgtaattttttttttaagtaaaataacaagtgttggtgaagatgtggattaactggaaccctcgtacattgctggtgtagatataaaacagtgcagccacttgggaatagcttggtggctcctcagaaagctaaatatagaattaacatatgtcccggcaattccactcctaggcatatcccccaaagaattgaaaacagggactcaaacagatatatgtacatcaatgttcattgcagcattattcacgatacccaaaaggtggaaacaatccaagtgccatcaaaagatggattttcaaaatgtggtatatacatacaatggaatattattcagccataaaaggaatgaaattctgatacatgctgcaacatggaagcttgaaaacattatcccaagtgaaataagtcagacacaaaagctcagatattgtatgattctaattatatgaaatatttagaacagacaaattcatttagatagaaagtagaaaagcagttaccgggttaaggaaaaggggaaatggagagttactccttaataggtaaagagtttctatttggaatagtgaaaatattctagtaaactaggatagacgtcaagaaaacttaatccaaattagcaaatgatctaggaaagaaaaacaaaataaaacaagcaaaacaaacaagaaaaccttatgaaaattcaggatgtgtcagtattagcccagacccttataagaggttttaatatttatccctcagccccagtatacctcattaggcagtttactcaattgaggcttaagtgagttaattacagggcagcacctctgaagaatgcggtgtttactttttctctatcccactcctgccacattcctccctgcttcaccttaacaaattggacctgtggcatgattgcagtgggacccaaagcgtgcctgaacccactctcagaagtcattacccctctgccctgcccacatcttctcaggggtcggaagaaactttccctaaggacatctgcagccatgaaggaaaacagccctgctggaccgccactgtgcaaaaaagcacagccaaatggaaaagcaaaggctcgggtactaaaaatagctgctacactcacccagcagcaaaagccttagctttctgccagctccccccctctttttttgccgacaaaatggaacggctgagtgccacgagagcttcccccagcaacctggctccctggggcaccaatcacactgaaagacagggattgagttcacagcaccacaccaggctctggataggtgactggccatccctgggtgtgagcaggagaggggccaggctgggtgaggatgaacaagggcaaggcgtcaccacaacaggagggagaaggctagggaggcctagggagatggttcctgagagggcacaaccctagagctgcctatactgctctatacttctgttaacgctgcagccttggctgtggggagaaaaagaataaagaatagaagtgggggactcacagcattatcaggacaacatacaacaaaacaaagattaacccaaagccacagatatccctccccttccatgagatactcatgtgtatacacacacacacacagacacacacatacagacacacagttatgagcttccttcttacagctagggatcaacaacgaaactggtgctggggaaaaagaagaggaggaagagctaaatgagaaggaaatagtcaagggcaaagaagacaaatgagcagaagggggaggcccagaagggactgaggaagaagaggtcaggggcagctgatgcacacacagcagcttcccccactccttggagtgggaagaggagtggagggtgagagaaatggtagctcccacagggctcccagccatctctgtctcctgcacacacgctaacactgtcagaaacattttctgccaatactaaggatgagaggtggattcacaagtggatccttcatcttccctcaataattccacatggactgcacagctgacccagttattgcctctatatatttttccacaaaacagggagagagaatgagagagagaaagagaggacaagaacatggagctgaggtgggcagtgggagagggatggggagattgagaggactgaggagagacctaggtgaggctgggagaaaggtgtgagatagtttctcaggcttcacaggggcatccagagagcaagagcaagtacaaactacagcatgcaggcacggaaaacagtgttctccgtccttttaaggcctggcctgcagccacgtcacctggtcttggtccttactcaagaagtggcaggcatagtttgccctgggctttatgctaaagctgagggagaagggaaagggggaaagggaagtggcacacagctatgctttgccaggatggcccaccatcacaagcagggacagaggcagcagcagtggcaaaagccagctgcggtccctggcataagtaaagccaaagtcatggcatcccattgaggcacagtttggcacacctggcctgatgatagtgccattcccaaaccacttgccacccataaactctgggttcacctgatcaatggcccctgcataccctgcaaaaaaaaaaaaatccttctcatcatccttggctttcaatggaggacagacctacatctttacatttatggccctcttctgacataaaataccatcactctgtccaggaaaggggaaactatttcagtgtctcaccggtaactctttccttaagtatccttgggctttgggacagaagagacaataaggtacttgagatgcccatttttctatcaaaagtgtccatttgtaggctgtacctctgcttaaatagaggttggatgcactcaccaatctgtattgccagcttactgcagcccagagcagatgtttggggagcaggtgggaggaggccactcggcccccacctctctcagtgcctcatgtcttccacacaattcagacaagactgggggtggggattgggccctgtgtaaacaagacgtctcttcttaatgtcttttctccagaatggaaaacaaaagaatgggatgaggatggcaagaagccaataaagggagagggagcagtattgctgggtctctggcagcttctgacacacctggcaggacccatgggcagtagctgagtttcaggaccagagcacagaaagaactggaaaaggttctaagtgtcctggacaagcaaagccaactcagtagcctgccatggagcccttggaattccatcttataaaatgctcatgttattaacctacactgtatgttcatgtatttgttttcctgaatctcctgggaaaagtgaaagggcaagaattcctacttccattttataaggaagaaactgaagcaaagagacaaaagaaacaaaaacactgggtagtataacacatggacttgaagtcagacagacctaaggccaattcttggctctgccacttcctagctatgtgatcttggacacaacttcactaggcctcagtttcttcacctataaaataggtacattaagaatttctacttcaaaggttggtagcgaggattaaataaagcaatgaataggaagtactgggtacagcacctagcatctaatcatcactccatttttttattagttgttttgtttgttttctgagacagggcctcactctgtcacccaggctggagtgcaatgacacaatctcagctcactgcaacctctgcttcccaagctcaagcaatcctcccatctcagcctcctgagtagctgggactactaccgagtagcagatatggtgtgccaccatacctggctttttaaaatttattatttttgtagagatggggtttcaccatgttgcccaggctggtctcgaactcctgggctcaactgatccacccatgtcagcctcccaaagtgttgggattacagtcctgagcctcggtgcccggcccactccatcattggaatggaaatgatgactgctgccctggacccgcagcccatcagagccaggccaggcaactactctccaaagctcctgctccctgttagatccacacactgtccagctgacccatgcctcaaatgaggaccaaagccttttgttgggtagctactcccaggaggtaaaggaaataaatgttaaaggatgaccctcctggctgaaaatggagaaacccgaggcagttttctgctgagccccaaggcagacccagcccactcagtgcttttcctagcatattggcatccagagagccaagccaccaacatgcagaactgccagctgcaggaacagctgtaagacaatcacctgctttacaaactgaaggttagaggatgagctcttccacagacacacattcattactatttatgggctgcacaaactcatatgcacacatacagtcactcacctctacacaaacagaagtgcactacctaatttaagcagacaaatatgaagctggagaaacaacgcaaagaggacactgaaaggacgcccctgacaagggagaacaacgtgcaaaggcttaagaaaagaaatggaattttaaagaataatttgaaggacaagaaaaacaagtttgtaatagtcaggcaaacaagcttttcccgcctgagacaatactaaacagaaagtcaagaggcagacagcaattaaatggaaagtctttgaacagcaaaacaaatgtggcttctaactagtccagcccccagctggcaaggtggctggactggaacatccctgagccagtggccatttgtacaatggggataatatctcccctatgttttgaagtcatgcctagggccaagcaaagagggactgctctcaacaaacccaaggcacccaagaaaaaaggttattagaggaggctgttggagggtagagggttcacaatggatccaagcctctgcctaaccagagagctacaaagagctacagagagctacaaaatccaccgtgcagcctgcaagggagaacagtggcagtacagatgttagccctgccagagggcacagggagccaagaagggctccacaggcccagctgggaataggcacctggaaggaagacaacatgggatgggatgaaatgggaagggcagtgaggagcattcctagccctttctctgtactcccagaggtggaacacgacctactccattcccactccagtagagaagaatacagatcttcaagaagggagctaaacaaactagcaaaaaaaaaaaaaaaaaactgcaatcacagcgacaaaagttagtgcatccaatgaaaagaaatcacatgacacaatcgggcatggtggctcacacctgtaatcccagtactttgggaggccaaggcaggcagatcacttgaggtcaggagctcgagaccagcctggccaacatggcaaaaccccatctctactaaaaatacaaaaaaattagccgggtgtcatggtgcacgcctgtaatcccagctactcgggaggctgagacaggagaatctcttgaacctaggaagcagaggttgcagtgagccgagatcatgcctctgcactctagcctgggtgacagagtgaggctctgtctcaaaattagaaaaaaaagaaatcacatgacaagcagagtgactgaataaaaagcctagcctggccctctccagatctctcctacttggccacagcttgcaaagaatctgaatgctagaagtgagcttaaggctcaatctttatttggactgctaaagacccagaagacatggcaggcactcaatacctacatagagaacaattggaattcaatgccattaggcgtggaacttatcaatggatccaggaaggctgtggcaacctcatacctgttgaagacgaagaggtagacagggctaaggcagggcaagagtttcagtgctatcaacacagaggtgatcatcaaagcaacaggagcagagcgactatctttctagggagaaaccttagagagaaaaggacagcggaccaagcatagtcttcaactcatggctgcacgttaggaaaagggagcaagcaaggaaaccagaggagcagccacatgattagtgcagacctacacaggtcaaaagagtggagaatcctgagaaaatccagttgtaggcaacaatgtcaggagatcagtcactggatttggcaatgaggcagtcagagggcccttcaaaagagtgtccacagatgaagacatagaggcacaagggtaggccactccaaaaggctcaatgggtccactaaattttgaagatttgaggccacatttctaaatgtgatttttcaacatttcactaaagtcttaatgagaaaagagaaaaaaaaattcctccatgggtgcaacagagggattcttcaataccatacataagttcctatgattgatgaagagctaccccacaacacacatgacctcaggacaatgatgggcatcagtcactccagcagaaggagggggcagggaggtaaaatttctaagaagaaactcccatcagacacaattctaccttctctgggctctcagccatgcctcagactgcccggaggctttagtccttccactttgtggaaatgtaataataactccgccatggcggagacagagaaataccctagtgccaccccttcccccagcattcaaatatactatctgggcatcccagaggaaaattaattctgtcaaataataattatagtcaacatttatagagaactttccatgttgcaagcaaagtattagttcatttactcttcacgacaaccctctgaggtggttccaatatgctgctcattttacccatgaggggaccaaaattcagagaggttaagtaacgtgccagagttcatgcagccacagagcagtagagtcagaattcaaagccagtttggccccaaagccatgctctttccatagccgtgctgtctctcgaggggtctgtgaaatcagccacagaaactggactcatcattttatttgttctgcaacagtataaataaaaaggcacattttgtgtcaggacagaaattttttttttaattttattattattatactttaagttttagggtacatgtgcacaatgtgcaggtttgttacatatgtatgcatgtgcaatgttggtgtgctgcacccattaactcgtcatttagcattaggtatatctcctaatgctatccctcccccctcccccaaccccacaacagtccccggtgtgtgatgttccccttcctgtgtccatgtgttctcattgttcaattcccacctctgaatgggtgctgggaaaactggctagccatatgtagaaaggacagaaatttttaaatgagcctactggggccctcttgtggaaagacccacctctaccatgttctagtttctgcaccacacacaaacacacaccacacacacgcgcacacacacacataccacacacaggcaccttgattactaaatgcccttggcacagaccagccaaggcataggcacaggcattcaggaagaagaaatcccttgactcagattgcagccaggcttcctttgtgacttgatcccttaaactcctatcactcaagcttcctagctatacacgaagcaaaagcatccctgctccccttcatggagcccagtgccaggcacacacacacatatacacacacacacacacacaaaccacaaccacacacaccacgtatatacacacacccaactgtctggcaagaacttgacacctcgcccctccatgcagaaaatacacaagacagaagtatttctacatggcagacaaagacggagtcttctttggtgaatggggcttgcctaagcataccagcagttgaccagatgaatcagaggaatactcaggtcctagtctgtactttccagtaggtcctagactgtaagctcctagcaagatacagacaaggggacctactccttatacctgatccttgaccctgcctgaggtaccgggagtgatcagcccatgtctgataacaaccaaggttacaagaagctccattcccttccaacccactacagtgtaataggaagaatgcaggctctggattttgagccaagtctcccctactagctgtgtgactttgggccagatgcttaacctctacaagtttcaaccccttcatctataagaggacttgatagtaactatttagtatgactgtctatattaaatgagatgacatagagcatatagcacagtgcctgacacaaaatgagggctcataaagcttatagctctcactactattattagagaaaattctgagcaaagaataggataagcaaaagcagcgagggcttcacccccatacagaactgtcttctgttctgacaaccaagcccctctttggagactagcttccctgagccacaagtcagcccacacacctggactatactctgggtggttacagacacatttccattgaaacctttaagcgatgctggctggctctgcatcagtgccagctgactgacatcaaacacttcagagtcccgcttcctgatgactcaggcctgtctccaaattcctgctgccactctcctacctctaagggggagtcagggagagtaggaacagccggggcaaatgcagctgacctagactgctgggaccactgtagacagatgcagctagcatccagggactaagggtcccagggcttttcttccctccccttttaaaatagtaactggatctcctgacagtatgtgcgatgggctttctctatagcctgctcccaaagaacaccagggactttcacaccacagtcatccagataccacggtcagggttcgaggggaggagagatcagaattcatctttcctttcccctgatgtctctaagcttccagaaaacatcagggcctcttaaaggggctaaaatagggaagaaggtatgatttccagtccatagttctaaaggaactatctgctaactggtaagtacaatttgtttgccatttctattgcaagcattcagcactcacactctaaaagcaaataccacacaaagataatttcagcattaatgtcagttccttgagcacactgggcaccatactatggaacagaatatacaaaagatattgtcacttgcctcaggtggatgatgtcctgttcacattcagtggataatgtggccttccacatcttagtctcagacagcataattattaaaaagaaaaggacaggcgcagtggctcacacctgtaatcctagcattttgggaggctgaggcaggtggatcacatgaggtcaggagttcaagaccagcctggccaacatggtgaaacctcatctctactaaaaaatacaaaaactagttggggccgggcatggtggcttacacctgtaatcccaaaactttgggaggctgaggcaggtggatcacccgaggtcaggagttcaagaccagcctggccaacatggtgaaacctcatctctactaaaaaatacaaaaattagttgaggctgggtgcagtggctcatgcctgtaatcccagaactttgggaggccgaggcaggtggatcacttgaggcagaagttcaagactagcctggccaacacggtgaaaccccgtctctactaaaaatacaaaaattagccaggtgtggtgatgggtgcctgtaatcccagctactcgggagcctgaggcaagagaattgcttgagcctgggaggcggaggttgcagtgagccgagatcgagccactgccctccagcctgggcgacagagcaagactctgtctcaaaaaaaaaaaaaagacactaattacaactttgtaataatgagctaggcaataattagggtactccttaaactaattggggagccccaagaaaatagcatttacttacagaaacacttagcaacaatacgaggatgggtcaccaagcacaggacttgctactaccatgttggtatcaactatgtcttccaggtaagtcagcaactgcaacattttatttttaacatgcctgagagcccaagactatttataataccagatccttaaaaacttgaaagggagatgaattttaaaatgtacacatttacatatgtgggcagaaacacaaaaatcagatgcctctcaacacagctcagggagccataactcacggctttcacaatcccaccgaatgcccagagaaaatccgggcaccttctacaagggatggtaggaagctgggtaggtagccaagaaacaaagaaacctaaactcagtacttggcaggacaattaaggagcagaggattttaaatgcattgtttctgactctaaatatggctacatttattaccaatttgggatcagaaaccacatttagttctgtcatgaccacatgctaaaaatattaagcagagtattgcctaggaaacagcagttctccctgctgcggcagctccacttcagagccatctctgccatggtcacagggtttccatcctgtgctttgctgagagcacagttacaagcagaactgacactgtcctgccaagacgtccccccgcattttagaaggcagcaataggaaccagagctagggactgcacaaactcctcatcctctccagggctgttttaggtgtcagtgaagctctatttcataggcctataactagaatccatctgactgggagctccacagcgggagggacaattgtctgtgtaacataccactgtctcctcattgcccagcacttttcctggcactcaaaaaatagccattgatttaataaaatcaataatctaaaaagaaccatttggaagagtacaatggaaaataacactgccattaaaataggtaaaaatatggactgtggtaatacataaaaacaggtgctggccaggcacaatggttcacacctgtaatcccagcactttgggaggcctaggtaggaggatgacttgaagctaggagttcaagatcagcctgggcagcaaagtaagactctgtctctacaaaaaaaaaaaaaaaatttttttttcattagcagggcatggtgatgcaactatggtctcaactactcaggaggctgaggtgggaggatggcttgagcccaggagttcagggctgcagtgagctatgatcacaccactgcactccaggttgggcaatagcgagacccctatctttaaaagcagatgcataaaaaattgttgagtggaagtgaaagcagcagaacctaatggcatacatatgtaaattactactttggaaagaagtgtgtgtggccacctctatgatcacatgtgaacttagaattatggaaaactgtgctcaatggaatctttcaccctgaaatgttaaatatctgagaaaacactttaaaatacattattttcagcacagaacctactcccttatcagctgacttgttctgatctcctgaatggctcagaggccttgttcttgttcagcaaacccaagatcagaccatacactcatcagccaaaggaaacagagaacacatggaaaaagccgcagtcttaaagtccaacttagcaacttgaccctgtaagggcagtttccaggctgcataatcagaatggctggctgcccagacaggcggccaagatggaagtgtcaaaacaaaaaagtatggaaaagttcacctggcccaacttcaaagccaaagctccaaaaaggtaggagtttaacaggcacttactggccagcaaggtgcctgttaagaagggtagcagtacactaatccttctcaaactcttcacaaaaaccaaagagaagggaaacacttcctaattcattctatgaagtcagcattaccctgaaaccaaagcaagacaaagacactataagaagactccagaccaatatctcttataatatacatgcaaaaaatcctgaacaaaatactagcaagccaaaattcagcagcatattaagagaattatacaacatgatcaagtggtgttttatcccaggaatacaagagtggctcaacatatgaaatgcaatcaatgtaatacaccacattaatagaatgaaggaaaaaaaccacatgatcatttcaatggatactgaaaaagcaactgacaaaatccaatatcctttcataataaaaaatacccaataaacccggaatagaaaagaacatcctcaacataataaaaggcatatatgaaaaacccacagctagcatcatatttaatggtgaaagactgaaagcttttccccaaagaccaagaacacgacaaagatacccactttcaccacctcttttacttatttatttatttttttttgagatagagtctcgctctgttgcccaggctggagtgcagtggcgcgatctcggttcactgcaagctctgccttccgggttcacgccattctcctgcatcagcctcctgagtagctgggactacaggtgcccgccaccacgcctggctaattttttttgtatttttagtagacagggtttcactgtgttagccaggatggtctcaatctcctgacctcgtgatccgcccaccttggccttccaaagtgctgggattacaagcgtgagccaccgcgcccggccacccactttcaccacttctattcaacataatactataagttctagccagagcaattaggcaagaaaagaataaaaggcatccatattggaaaggaagatgtaaaactattctatgtgcagatgatatatacatatatatgtgtatatacacatataaatgtatatacatatatgtatatatacatatataaacacatatatacacacatatgtatatacacatgtgtatatacatatatacacacacacacacacacacacacacacacacacacacatatatatatatatatatatatggttttttgttttgttttgttaagatggagtttcgctcttgttgcccaggttagagtagcggggcgtaatctaggctcactgcaacctctgcctcctgggttcaagcgattctcatgcctcagcctcccaagtagctgggattacaggcatgtaccaccacacatggctaagtttttgtatttttagtagagatggggtttcaccttgttggccaggctggtctcgaactcctgacctcaggcaatccgcccaccttagcctcccaaagctctgggattacgggcataagccaccacgcccagccaatgatatgatcttatgcatagaaaaccttcacaaataaaacctgttagagctaataaattcagtaaagttgcaggacataaaaccaacacacaaaaatcagttgtatttctatatcccagagatgaacgatccaaaaaggaaactaagaaagcaattccatttaaaacagtatcaaaaagaacacttaggaataaattttgccaatgaagcaaaagactttacactgaaaactacaaaacgctgctgaagaaataaaagaagatctccatttcaatttttctgtacaacacataaataaataaaaagtcattttaggttcatgattcaaagatatgatattgctaaaatgatagtattacccaaagcaatacgcagatgcaacgcaatccctttcaaaattccagtggattttttgcagaaatggaaaaacccatcctaaaattcacatggagtttcaagggaccctgaatatccaaaacaatcttgaagcaggagaacaaaactgctgggcacagtgattcatgcctgtaatcccagctacttgggaggctgaggcaggaggattgcttgaggctaggaactcaaggctgcagtgggctatgacagtgccattgcactttagtctgagtgacagagcaagatcccatctcttaaaaaaacaaaaacaaaaaacagcaaagttgaggggaaaaaaagaacaaagctggagaattccacaagtccaatttcaaaacttaccataaggctagagtaatcaaaagtgtggtaatgatgtaaggataaacatatagaccaatggaatagaattgtgagaccagaattaaaccctcacatctctatagtcaactgatttttacaaaagtgttattgagtaaaaagggatttttaaaggacgaaatttaaaaggctaaaactggcagggtgcggtggctcacacctgtaatcccagcactttgggaggctgaggcaggcagatcacctgatgtcaggagttcgaaaccagcctggccaacatggcaaaaccccgtctctactaaaaatacaaaaattagccgggcgtggtggcgggcacctttagtcccagctactcgggaggctgaagcacaagaatcacttgaacccgggaggtggaggttgcagtgagctgagactgagccactgcactccagcatgggcaacaaagcaagcctcccatctaaaaaaaaaaagttaaaactatacagttcttagaagaaaacatgggcaaaaccttcatgaccttggattcggcaatgatttcttaaatattacactaaaatcacaggtggtaaaagaaaaataaattgaacttcattaaaatatttttaaaatttttgtgcaaaggacgcgatcaagagaatgaaaagacaagggaatgaaacaaaatatttgcaaatcacacatctgataagggtttaatatccagaatacagaaacaactcctacaacagaaagacaaacaacctaattttaaaatgggcaataatcttgaatagacatctctccattgtacaaatggcctggaggcacatgaaaagatgctcagtatcattagtcatcattagagaaatgccaatcaaagccacttcacacctactaggtatggttataattattgaagaaaaggaaaataacaagtgttggtgaagatgtgaagaaactggaaccctcatacatcactggtgggagtataaaatgttgcagctgctatggaaaagtttggtggttcttcaaaaagctaaacataaaattaccatatgacccagcaattctttgcttaagtagatacccaaaagatgtgaaaacagtgactcaaacagatgcttgcatgtgaatgttcacagcagcattattcactatatccaaaagatgaaaatgactcaaacagccatcacagataagtggatttttataaaatgtgggtgtgggtgtgggggcgtgtgtgtgtgtgtgtgtgtgtgtgtgtgtgtgtgtgtgtgtgtgtgtgtgtatttccaatggaatattattcagcctcaaaaaggaatgaagttctgatacatgctacaatatgaatgaaaccttaaaacactattctaagtgaaataagccagacacataaaggacaaatattgctgggtgtggtggcccactaaagtgggaggatagcttgagcccaggggtttgaggccagcctgggcaacacagagagacctctatctcttaaaaaataaataaaaaaaaaaataaagaggcatcataatgacaaattttatgctttgtgtgtgtgtatatataagtatgtgagtgtgtgtgtgtatgtatatgtatatgagattgtgttgtgtgttttggtagagatggggtctcactatattgcccagggcagtctcaaacttctggggtcaagtgattgccccaccttggcctcccaaagtgctgcgattacagccatgagctgctgtgcccagccttctgctgtatatattttatcatactaaaaaattaaaaaacaatgtaagattgcccatgagttagaaattgttaaaaccggacattgggtacatgaatacattatattgctctcttctaaaaatttaagaaggccaggaatggtggctcacacctataatcccaacactttaggaggccaaggtgagacaatcacttgagcccaggagttcaagatcagcctgggcaacaaagtgagaccctgtctctacaaaaaatttaaaaactcagccaggcatggaagcacatgcctgtggtcccaggtattcaggaggctgaggtgggagaatcatttgagccctggaggtggaggctgcagttagtcatgatggcaccactgtactctagcctgggtgacagggtgagactctgtttcaaaaaatgtttaataaaataaaaataataaaaataaacttaagaaagaaaaaaatatcttttctgtagttttttggtagatattctttgtcaaggtaaagaaatccccttctttgcctaaactgctaagaggttttatcatgaatgtgtgttaaattttatcaagtgtgttttctacctctaagatgatcatatagttttacctttaacctattaatgtggctaattttatgtatagattttctaatatgaaaccacccgtgaattcttgggtaagctcaatttggtcagataatcacttttattttctgttggattttatttgccatattttgttgattctccatgtactcccataattctctgtgcaactatcataagatccacaaaactgtactgtaaatatgaattgcctgagtacatgggactccttcctcatccactgtttaatctctagttagatctaacacacagcaagcactcagtaaaggtatagctgatgaacaaataggtgaataaatgggtgagtggacagacgaacagataagcaaataaacaccttaatccagaagagtgtcacttgccctggcaggagtatagagcagctcttttcaggcaaggggtttcccttgccttttcagctcttttcagctcttttcccaaggggtttccaaccactccaaagaggtatctaatctgtctgtggacaactcagtttgtctgcagatctgtaagctgaaccctaccctgagacactcatctcaccacttaccctcatcagcaacactctacagatcagtgcctgccttcaccaacaggatacagccctggtatcacagcacaccacacagcttagatcctatgctggggttgaggggaaatgtggcttcaaactcagtgttcctctcaatttcagagtttattcccaacaatcaaaatggcctcatcccaaccctgattggcatagcaagagcccatcccattaacaattcactgcctcagcactccagaggaggagagcaatcagcaagagaaacagctgaattatttcagcagctgtaaattatgtgttctctcttcccctcctccaagtccatgttcaactgtgccccacacctccacactgaacttgggtctgtcaagtatctatgtcaactgcagtaaccaaacttaagttcaagaagcaatattaaaaagcactaattagctgatatttaaataactgtgtttaatgtcaacaaaatcacactttaaatatcccctagtctattagttgcttaattaaattccttaagatccttggacactggcacagagcacgctgccctggggagccgttcccaggccctggctttggcaggatgtggaaggggaggagcccatatccctggggaagtgccaggagagccctggttttcttctagagtctcctaatgaggtggcttctcttcacagctctgctggtctccacagggcagcaagaacatgacaaataaatacattctgagcatggagaagtgccaaaccagactacaatttattttttaaagtgcattaaaaaaaaaaaaagcacacataaacccaagagagttacttttcccatctggtatctgttctctttaagagtggtatatcacaaaacattcaggcatgtgtacagggggtacacaataggatttgtgacagcaggtagggtcagggggccctgcaagatgccaccaaccaaatcccagcctgccaagagtcatcagcctgcaactgacaggggtacagctcagccaacagcagtgtcctaggctggaacttgcaaagggactctgggttccagtgggtgagcttgtgatagggataccagtgggaccccaggaagtctctcctgccacagtaggctccatggggatggcttgccagccagccttctcaccaaaccagatttgctgtaaggggatgacatgccagctacctgcccaggtaaacatatcctggaaacagtctgtctcactaactgcctccaggcagagcacattcagccaaggatcagtaagcattaggagtctacattttgggcagcagacgctctgaacccaatcccaccgggtcatgaataagaaaacatcattttaagagcaacaagggtgtgagagaggccaagtggccgtcctttgcctcactcttacaacaagggccccagttctttctagtttccttacagaactaccaactcacctctcagtaagtcttacttttttgtctctatcactcagccccttcctacaccttctattttgcctaaagggcttgccctcctgcaaagtaggaggcaattctttccaattattccatcctgagtctcactgctcagggatccctcttatggcagctctccttaaaacagccactgcagcccctggtaatgccagcggaaaacactgggtagaagaagcttggttaatatcacagactctcaccctgaaatgcaaccactcccgttaacaactaggcacaaaccctggcttcggagaagccaggtgcttgggttgtagctcacaaaaatgtgaagagcacccaggaaaaaaaaaaagaaactgtgctgcccaggcacattgttcacttactacctgtggttacacacccacgccaaagccatttcaaccccaggtgagcagttaacagtcacgccaatctggaaaaatatatttttgcaaaaacatttttcattctcccatacaggacagctaccaaaagagcaaatatttgtgctctacgaaaagatgaataaacccatactgcctactagggaccatacaacaagttgccaccccaaacacatccaaacagaagattattcatccttccacacatatttgtttgagacctgctgcaatccagacatgtgccaggtgctgcagatacaaataggggtcctgtcctccaggagcttccacacaggcaatggagatagattggcaatacacactcttaaggagaacagataccagatgggaaaatcggcaattacagcaaacactgagttgaaaagagccctgacagagatgactctgaggcagaagacaacagacgtctcattcaggagatggggtcagggaggacttcctagaagaggtgagctttgatgattaaaagaggaaaaggaattacagaaacaaagacaataagaaaggcatcctaggcaggacaagagtggttttttaaaggcctggaggcatgaaactaggaacatgcattaatttcaacaatatatgctggagcaaagggcttatggagagtagcatgatgatatacaagacctccttgccagacaggttagatagagttcaaacacatagctcactgcactgtcttagcaaatctctcctttttagaacttccccatggtgaatgagagataagagaagggagaaggaagcctgctataagcctgcaacttgcataacacagtcaccacagtttgtgacctctgattatgaattcattcctggcagctcagtggtttgttagctcttgcaaactctcaacttctacttcacttaatagaaggagccagtaaacagaatttgatttggactgtattatctacccatagtggcctaaaccccagcggataacttcaacagaaaagcagcctgagattttaggtagtcttcctgccatctcttctgggtgatatgcctgctgtactctcctcttgtatgttccacacttaagaagtccaaagctcagctcctgctcttccctccacacgtctcatcctcctccaggactgcctagttctactgcacacgctggaaacccaagagctctcaatccctcctctcccttccctgtcttctatcccctactcagccatcatcaactattgtcaattttatctactaaatatgtccctccccctatgctcctgttctcatgcccaaattattatagccactccccacttctcaggtaggagcaaccgtcgcaagctgtcaatcaagccagacccaagcagagcagcaaaatgaggaagccaaaggcacatggctttgacgaatctctcatttgctcaactcagggtttctggaatacccaatatccagtctcctgaacccctcctaaaggctctcaataaaagccactttcttcttcggttgaagagaggcactcagggagcctattcaatagcagtaacaagctagaacgtgggctgcggggaaggtctggtgctggcgtgagtcctccggaaatgtcaacactttgggagcctagcccaaagccaagccttcaattatgggaattatatcccaggcaaggcaagcttggctccccacagccccaccactcacagtgcacggagacatacctacacagcccctgagttgaagaggcttcatccctactccctctgccaccctcccttggcataaggaaaaccatttggtgaaagcaggtagaaggcagcaattttcaggaggaggatgctggtattgataataccttgaacattttccaaaataaaggacaaaataggtattgaagaagaaggagagatctgactatgcctcccagcctcaactcaatggaaaccttccctttaccccattcccaaccattggcccccacaccagcctagaaagaaaaaatatatgttgaatgaatgaagaaatgaacaaatagactgaggacagaggaagggggcaacaggagaaaaagaagaccctgctcaaaactctccttttcattcattcagatatctccaagcacctaccgtgtactagtgcaaggtgctgggaacacacaggcatgcatcaactgtgaaagagaagaacgactggggagaaaaacacactatctgtctggaatgctgtctttccaaatgctactttaacaacacctcctgtttttctgacattaaagccatgccaaacagcatacatgcaaacaaaaacttcacattttattgtatccagtactgtggggccttgtggtttcttttctaaggaaaaactcatcattcatctccttgattaaaaatttatctaatttggctttcattaggtaggtacaaggggaaaacacagattcacagggagaacttgcccagcaacaggactgtgatgagctcccgcaactgcacagttgggtcccaacccaccaccaaggaaagaaaattaaaaagctcacaatgtggagtataagctctagccaaaaggaattatcttcccacaagcatttctgtcggatatttggttaatggaaaaaaaaactttcaaaagagaaggaaaggaaaccccaaggatatttaacatgtaacttagaatttctatatttttcaaattcccttgcagggagaaaaggcaaagaagtctttatttctcaatcctactttccaaaacttttccaattgatacaacattgtcataaaaaatttcaatttgtagagagcatggagcagaagaaggtgcagtggctgaggaattttaagctgctgcaaagaggctctgaggtgagagcaggcagagctgcagcagaggtgggagcagcagccctgaacaccgcaggctcggcaatggtgccttgggccgtgcgtctaagatcaaacaccagggactcaggcctgcggcaggccacgctctccacacaattcttcaggttcctatgctcagacagtgatttggagtaaatggtcaggctttaatgcaacgtcaaagtatcctggggtaaaagatcagcaaattacaagtatacatcttgattaaatgtttatttagaatgtagagggattggccaggcacagtggctcacacctgtaatcccagcactttaggaggccgaggcaggtggactgcctgaggtcaggagttcgagaccagcctggccaacatggtgaaaccccacctctactaaaaatacaaaaattagccgggcatggtggagggtgcctgtaatcccagctactcggcaggctgaggcaggagaatcccttgaacccaggaggcagaggttgcagtgagccgagatcatgccactacactccagcctgggtgatagagtgagacaacatcttgggaaaaaaaaaaagaaaagaaaaaaaaaaagaatgtagagggattactctatagccagaccatgaatctgaccctatccttccctgcttgaaaccattcaatggttttccaggaccctcagaataaaggccaaattccatactcgcaacctgccaccatccagccctgatcaacatcagcagcttcatctctttcctctccctgcctattgagatggagttttgctcttgttgcccaggctagagtgagtgcaatggcgcgatctcagctcaccgcaacctctgcatcccaggttcaagggattctcctgcctcggcttcccaagtagctgggattacaggcatatgccaccacgcccggctaattttgtatttttagtagagacggggtttctccatgttggtcaggctggtcttgaactcctgaccttaggtgatccgccccccttggcctcccaaagtgctgggattacaggcgtgagccaccgcacctggcctagagttggtcttatacaacatttcttacaatgctgaagacatctcgtctcccacctccaggcttttgcacatgtcattccctctgcttggaatgccatttcccctcctctttatctgacaaattcctactcatcctaaaggctacagcttaaaagacacttccgctttgaggccttccccaaccctccccactacagcaaattcagtgctgccagagcacctgtacttctctgatcatagcattattatactttcttatatagttgtccttctccccttccagaccttaaccattgcaaggacagagaccatgttcattctgcctaactagctcaagacttgagacaaaagagatgtttaataaattactgagatgatttagagtctctgttagactcacttctcagttctatcctggttcaccccctaagccagttacacgcttgccaccacaacacccacttgcctccacagacccctcacatttctgtccttagtggatggctcactgaggccttgaccttaagcacgttcatcagctatctgttgcagcatttgctatctgatggacacagtgttaagtaactgagatacaaaggtgactatgctccccctcctgccttctaagagaaaaaaaggggcatataaacaaataatcaccacatagtatgataagtgtcataacggtgaggtatcggaatgtaggtgttgttaaaccatttttcccagtgctcctctttccacagtaccccaagctaactacacactgtccttcctcattcttacagacagaaatccttccagtgctctttccccgagtgtccagcccagacccaacttcttcaagctgggctcccattctgttccaggttaattgaaattctttctggcttctgctttctcgccttcttcagttcttttctcaggcatctcacatacatccctgcctcttttcttatcctgagccaacttgtccaaactagtatttctccatctcctctctcaactgtcttggatgataacttggcatttataagacatctgcatttacacaaaatgtaaataacagtctctgtctataatgaagaagggactgagccaaaatatcaggtaaaaaaaaaggcaaaataaaccttcatcaacaaagttttctccctctactgcttcctcttacagatccaagtgctagggcatcatggccctcagaagatgttcccaattctgttacatttccagggacattacagtgccctttactcactaatgcccaggcagtgaccctctggcctgccctttcagtctctctgaatgctaaggccactctatccagccatgtgctcatttaatcaacatgtgctgagcacccctgtgagccaagagccatgtcttccacaatgctgtgcacgctctgtacataacacatgcttgattaatgtctgtgattgaatcactgataagaaggaaaccaggtgagcctctcctgccccttgcccaggaataccccggtgtaaaaaatattttgcaatatagctgaggtcagaacccccaccccgaaagcctcttattcatctaagcctagaccagggagacctttactccagctaaggagatgctgacacagccctcacatcaccaagccaagtgagccagagaaactagtgttgtaaaacacctttttaatcaagtgacttgtctcctgttagtgtagatttaggggaaatttttctcaaggaaccagaaataaatggagaggaagaaaagaacagaaactaatgaacatagtaattatcccccaaagttgcaaatcagaacaattcttcacctgaagacaagtatgaaaaacaagattgaaatgcttcagggatgtgtttgtgaaacagcaggtaaaagaacagataaaatgtatttacagtacctcactggggatacgtaccttttggctgatagctaacagatactaaataccgctgtaaaaataatattattctatccttcattatggagttatagttatccacaggaaagcaggaacataaactattttgaatgctaattaggaataatttcagagttcaagtttattctgagatttctgggcacaagtgggtatgagctgggttaggcccactgtattagcctgctcaggctgctctaacaaaataccacagactgatggcttcaacaacggaaaattttctcacaattctgaaggccagaagtccaagatcaaggttccagctgaagactctcatcttagcttgcagatggctgccctcttgccatgtcttcacatggcctttcctcagtatacacacacacgtacacagagtgagagagagagagagagagagagagagagaacgagctctcgagctctctttaatctcttcttatggagacactaatcctgtgggatcacggcccaaacctgatgacttcatttagcctcacgtacttctttacaccaaatacagccacacttgggattaggacttcaacatatgaattttgggagacacaagcattcagtcattaataccccctaaagggagagacctgttcccccaaagaccagcccaagcactgataaaagaaaacagaagactgggtaagagggtggccttggggatatctgcagaccatagcaggtgacagccaaggaccccagggcacaggaggccaaggcaggcatgagggggaactgtcccaggtcaaataaactctttttttttttaagacagtcttgctctgttgcccaggctggagtgcagtggcgtgatctgggctcactgcaacctctgcctcccaggttcaagcgattttcccacctcagcctcccaaatagctgggattacaggaacacaccaccatgcccggctaacttttgtattttcagtagagacggggtttctccatgttggccaggctggtcttgaactactgccaggtcaaactcttaaggaactatcctctccctttcacagaagatgactaaataatagtaatataaaatatatgtttacgtaataataatgctttctggataccaggcatcaactacatacctggcccatttccaagtgcttagcaggcaagatttcatttaaatctcatggcaatttagtacagaatatttgataatcatttttattttacagataagaaaataagttcacactgatgaaagtcacttgcccaaggtaacccagtatggtaggcagaaaaataacatcccaaagatatcaggtcctaatccctagaacctataaatgttaccttattaaaaaaaaaagaagccaggtgtgatcactcacacctgtaatcccagctacttggaaggctggggcagaaggatcccttgagcccaggagttgagtctggctgagggagggaataagaaaaaaaaaggatctttgcagatgtttttacattaaggaacttaaaatgattatcctggattatcagcataggccctaaatcacaagaagctgagggagatttgacagagacacagaaaagaaggtgattgagatttgtagacattggccttgaagacaggagtaatgtgtccacaagccaaggaatgctgttagccaccagaagctagaagcagcaaggaagaacagattttgccctacaaggtatagagggagcacagccctgccaataccttaacttcagcccagtgacactgatttcagacttctggcctccaaaaccatgaaaggataaatctcttgttttaagccaccaagtttgtgttcatctgttacagcagccacgtgaaactaacacacccagctagccagactctaacctgggtcctatgactccaggccagcactcttgagccctgtgccttgctccttttctatacacagcctccccaagccagacttgtccactatctgatgggtgaccctgccaagaattgaagcaatcagcactgacagctcctctgctgcaaagccttctcatgagcctctcctttctcccaccaacatcactgcaaaagcttatcagagactgaattatcttcttgatgttctaattatcaggtgtggagagaaatagtccagaatctatcatccacaagaggaagtaaatcaaactgtctaacaaaggttttcatctaattttttgtttgtacttgtttttccaatcactgagaagctcctaacctttgttggtctgctccatcctgcccacaatttctcctttcccacagagacatgtttggaaggtatcagaccacgagtaattcagtttcctctctgccccctgagaaggactgctattcaccactttgacttcccaggaacaccaagagaaggagtgagccacctgagtccttctctggaagttttcaggatgagtgttggtgtgagcaggctggcccagaggtacctcaagttaaccaattctggaattaacaagcaagctaataaacacattgtcaggacaaaggtaaagcaacccaaaatgcactttttgaacctattctgacaagtgtgcttcagctttatctgtttatgacacttcaaaatgcaggtggagaaacacagcagtatgttttgtaaaaataatgatgtcttggtaacagaggacactgtggctgctgtggctatgaaatctttgcagaggagccagtagaaccagtttggggttcctgggagaaaaatcagtttggtggaatagcaaaggggaagacttggaatttactaatgtagtacaataatagttaattcattaaagtacccagagttctacttttctttttgctagatgcttttcctctccctcaaccccatgtcttccttcaatccttcaaggttattctagcaactctctaccttcttttgtcaagaaggttcaatctgatttttcgtcagtatcccaaaacaattatagctaacatttagagagttgcaaaactgggttcacaacaatccttcgtcataggaaccatcattattcccctattactgatgaggcagctgagatcaaagaggttaggccaccttcccaaagtcagagagctaatcaatggcagagccagaattagaaagcaggtctgactccaaagcccaagatcttaactacaatatcaaactgcctgcctccaaatgacaccaaatgaatgggggaaagttaatagtgtaagctagagaagaactaaaagagacaaattacacatctttgggtgagcctctgaagtgctcagaaagactcacaaaaatgttcttagaattctgtctagaaaatttcttccattcctgcatcctcagagagaatcatcttgaaaatgcagttagtccctaagaatccttgtgggaggcaaatgaatctagaaatgacagcaagcttaccccttccccagatgaaccaaacccctcggatttagcagtacctgaagggagcccacccctgctccctccacctgcctgatctcagcaggctgtcaccagcaagatcctcattcatcgcaccatgagggaaataatggagagtccccaagtgtgggggagaaaaccaaaaagtaatgtaaaaagataaggagtaagaagagaacaaagcctttcagttaatggcagatgagaaaaaaaggtaaaataattttttaaaaaaagaaaagaacaaagctcaagctcctatttattatgtatccgcaggttctaattttttaagcttcttaagatattctggctccaaattagctttctttgcttagtcctagttattgctttagctctcttcaaatgggcccctaaagatgttgaaaaaatgtaactgaaaggtcaactggttccatgggaactgcagggagactctctgacatcttgctctgaaatgctattttgtaactttataggataataccctagaactaatcatggtaaagaatttcccattccccctggcaacagggctaatggaggctacaggggacaaggggaaagaaagatggtactaaaagagagagagggaaaaaaaaaaaggccccatctcctcatttagcagcacatgcgcaaaacagtttcccaaattctacccaaatcactaggctaacactgatgccatccaattccaaagcaacatgtcacacatgacactgtcctttctgatggaagaaaggccagcaggatgtgaggaggtaaagaactggggcagcaaagaggggatggagaagaaatataaaccataaattagggccggaagccctgctgcttgtcctgccaggagctggcaaggaaggactgaatcaagtttctgaaacgtaagaccatgaaaggggatgttaaaataaattgagagaaaacggaaaaagatcagaggagagaagagtcttattgcaccaggtttgcaatttgtctgctttctgagctgaagctctgagtaccagattttttaagatttattttaagagctttgaggcttcttggggaaaaaaaaaatcactaattgtacctctttcaaagtttccagaattttgctgcaatggagggtatttgcatgaagcaggacaagttcctcttagagaagtgcctattctttataacacagttgtgcttgtgtgtgtgtgcatgtgtaagagaagagagacctttggaagctgtttcccccacagcagtatattagtccatcaggtgcacaggtgaagaatacagaggctgatccactcaattcttgtgaacacaaaggttggcaactgattttgaagttcttactcaggatttaagaaagaagaggaaatcaatgcaagtcaaaataaaaagagatgcaagtatgtttactttctaaacaaaacaaaaaccctcaacctaaaaaaaaatttccttttaaaggcagcctcattaggcatcacagaagtgcaggccattaccatccctgaaggtcaagagcatctcaagtttggggaccctggctgaggtaccattacatgacacagattcacaaatgacagtcacagtggggtgggagagcctaactgtgcattttacccatcccaatcacatttccacaatcacacacacacacacacacacacacacacacacacacacacacaaaagttatagcctggaggagtagaagagatggagcctaacatattacctacaaccctagccagaagacagctgtgaaaacttccgaaagaaaacactcctttgaagaactgcagaaacaacacaggggccaggaaacagagcaagtgaaaaaagattaaaggaatgaggatcatcatttagcactgaaaaggggcagtaaaagaagtgagcagagccttaataatgatttttgagcccaaagttggttgagagagccactctaccaaaaagctgttctaccaaaaaactaccttctggtaactactagaaccttcaaatccctgtcttgctggtgtatagctgaaattcttgcataaaaaagggagcgaggccaggtgtcgtggctcatgcctataatcccagcagtttgggaggccgaggcaggcagaccacctgaggttaggagttggagaccagcctaacatggtgaaaacccgtctcaaaatgcaaaaattagctgggtgtggtggcacacacctgtagtcccagctactcaggaggctgagacaggagaattgcttgaacctgggaggtggaggttgcggtgagccaagatcatgccacagcactccagcctgggaaacagagcaagactccatcacaaataaaaaagggtgggggtagcaagagtttcactaaaaggggacttctacataagtttaaacataaagactattccagaaggataggggatagtcagtaactaaagcaagttaatagtaacaagaataacaggctgggcgcggtggctcatgcctgtaatcccagcaatttgggaggctgaggcgggtggatcacctgaggtcaggagtttgagaccagcctgaccaacatggtgaaacctcgtctctactaaaaacacaaaattagctgggcatggtggcgcatgcctgtaattccagctactcaggaggctgaggcaggagaatcgcttgaacctgggaggcagaggttgcgatgaactgagatcgcgccattgcactccagcctgggcaacaagagtgaaactctgactcaaaaaaaagaataaccaaataccctcagtcagccacaaggccaaatctttaaataagggaaatgaaggagaaagctaacaagcaggctgtccaatatccttcatttgagagccgtatagtgaagagtagacaacatctaagtcaggttaaaggtaaccatgtgctttgagaaaaggaaaaggagaagccagcttcaggtgggaaaaaggagccctagacatgagtagagaccagtatctgcagggctacagttctcaacacacaaagaattgtttttgggaaagctaatgaacatctgtcggctaaccctgttctagacactctctctttctcatatccatccctgggattttattatcttaagaaccaggtctttgagcaccaataacatttaggactcaaacgttttcaaaagtgaccagagtcccacatcttccttactcccaggagcttggagcacttccctagaaaagcaaagaattagaattgctggccaggtgcggtggctcatgcctgtaatcccaccactttgggaggctgaggtgggcagattgagtccaggagtttgagaccagactgggcaacatggcaaaaccccatctctactaaaaacacaaaaattagctgggcatggtagcacgctcccgtagtccccactacttgggaggctgaggtgggaggatcatctgaggctgggaagtggtcgttgcagtgagccaagatcatgccactgcactccagcctgggcaacagagagagactctgtctcaaaaaaaaaaaaaaattaggattgcctaggccttaccaggtgggcacaccagcactgagcagtccccctacagtctctacagctcccaaacatacaggccctacgaaaggagaacagttacactggccaatatttgccatgaaaaaccaggccactaccagaaagagaagcactatcccctctgacctctccatgtctcaccctgccacccactcacattctgtgaatttgtttctatctggccattgtcaattcctgtctaatgaccttatctaagaacttagggagtactacaaaaaatgtcagtaaaaaatcagagtgagataaatttgctattcctggtgagcttttgtgtttgttttattccaaaccaattcactaaagcttgcttccttatgacagaaatcctaaaaatcaatgctcaaagcctagcaaccacaaactcccccttccagtaacaaaatgctaggaagaaagagagccacataaaacgaaggaaggggaaaatggcctctccacagactgttccaattaatgggagtggaggagcacaatagttaatgaataagaaagaaaatcatcttgattacatttatttaaggaacaaagcagtaggaatgtgaatgtgaacacctgtgtacccaggttcagcgtaataaaagaacacattctcattcacagctcattcattcaacaaatgttgtttgatcatctactatatgccaggtacctttcctaggactgggaatacagctgtgaatgtgacaaacagatctcgtccctactctcatgaaacttacgttctagtggagggaaaacagagtcaacaagaagcagaaaagcaagaaaaatatcaagtggttaagttatggtgacttaagtagtcactttataccagataaaaggaagagcctttcttgtaaataacagcagaactgagctgagaatgacaaagagctcatccaatgaagacgagagaaaaatattctaggcagagggtacaggtggagcaaaggccctctgtttaagaagcagaaagtaagttactgtgtccagaacacagaaggcaagcagaagggagtaggggaggttaggagataaagctgccaaggaaggcaggcagggatcggaatatgaaaggccttataaccaggctaaggagtttggagttgattctaagtatgatggtgagcccaaagggcgtcaggcagcaaggtgacgtgctccttaagaaattgagggaaactgataactgattccaagatggaaactgacttttcagaaaagttatctaaccacagaaatttaaaacagcttaatttccccaaaagaaatgcttcactgttttgtttttttttcggttttttcttttgtggagacaaggtatcgctctgtcacccaggctggagtcaagtggcaccatctcgtctcattgcaacctccacctcccaggttcaagcgattctcctgcctccgcctcctgagtagctgggattacaggtgcccaccaccacgcctggctattttttgtgtttttggtagagatggggtttcaccatattggtcatgctggtgttgaactcctgggctcaagtgatccgcccgtctcggcctcccaaagtgctgggattacaggcatgagccaacatgcccagctgcttcactattttttaatttatcagttattaaatatgcactaagtgaagggcactgtactaaatgtattaaatattgggttggtgcaaaagtaattgtggtttttgccatttaaaattgcaattatttcatcctcatccagcactgtaagtagatattatcatctcacctataattcctataattcacgcctataattccagcactttgggaggctgggcgggcagatcacttgaggccaagagttcaagactagcctggccaacagggtgaaaccccgtctctactaaaaatacaaacattagctgggtatggtggcgtaagcctgtaatcccagctactcgggaggctaaggcacaagaatagcttgagcccaggagacagaggttgcagtaagacaagatcgtgccactgcactccagcctgggcaacaacaagagaatgtctcaaaaaaaaaaaaaaaaagatattatcatctccattttacagataaagtaaccaaagttcagacaggaggggaaatgacttgccaaaggccacgcaacatgtacatggcacaaagccaggaagggactccaagtctctctgactcaaaagagccagtgcaccagctactttctctaatgactccatcccttccctcacaagagggaagagaaaaaacagttctttctggttactactcaaagcttctgcccattgccttctctctacttgaaggagccgctcaccttccccagtaagggacacagattgaggcctgactccaaataccttctccaagaaccttccctaacaaggcaaacccaaccccactgtccccatgtcgttagtcagcctctctcagcccctagggtcgggcccatgggttctgtccctaatgaaacttgagctctttaaaggcattacaatcttcaccattcattgagcacctaccatgtgccaagcacatgacctccattatttcatttcatcctaactgccctaggaggtgggtatcagtacacacttattcagatgaagaaactaagtcacagaagtaataagaacaaagtccaaaagctagtaaggaagaggtgggaagatggtagagtagaaagcaatgaggactaaactctgattttatctggcccaaattcctatctaaaaggtctggggagtcatgtcctacaaacagtaaattctcatcagatgggttttatttaaccatgtatattgagacttactttccaatctgactctggcataacaaggaagaaaataaaaatattttaccccaaaacatgtttctctgccatatcttgaatggccctgcaaagtgatcccttgtgggaaaaatccacatattctatagagaatcccctacccccttgttttcctttcttccttccttcctttccagatccaggagataatcaactaagagtcacgcattcttttaggtccgataagaaacattttacaacctgctctctctgaagtgtgctacctgagagcttcctctgcacaataaaacttggtctccacaatcctttatgttaacctaaacatttcctttctattgatcccagatcttcagataaactcaaccgtcagccagaaaatgtttaaatttacctatagcctggaagcccccactttgagttgtcccacctttctgaaccaaaccaatgtatttcttgtttgtttgtttttttgagatggagtttcattcttgttgcccaagctggagcacaaatgtgtgatctcggctcactgcaacctccacctcccaggttcaagcaattctcatgcctcagcctcccgactagctgggattacaggcacatgccaccacacctggctaattttttgtatttttagtagaaacagggtttcaccatgttagccaggctggtcttgaactcctgacctcaggtgatccgcccaccttagcctcccaaattgctgggattacaggccaaaccaatgtctgtcttttttattatttttattattattattttttgagacggggtctcaccctgtcaccaggctggaatacagtgacacgatctcggtttactgcaacctccgcttcctgtgttcaagtgattctcctgcctcagactcctgagtagctggggctacaggtacatgcccaccatgcccggctaatttttttttattattttttagtagagatggagtttcaccgtgttagccaggatggtctcgatctcctgacctcaagatccgcccacctaggcctcccaaagtgctgggattacaggcctgagccaccacgcctggcctgtatttcttaaatgtatttgattgatgtcttgtgcctccctgaaatatataaaaccaagctgtaccccgaacaccttgggcacatgttctcaggacctcctgagggctatgtcatgggccatggtcactcaggtttggctcagaataagtctctaaaaaatattttacagagtctaactcttcgtcaacagcacagaaatctgtctccctaactagacaacaactgcactgacagaatttgtctgatataaatcagagtcatgtgctgcacatttcagtcaacaacagaccacttatacgacagtggtctcataagatgacaatggagctgaaacattcctatcacctagtatttaccattaaatacttcttattgctattttagagggtactcattctacttattttttaagaggggccaggcatagtggctcatgcctgcaatcccagagctttagaaggtcaagacaggaggatcccttgaggccacaagttcaagatcagcctgagcaatatagcaagatcctgtccttacaaaaaatacaaaaataggcgtggtgatgagtacctgtagtcccagctacttggaaggctgaggcaggaggactgcttgagccaaggaatttggggttgcagtgggctatcatcatgccattgcattacagcctgggcaaggagtgactttttttctttttcctgagacaggatctcattcccatagcccaggctggagtgcggtggcatgatagcagctcactggagcctcaactttccaggctcaggtgattttcccacctcatcctcctaagtaacgggcactacaggcacacaccagcacacctggcaatgtttttgttttttttgagacagagtctcactctgtcgcccaggctggagtgcagtggcacaatctcagctcactgcaagctctgcctcccaagtgcataccattctcctgcctcagcctcccaagtagctgggaatacaggcacccaccaccacgcccggctaattatttttttgtatttttagtagagacggggtttcaccgtgttagccaggatggtctcgatctcctgaccttgtgatccacccgcctcagcctcccaaagtgctgagattacaggcgtgagccaccgcgcccagcctttgtcttgtatttttagtagagactactaacacggtttcgccatgttgcccaggctgatcctgaactcctgggctcaagtaacccccaccccccgcctcagcctcccaaagtgctgaaattacaggcgtgagccacagtacccagccaaggagtggctttaaaagaaaaacaaagttaactgtaaaccagcctcaagcaggtctttccagaaggcactattatcacaggaaatgacagttccaagtgtgtgattgcccctgaagaccttccagtgggactaaatgtgaagatagaagacagtgatgttaatgatcctgaccctgtgtagacctaggctaatgtatttttgtctttatttttaacaaaaaaagtttaaaaagtaaaattaaaaactgctaatagaaaaatgcttacagaataatgtataaatatttttgtgccgttgtacaatatgcatttgtttaagctgttattatgagtcaacagttttaaattttaaagtatataaagtaaaaatattacagtaagctacagctacatttattattgaagaaaaaattttttataaatgtagcgtagcctaagtgtacagtgtttataaagtctacagtagtatacagtaacatcctaggctttcatattcactgaccacttactcactgactcacctagagcaacttccagtcctgcaagctccattcatgttaagtgcactgtacaggggtactactttttattttttctcttttaataggttggggtctccttctgttgcccaggctgatcttgaactcctgggctcaagcaatcctcctacctcagcctcccaagtagctgggactccaggcatgtgacacccgtgtgcagctaccattttttatcttttatactacatttttactgtaccttttctatgtttagaaatgtttaggtacataaatgcttaccattgtgttacaattgtctataatattgagtacagtagcaagctgtacaggttttagcctaggagcaagaggctatacaataaagcttagatgtgtggtaggctataccatctaggtttatgtaagtacactttatgaggtttgcacaaggacaaaaatcacttaacacatttttcagaactatccctgttgttaagtgaagtatggctgtattttggaactctggaaacaactgaagccttgcaacttccagggaaaggccttgatggcaaattgcagttaatgtctatcaatttcaactcttagcagagtagcagctacgtttcccccaacttcacggcaggtagttgtgtatgtgttcctggagcagcttgcacacagcttgcacaaaaagaacactgtcttccaaatactggggatctgtgctgattctgattgctgcttctgattacagaggtgcagacaaagtagtagcagagattgttgttgctcctcccagcccggttgcaagcccctttccctcaggctgaagtgacttcctggagatttaaagggccaatgcttttttttttcctcccctgatcatttatctttttcaccttttgggagtcagacattaaagaacattcaagcaaggcgcagtgactgacacctgtaatcccagtataggaggccaaaacaggcagatcgcttgaacccaggagtttaagaccatcctgggcaacatggcaaaaccccatctctacaaaaaattaagtgggcctgacggcacgtgtctgtagtcccagttactctggaggctgaggtgggagaatcacctgagcccaggaagttaaggctgtagtgacttgtgatcacaccacttcactccagcctgggcaatgaagaccctgtctcaaaaaaaaaaaaaaaaactgaatttttaaaggcaactacataagcctgtccagtcatgcatgcttgtagtcccagctactcaaaaggctgggatgggaggattgcatgagcccaggagttggatggtatagtgcattataatcatgtctatgaatagtcccagtactcctgattggacaacatagcaagatcctgcctctaaacaaaaatgtttttaaggcatctacatgtgtaaggaaaatcagaaagtcactgcacatgcccaggggaaagtgcaggctcaaaagagacctgagaagaccttaagtttacacctgaggctgatcctcagcacacaaagcctatgacaataaaaacaaaaacgaaaaccacaaacactgggaaaggcaaaagatctgctttccagggttaccacattattatattcaaatgtccagttttgaacccaaaacacaaggcatacaatgaaacagaaaagtatggtgtgtgtgtgtgtatgtgtgtgtgtatatagatagattttttttttttttttttgagacagagtcttgctctattgcccaggctggactggagtgcaatggcacaatctccactcactgcaacctccgcctcctgggtttaagcgattctcctgcctcagcctcccgagtagctgggactacaggtgcacaccaccacacctggctaattttttgaatttttagtagagatggggtttcaccatattggccagtctggtctcaaactcctgacctcatgatccacccaccttggcctcccaaagtgctgggattacaggcgtgagccaccacgcccggcccaagtatggtatatttaagaaaaaaaaaagctctactccctctcccctctcccctctccctctccccacggtctccctctccctctttccacggtctccctctccctctctctccacagtctccctctgatgccgagccgaagctggactgtactgctgccatctcggctcactgcagcctccctgcctgattctcctgcctcagcctgccaagtgcctgcgattacaggcgcgtgctgccacgcctgactggttttcgtacttttttggtggagacggggtttcgctgtgttggccgggctggtctccagctcctaaccgcgagtgatccgccagcctcggcctcccgaggtgctgggattgcagacggagtctggttcactcagtgctcaatggtgcccaggctggagtgcagtggcgtgatctcggctcgctacaacctccacctcccagcagcctgccttggcctcccaaagtgccgagattgcagcttctgcccggccgccaccccgtctgggaagtgaggagcgtctctgcttggccgcccatcgtgtgggacgtgaggagcccctctgcctggctgcccagtctggaaagtgaggagcgtctctgcccggccgccatcccatctaggaagtgaggagtgcctcttcccagccgccatcccatctaggaagtgaggagcgtctctgcccggccgcccatcgtctgagatgtggggagcgcctctgccccaccaccccatctgggatgtgagaagcacctctgcccggccgcgaccccgtctgggaggtgaggagcgtctctgcccggccgcccccatctgagaagtgaggagaccctctgcctggcaaccgccccatctgagaagtgaggagcccctccgcccagcagccaccccgtctgagaagtgaggagcccctccgcccggcagccaccccgtctgggaagtgaggagcgtctccgcccggcagccaccccgtccggaagggaggtgggggtcagccctggccaggccagccgccccgtccgggagggaggtgggggggtcagccccccgcccggccagccgccccgtccgggaggtgaggggcgcctctgcccagccgcccctactgggaagtgaggagcccctctgcccagccagccgccccgtccgggagggaggtgggggggtcagtcccccgcccggccagccgccccgtccgggaggtgaggggcgcctctgcccagccgcccctactgggaagtgaggagcccctctgcccggccagctgccccgtccgggagggaggtgggggggtcagccccctgcccggccagccgccccgtccgggaggtgaggggcgcctctgccccgccgcccctactgggatgtgaggagcccctctgcccggccaccaccccatctgggaggtgtacccaacagctcattgagaacgggccgggatgacaatggcggttttgtggaatagaaaggggggaaaggtggggaaaagattgagaaatcggatggttgccgtatctgtgtagaaagaagtagacatgggagacttttcattttgttctgtactaagaaaaattcttctgccttgggatcctgttgatgggtgaccttacccccaaccctgtgctctctgaaacatgtgctgtgtccactcagggttaaatggattaagggtggtgcaagatgtgctttgttaaacagatgcttgaaggcagcgtgctcgttaagaatcatcaccactccctaatctcaagtacccagggacacaaacactgcggaaggccacagggtcctctgcctaggaaaaccagagacctttgttcacttgtttatctgctgaccttccctccactattgtcctatgaccctgccaactccccctctgcgagaaacacccaagaatgatcaataaaaaaaaataaaaagaaaaaaaataaaaaagaaaaaaaaagaaaaaaaataaaccaaaagaaactatccccgaaaagacctaatggcagatctactagacaaagactttaaagcaacagccttaaagttgcttaaagaactaaaggaaggcatggagaaaaatcaagaaaacaatgtttggaaaaagattaaaatatcaataaagatacagacatcttaaaaagaaaccaaaaattctagagctggaaagtacaataactgaaataaaaaattcactagaggaattcaaaggcagatttgagcaagcaaaagaaataatctgagaacacttggagactggacaatggaaattatcaagtctgaggaaaagaagcacaaagactgaagagaagtgaatagagactaagggacctaggggacacaatcaagcagaccaacatacacattgtgaaagtcccagaaagaaaagataagtagcagagagaacatttgaaaatataatggtacaaaatttcccaaatttgatgaaagacacgaacataaacatctgaaaagctcaacaaactccaaacaggatgaatacaaagagactcacaccaagacacattataatcaaactgttgaaagacaaagggccaggtatggtggcttagagccaggcatgatggctgatgcctggaatcccagcactttgggaggctgaggcaggcaaatcatgaggtcaggagttcgagaccagcctagccaacatggcaaaaccctgtctctactaaaaatacaaaaaattagctgggcatggtggcaggtgcctgtaatcccagttacttgggaggctgaggcaggagaactgcttgaacccgggaggtggaggttgcagtgaggcaagatcacgccactgcactccggccggggaatagcgtgagactccgtctcaaaaaaaaaaaaaaaagacagacaaagacaaaatcttgaaggggagaaaagcaactcattacacacaaggatcctcaataagataaggagatctctcatcagaaactttggagggacccactcccaagatggcagccgcaatggctgccagctgttgcggccacagtgaagacaggcagcaaaacaccagctggtcccagattcactgctaagtgctgaggggagtttttctctatcctctgtgacatttccaattttagataatgcctcacatctctgcccccactccagaacccgctgatgcccccatgatcccaaagaagacagcctaccctagaattcacccccaggatgttgcaacaccacattttgtttttacataatttaagagactaatgcattaaaaaaatagatataggttatgtttttagacacacaacgtgtaagatgcaatatcatgacatcaacaactgaaaggggtgagaaatggagctgttgaagaagccgagttttctatgctattgaagttaagctattataaattcaaattacagtgttataacttcaggatgttaaatgtaatgcccatggcaaccacacagaaaatagctaaagaatatacaccaaaaaaaatgagggccgggtgtagtggctcaagcctgtaataccagcactttggagaccaaggcaggcagatcacttgaggtcaggagtttgagaccagcctggccaacatggtgaaaccccatctctactaaaaatacaaaaattagttgggggtgatgacaggagcctataatcccagctactcaggaggctgaggcaagagaattgcttgaacccaggaggcagagatttcagtgagccaagatcatgctactgcactccagcctgggaaacagagtgagacgctgtcttaaaaataaacaaaaataaataaataaatacctaaaacttacacgggacacagcaaaagcaatactaaaggagaaatttataactataatgtgtacattaaaaaacaggaaagatcagccaggcacggtggctcatgcctgtaatcccagcaccttgggaggccaaggcaggcagatcacgaggtcaggagatcgagaccatcctggctaacatggtgaaaccccgtctctactaaaaatacaaaaaaaaaaaaaaaaaaattagccgggcgtggtggcaggtgcctgtagtcccagctactcaggaggctgaggcaggagaatgacgtgaacccaggaggcggagcttgcagtgagctgagattgcaccactgtactccagcctgggtgacagagtgagactctgtctcaaaaaataaaagaaaaaaaaaaaaacaggaaagatcacagacaacaacctaactttacaatttaaggaactgaaaaaagaaatgcaaactaaacccaaagctagcagaagaaagaaaataataataaagatcagagctaagatcaatgagatagagaatagaaaaataatagaaaaaaatcaacaaacctaaaaggtggttatgcaaaaaagatcaccaaaattgacaaacctttacctagatggacttttttaaaacaggccaggcacagtggttcacacctataatcctagcactttgggaggccaagataggattgcttaagcacaagagttcaagacccgtctgggcaatatgtcaagatcccatctctacaaaaaattttaaaattagccaggcatggtggcaggtgcctgtggtcccaactacttgggaggctgaggcagaaggatcacttgagcccaggaggtcatgactacgccaccaaactccagcctgggcaacagggtgagaccctgtctcaaaaaggaaaaagagagagaggactcaaattactaaaatcagaaatcaaagttgggccaggtatggtggcacatgcctgtggtaccaggtactcaggaggatcctttgagcccaggagtttgagaccagcctgggcagtacagcaagaccccatttcaaaaaaaaacaaaaaagactgcagggtgaagtggctcagcctgtaatcccagcactttgggaggccaaggcaggcagatcacctgaggtcaggagttcaagaccagcctggccaacatgccaaaaccctgtctctactaaaaatacaaaaattagccgggcatcatgttatgtgcctgtaatcccagctactcaggaggctgagccaggagaatcacttgaacatgggaagcagaggttgcagtgaagcgacatcatgtcactgcactccagcctggatgacagagtaagactgtgtctcaaaaaaaaaaaaaaaaaaaaaaagaataaaagaaaaaaataatgaaagtggagatattaccactgattctacagaaatgaaaaggattataagagtgtactaggccaggcgcagtggctcacacctgtaatcccagaactttgggaggccaaggcaggtggatcacctgaggtcaggagttggagaccagcctggccaagatggcaaaaccccgtctctactaaaaaatacaaaaattagctggcatggtggcacgcgcctgtagtcccagttactcagaaggctgaggcaggagaattgcttgaagccgggaggcggaggttgcagtgagcaagatcgcaccactgcactccagcctgggcaacaagagcgaagctccatctcaaaacaaacaaacaaaaaaaaagagtgtactatgagcaggtgtacaccaacaagcttgataacctagatatggacaaattcatagaaccaaaatctaccaagactgaatcacaaacaaatagaaattctgaacagacagacctgtaactagcaagccaactgaaccagtaatcaaaaatctcccaacaaagcaaagccctagacctgatggcttcaccaaacatttaaagaactaacatcaatccttctcaaacttttccaaaacattgaagaggaaggaatattccctactttattctctgaggccagcgttactctgataccaaagccagacaaacactacaagaaaactacagactggccaggcgcggtggctcacgcctgtaatcccagcacttcgggaggccgaggcaggcagatcacctgaggtcaggacttcaagaccagcctgggcaacatggtgaaaacccgtctctactaaaaatacaaaaatcaactgagcgtggtggcgcatgcctgtgatcccagctactcaggaggctgaggcatgagaatcatttgaacccgggaggtggaggttgcagtgagccacgatcttgccattgcatgatctgggcaacagagtgagactcagtctcaaaaagaaaaaaaaaagaaaactacagacctgtttctcttatgaccttttttgtgagacagtgtctcactctgtggcccaggctagagtgcagtgccacaatcacagctcactgcagtctcaaaaccctggtctcaagcaatcctcccacatcggcctcccaaagtgctgggattacaagcatgagccactgcaccctgactctttgccacttcataagaaggtggcctttccttcagtttccaataacatgttcctaatttccatctgaggcaccattagaagggcctttaccatccagatttctatctacattctgatcaagaccacttagataatctctaagaaaacggaggctttctctacagctctcttctgaaccttcgtcggaattacccttaaggctcctttcatggcaatgcacctcaaaactcctctagccttctacccattacccagttccaaagctgcttccacattttaggtatctgttatagcaacaccctacttctcagaaccaatttctatcttagtccactcaggctgctataaaataaaaatattttagactggataatttatatataacagaaatttattgctaacaattctaaaggcttggaagtccaagaacaagatgccaacagattcaacgtcaggtgagggatctctgcttcatagatggcaccttcttactgggtcctcacatgcagaagaggcaaggaagctcctcgggcctcttttataagggcactaatcctattcatgagggtggagccctcatgacctaatcacctcccagaggaaccacctcgagggttaggtttcaacatatgaatttggaggggacacacattcagaccatggcactatcattattccctatttagagctgagaaaattaatgggcaggaaagcaaagtaaatagtccaaggtcacatagcttccaagtggagaagctgagattctttttttttttttttttttttttgagacagagtctcactctgtcgcccaggctggagtgcagtgacgcaagcttcgctcactgcaagctccgctttctgggttcatgccattctcctgcctcagcctcccgagtagctggaactacaggcgcccgccaccacagccggctaattttttgtatttttagtagagatggggtttcaccatgttagccgggatggtctcgatctcctgaccttgtgatccacctgccttggcctcccaaagtgctgggattataggcgtgagccaccacgcctggcctttattttatttatttatttatttatttatttgagactggctctgtcacccaggctggagtgcagtggcaccatctcggctcactgcaacctccgcctcctgctttcaagcgattctgctatctcagcctcctgagtagctgggattacaggcacacaccaccgtgcctggctaatttttgtatttttagtagagatgaggtttcatcatgttggtcaggctggtttcgaattcctgatctcgtgatccacctgccttggcctcccaaaatgctgggattacaggcatgagccaccgcgcccagccgagaagctgagattctaactaaagtcagccccagtccaagggccaagctcctaaccactatgcagcatggccttccagatgaataagtgaaaggagtagtgggcaaggccacagtatcactaaagagtctggtctagggtctatacccgcccaccatgcacttaacacttggtctggcagcacgtaactctgacccagttttctttataccacaggcaactcctaaacctcagttttcctggacacacagtgggaggaacaactccagcccatttctggccctccagacattggttgctgccaagagagaacatgtgcacatctacatcaaccagaactgaatgttacacaaaccacaggtgctggctttgctaacttggcacatcacatctctgggagttgccagtgtcagtggcttaagtggtctaaggtgaagggggtagcccttacccagtagtgacagccaagagagggatggtgacacagcaggttacaaaggactctgtagctgtcagccgttaacatgtgacaagcctgaaacctccaggcctttttctgtgcagatggaaagatgccaagtgctggcaccctgggccaccatgtctgctgagtggccaggtgccccaacaacacactgactactggcactgagagagcacatgaatcaggaggaacaaggccacactaaaggagattagtctcaagattgccatttagctgactgaaggaaaacaacctattacagtaatgttccttttctgatcttcattttcactccctcaacaaaatccatccagtgtccaaaagggtgctgctcatttgcaaatccaaaaccaccaaaaccaccaccaactctccaaaggcttcccctgttctccaggtaaatatgaaatgccatgccacagctgacaaggcctgccctcaccaacccctccaacctcagctggctcctctcactctctgtgctccaaccatactttcagttcctcataaaactccccacccactgcctgcttccagagcctttgcaaatccaggccctcagcctgaaattttcctcaacgtcctgtcactctgcttggtaaatacttgtttggtcttcacaatatttactcgaacatcacttcctcaaagaagccttctatgataccctcttagccctaggaccaagtcaaatccctctcagatgttcttaactctttctttcaatacacttattccaagtgtaattttactaactttgacatattcatcagtacactctaagctggaaccctatctgacactgtatctcagggcctaacagtctctggaatgtaacagatgttttatatacatttgttgactgaaaaaataaaatttcagagagaaggaaaacgaagctgtatccaaatcaaagagttctacttagagctgttctcctccctacatgaccttaagccaaacaattctctccccttccccctttctctcccaaatttcttacagaagttactttctgtcctgacattctttaagctggtggtagccatagtgataagctggcctacagccagaaacagtctaaaaagatatcaccttgtctgagtgctccaggcttccaaaataaaagttcccagcacaggcccaggcaggcacaaacacaaaagcctttccccagtaaagacactgaaccaaacaaccaggaccccctgaaagaaatgagtaatccccagggcagacagtgccccccgagtgacccacccaaagaaagaagggaggggaggcaaggctacaggggcagaagcaggcattctgtgccctgatgagattttaaaccctcttttactccttggatgaagcagagatgtgcccaaacactaaatatcaaagtcgctcctgatgaggcagcttcagaggaggtccacagattgtggctcagaaaagcaatatcagcaactaaagaagttcacataaagctctaattaaggccattttccctctacagaagcaggaggatcttctccttacccttctcttatgtagggtaggcaggtagggggtggcaggaagggaggcagaagtattttttgagcaccacttagtgccaggcatagtgacaggtactttatagacagggctattaataaaaaacaaatgggaaatgaataagcacatacacagataggtagctgatgctcagcgaggttaagcaacttgtccaactattgaatggtaaggtcaagggtcacacccacagccagatgtggtggctcatacctataatcccaacacttcagaaggcagaggagggaggatcacttgaaaccaggagttcaaaaccagcctgagcaacacagcaagatcccatctctacaaaaaattaaaagattagccaggtgtggtggcacatgactgtagtcccactactagggaggctgaggtgggaggatctcttgacctcaggaagtcgaggctgcagtgagccaagactgtgccactgcattccagccagggcaacagagcaagaccctgtctctttaaaaaaaaaaaaaaaaaaaagttggccaggcacggtggctcatgcttgtaatcccagcactttgggagaccgaggtgggtggatcacttgaggccaggcgttcgagacccaggagttcaagaccagcctgaccaacatggggaaacctcatctctactaaaaacacaaaaaaattagccaggcatagtggtgtgcacctgtaatcccagctacttgggacgctgaagcaggagaatcacatgaaaccaggaggtgaagattgcagtgagccgagatcacgccattgcaatccagcctgggcaacaagagcaaaactccatctcaaaaaaaaaaaaaaaaaaaaaaaaatcatacccagctttgcctgaatcagacttttttctcctaccccaatgctgcctttgtgggtcatctattagccccactctgctcctcacccctttaccaccaccttcctaaccagaattgggaatgtagctcctggtaagctctctggcaaagaaaagtctgtcttccatgagcacaacccaccacaattgatacatacaaaactgagatgcaccaccacttcctaggtttggagcacagtttgttgtagggagcaaaattcatcatctgcaactatgggcatgaggctggattttctgaaaacccaaaatgagaccacagtgatgaagtctctgcatttcccagaacccacagctctgggcactagtatggtattcctgcagtgtagcatgccttaaaccaaaggatggtgtgctccatcacaccatcagaaagacagtacctgcagggtagacaatcccagctgaagtctccatagctcctctagctaggcagagagggtagcaactccatacctgagtcacctgcctctacacagcatcttctgcaaggttaagcagccattcattgtgctgtagttcaaggttaacccttccccctgcactcatttcaggatctgcctcttatcaaaacctatgccagctgattattataatgataactattatgccattataataacattattgtgctttttttctgcacttgacatctgttggctgataggtttaaacagtacataagcaataattatgcagtgctctctcctttccaaccaagcctctagtgtgactcttaatgttacatccaactgcaataaatgcccagcccgagcagcagtgggaaacatggctcatctgggttcacccaccatgcctctagtcacagtgccagaaacagaggctcaactaggtccctaattgttaacatgctcccctgctctcccagggatttgggggaaatactacccagcaagcaatttattgttgaaaacccccgcagggctggaggagttatatacaagtctcagtactgcagagggacaagcagtaccaaatcacaacagcacacaccatcacaagagaagaagcacaggaaaatgcattcctccactgggagttctcaaacaaatgatttccagagagtcattctgcctggttccccacacacagttcttggcaattgctggtaaaattggcagaagggagaggaggggtaggactatctccaggcttctattttgaagttgagaaatcactaaactggctgctcagccttctttataggacccgccagagtccaggatagagtctggaggccaaagcagagaagtcccacctcctgtcagccaaagcccttgcatctacctttcacactgttgatgacaatcaaggtagaaaaaagatgtgagattctttaactgcagactatcaatatgcctgaattacacattagccctattaaagtaaaggcaacccatagcaaggcttcactaaaaaatgatgttaaaacaaacctcgccaggggaccagggctggcctgttttgttttctacactgtaatacacagtttttgtttttttggttttttttaaggcagagaagggggtggaaggttatttgaatttaaacgagcagtaaacactataatctgtgtgcaaggagaaaaggaacattcagaagtgccaagtgcagcctcttgggacatgtgtggccagggcagtagtagcccggggggctttctccttcagcctcaacacgctgctctcattgcttgggagcaggcaagccagcaggcaaggtccacgcagcacaaaaaggcactgttccctaggtctaaggagaagattgccctctcagaaggaaattaatatgacgcaacacggaatgagcagggcgagtcatccacagaagtcacctatctaaggagggggtttgaagaggtgttactcaaggcatggaccacatctgtctcattcatcactgtatttccagggctaagcaggtcctggcacacaatgggtactcagcaaataatggtggactgaatggtaaccagaaagaacccttaggttggaagccactgacaagagctagaatctaactgttcctattgtaacctgtggtaacaaaagagccgtggacggcaaagaatatataaagggagccaagagaataaaaatgagtctatctccagtacctggtgccttaatagactgacaagtgtattctggtcagattacaatatagccctagaaggacaaagtgggaaggagaaaaggggaagagggaagagtgagaaacaagtgagacaaaacatttattgagtgcttaccatgtatatatctgaaaaacccagggggtttcacagctgaggacacaggagcaggggggttgagtagctcctctgaagtctcacagctgttacatggtttaaatctgggtgtatctgatgctatgacccaaaagcttgccaccataatttgccttggtttcctccagaggggagctggcttcccagctaatctctcctacagaggagagatgctcttacatgtccacataaatcaacttagtcgtcatgtttattggagttagttaactggaactgtgacttgatggtctcttatgaatttcacatgcctgaggcaggcccccaggaactgaaacctggatgaactaactaagtttacaggcctgcaaagctgcacaccagtaaggtcctaagtcatcagctttctagggcaaacctctctggcccggcacaggtcaggtctgggtaaggaaagaacctaagcatgacctctacatgcccccaagttctcctcagaaattacaaagaagccttccctactccatgctatgtcagccatacacagaattctatttgaaggctttaaattctgatttaagtaggactaacagaagtaaaaagccaaggatttctgcatggtccttagaagcaaatgagccttccctccatgtccatggtgctcctgcctccccggagtttccagagaccttccacacccatgatgtcaggtgcagcagagtagaaagggcaaggtgattttccatattctattcagaagagaccagaggtgagaatcagccagtgctcctaatggaggtgaataccctggacaaactcagaggcagcttaggttgtactaaaaaacattttcaaggttgtctgtttattgcacctcctgtatgagggctttcatcagttaaaatgggttttttcaaagcacagggaagcggatgattcacccaggtgcacaacagctgctgggaagacctgtgggaagaggccacccggcaaaggcaggctgtgtatggtaagaagggtctccaaggaatgccctacatgccaagccacatgctgtcaggatattaatccaaacccatcttgcacactttacaatgtttactctctctgggatgtggagcattaaattatatccaaggactacacaagtccttccaattctattccacactcacttctttgctaaaaagatttgtaacctggaaacaaagccctctgcctaatagcagcaataactctccgcaaagaataggaagccagactgtcagttcaaactctcctaaaaggtattgccccattgaagctttagtttaggtttctccaaaaagtggagaaacctactactgatcccctttttccagagaggacaggcctgtgtaactaagcatcctgaaaggagggttcaaaccaaaagaggaaagaggaatcaccaccactccattcctgccctaactgcaatggtcctggaaatggtaaagaattccaaagaggactgcctcattgctacaagaactaagaacaaggtacattaataggagacaaagctacctggattagtcacagccctactctggctagcagtatgaccctaaatgggtcatttagactctccgagcctcaatattttaccaccataaaatgggggtgttgtgtggccaggcacagtggctcattcttataatcccagcactttgggaggtcaaggtggaaggatcgcttgaggccaggagttcaagaccagcctcggaaacatagcaaaaccccatctctacaaaaaaattttaaaaaattagccaggcatggtggcacatgcctatagtcccagctcaggaggctgaggtgggaggatatcttgagcccaagattttgaggttgcagtgagctacgatcacaccactgttactccagcctgggtgtgagtgagatgttgtctctaaaaaaactacaactaaaaaataaataaatggggatgtcataagaatcagactgaaaacagtaaaatttgaaaacagtaaaatattgcacatactttacacctgattgttattccaaagacccctgcatgagaaaccctaggacatttctagggagcagagaggccaagctgtcacatctgagaggcagtctacagcgactgggtccagttgtttacagagaaatccatatgtcaggaataaagtgaggacagagtaaaatttgaagagaagaccacacatgggtctgctcagctacatttaaaaaataacaatacagcaggtctccaaataacattgcttcgatcaacattatttccttataacaccgacgagaaaaaaataattgtttcccagccagggccactgcttgtgtggagtctgcttattctccccatgtctgtgtgggttttctccaagtcctcagtcaccttccacatcccgaagacgtgcctgttaggttcactgttgcgtgtaaggggtccagtctgcatgagtgtcagggtgtgtgagtgtaccttgaaatgggatggcatcctgtccaaggctggttcctgcctggtgccctgagctgccgggatgggctctggccacccaagaccctgaactaatagggtagtaattatctcacttgtttttgttaatccttcttaaaggaatgtatagctcacatttatctcagtttttaatattagaagtgttttggtctttatttagaagtttggtcatgtttctgtaacaagaaatattctgtaggaacttaactcttgtttataccaatgagccatagtaaaattggttttgtatacatttcacttaaagtcacagtttccaagaacttatgaccgatgtcaagtgaggacttactgtatatgcatatgtttcaaatttgaaaaggcacacaaagacatatagtgaaaagtaagtctccctccttcccaattctctagttacccagggcctctcactagagacaaactgcactgctttcagtttctcatgtagtctgcccgagatatcccaggcagctaatttctactggagatggggatatcatttgtggcaacactctcagacctagaaggtgatgccaggcaagtaagcactgctggggcacttagggactatgaaaaaaatgagacagccagaggataagatatcaccttgcaaaaggttccatggagatgcagacttccttctggctattatactgttttgccccttggctgaccacatttaagcagtgattctgtacaatgtatttcccttttagttgtatttgttcacccagagctctttctcagagatgtcattaacagaagtggcctctgggaccttatgctgcaccagcctgaccaccaggcccttcaaagtagccagaagcaggaacaactatcaaacctgcctcagtggaagctgagcaaaagggcaaaaagtgcaaaagttcttgagtcaccacctttctagggacaaaagttgcttttcatagcccagtgaaatcagaatataagggaggataaagcccagaccatagatgttctacagggccgaacccaagagattaagtcactacccacagaaaatcataggacacttttatctaaagataggctttcaccaaacgccctcaaaagttttcaagctatgtcctcccctcccccacctttattattttacaaggaatttaaatgtgtgaaactccagcctctacctaaaggatacagatgggtagcctataggtcaaatctagaccacaaatatgctttggtagtccctagagattatgaatatctggcctcccatatgacatgaggaggccatactcacccatgacgataggctgagtagcagccacccctcatgaagcacataagcactccggtttgacacaggcctaccattctctgttgcctctctgttcccaacttggccctaaaaacatctgagttggagactcctagccagtgagtaacacaggaggctaaactggcaagtacatcagctgaccaaatagcaggactcttgaattcataaacatttattgaacactctctatgtgccaggactgtgctggggattggatgcatgaagaggaatgacagatgcagtgtctgccctctaggaagttctaatccaattgagtgtataaggcttactctaaggaatccaatgcttcaaaaacaaagggctctgggaatggagcatgtgaactcactgtggctgggaatcaagaaatgcttcagggaagtaggatttcaacaggattgttatcatttcttaagttttcatgtaaacatccattcaacaaccatttatggtatccatattacactcagcattatgctaagagacacattaaatcacaacccatatccttgagaagctcatataaaaagagacaaacatcataccataataaaagtgtgctgaattctataataaaggtgttgcaatggggatacagatgaggacacatcaggtaaggctcactgaaggcggcagctctgcagcataaagtagggaaccggctgggtgcagtggctcacgtctgtaatcccagcactttgggatgccgaggcgggtggatcacaaggtcaggagctcgaggccagcctggccaacacggtgaaaccccgtctctactaaaattacaaaaattagccgggtgtggtggcacatgcctgtggtcccagctacttgggaggctgaggcaggagtatcactggaacccgggaggcagaggttgcaatgagccgagattgtgccactccactccagcctggggcaacagagcaagactccatcttaaaaaaaaaaaaaaaagtaggaaactaaggagagagtactctgggcaaaagaactggcagagacaccaacatgaagcatactcagaggaccacgtggatcagttcatcaggagcaaggggtacacgtgggtgatggtacggacatattaattaaaatggtaggatgggtatacactgcaataggcttggaacaccaacaacctgatacatttggaatttattcaggagctagtgggtgccattgaaggcttctgatatggtttgaatttgtgtccccacccaaatctcatatcaaattgtaatccctaatattggaggaggggcctagtgggaggtgactaagtcataggggcggatttcccccttgctgttttcacaaaagtgagttctcacaggatctggccatttaaaaatgtgcagcatgtcccccttgctctctttctcctgctccagacatgtaagacgtgccagcttccccttcgccttccgccatgatggtaagtttcctgaggccttcccagaagcagaagtctgtacagcctgcagaaccatgagctaattaaacctcttttctttataaattacccattctcaggtatttgtttataactgtatgagaacagactaatacagcttccaagcataagtattctctgataagcacaatatataggaagacccaaagtggcagtggtatatagtgtcctggaggaagcaaaagcaagaaataagagggcgcttctgtaataattctggagcacagtcacaggaaacaggggaagcaacaaaactaggtaaaaaagatactgcagaggctcgctaaaaagaaaaagacaatggcattttcttgaatgtactaattcctattgtttaccaattcagattggccttccctccaaatagtgagttttttttaccttatttgtttcatacagagaagtgaggcatggtctatagtcatagtgcttggatttttttaaaaactcaacttgagatcaaaataatgggattggctccaggggctttttcctcactcccttgctacatggaaccagttgtacatctcaaagagagagacagtcaacttgagcacaaaatctgggtcagtgtatgtgactgtgcctccgtgactttgcacaaggaccagaaatgagcatacaaatcagaggaaagcagtgacaaaagtcaacattcccttgatgagctaattgcttcatgtctggctgaagagcagaaagcaagagataaggagaacatactatctgagggaccaggcaggctctggactagccagccctaccccaataaaatcccctcatcagacactgcccccgaaacaaggcctgctggcttgagcacctgacaagagagaacctgagaaagataagcactaagctgagtaaggaaggagatggcagagaagcagcaaagttccttgctactcacaacttttagttattcagcatgaaatacctataactattggtataaataatatgtaatacaaaccaactaagacaacaatgaggtgatggttaagataaaacttgcttggtcagcataacctatcctgaaactacgacgtggctcagaaactggaaactattgttgtcaataatgatgacaacacagagcatttacatcaggggtcccaaacccccgatactggtctgtagcctatcagaaacccatccaaggaggtgagcagcaagtgagtgagcaaagcttcatctgtatttacagctgctccccaacgcttgcattaacgcctgagcaccgcctcctgtcagatcagtggcagcattagattctcataggagcacaaactctattgtgaactgtgcatgcaagggatctaggttgaacactccttatgagaatctaatgcctgatgatctgtcactgtctcccatcacccccagatgggaccgtctagttgcaggaaaacaagctcagggctcccactaagtctacattatggtgagttgtatatttcattacatactataatgtaataataatagaaataggttgggcatgatgcccataatcccagcattttgggaggtccaggcgggtggatcacctgaggtcaggagttcaagaccagcctggtcaacatggtgaaacctcatctctactaaaaatacaaaaattagcgggtgtggtggtacacatctgtaatctcagctactcaggaagctgaggcaggagaattgcttgaacctgggaagcagaggttgcagtgagccaagactgtgccactgaactccagcctgggtgatggagtgagactctgtctcaaaaataataataacagaaataaagtacacaataaatataatgtgcttgaatcatccccaaaccatcccccacatcccccagtccatggaaaaatagtcttccatgaaactagtccctagtgccaaaaaggttggggactgctgttttacattgtgccagaggaagcaccatatctattctctgaattcttaagatagctataaaaatacatattactattcccattcaacagatcataaaactaaggcttagagaaaataagtaacttacaatctgacaactagtaagtagatatcagaacgtaaatacaagtgagtctgactccaaagtgtgtttaaaccactctgaaatacactcattccttctctctttctcttagagatgtcttgaaggtttgcttggatcaccagataaggtccactgttacatctggcctcattctttacagaaacacacaagtctggcctgagcactatttgtttctaacacggaggaaggcttcaaattcatttcctctgaggtaagagcaagagaaacacatttcgacatgagtaggaggaaaaacagcacgacagcaaaaatcttcaaccatgagggtataagatcatgtacaaggcagtaagtggagacagggcctcctccttcccaggagacttttaactgcaaaagcatcctgcatctttacaatgctttaaacaattctaacaacttctatggccaccctttgtaagacccctagcctgtgtcccagctctaacactagagtcccactattatgtgggtggcctaaaaaagatcctaccattacgtggcccacttcacttctctggggctcagtttttgtcgtcagaaaaataaaaacctatcaaatgcaaaatggaggcattgggcagtaacagaactagaagtgtatctcctgactcttcactcatccacagtaccacaaacagccagccctgatgtttgcaaggaaataaagatctctataatatcttccagcccaaaacacaatcattttagactttagcagctgggtccaaggatggagacttaacttcaagaatacagtcaaacccaactccccatgagtatgagatggggtgtggggaaaaacaagaagcaaccttaggccagagacagtggctcacacctgtaatcccagcactttgggagaccggggtgagcagattacctgatgtcaggagttcaagaccagcctggccaacatggtaaaaccccatctctactgcaaatacaaaaattagccggccatggtggcaagcacctgtaatcccagctgcttaggaggctgaggcacaagaatcacttgaacctgggaggcagaggttgcagtgagccaagatcacactcacacctgggtgacagtgagactctgtctcaaaaaaaaaaaaaaaaaaaaaaaagcatccttaaatacttacttacaacttacttatgagctggccccttaagcttccaatacacactatccacagcactcaaagcatggccaatcaatgttgtctgtatcgattgtcctactttatgttattccactgggctgaagcctgctagttttctagtttggtcagatggctgctttccccttgggagcctcacaaaaatgagactatccccagaggtaaagaaatgtccatttaaaagcccactggtatagctgggcatggtggctcacacttgtaatcccagtgctctagaaggccaaggtagggcatcacttgaggccaggaatttaagatcagcctgggcaatgttgcaagcaagaccctgtctctttaaaaaaaaaaaaaaaaattaaattagccaggcatggtggtgcacacccatggtcctagctacttgggaggctgaggtgggaggatcacttgagcccaggagttggaggttgcaatgagctatgatcacaccactatactccagcgtgggcaacagagtgagaccctcttaaaaagggccaggcacagtggctcacgcctgtaatcccagcactttggaaggccgaggccggcagatctcgaggccaggagtttgagaccagcctggccaatatggtgaaatcccatctctactaaaaatacaaaaattagccaggcgtggtggcaggcgcctgtagtcccagctactcggaaggctgaggcagaagaatcacttgaacctgggaggcagaggttgcagtgagccgagattgtgccactgcactccagcctgggcaacagagcaagatgctgtctcaaaaaaaaaaaaaaaaaaaaaaatccactggcgagtgaggcatggtggtacatgcatgtaatcccagctactcaggaggttgaggtggaaggattgcttgatcccaggagttcaagactagcctgggcaacatagcaagaccccatctcaaaaaaaaaaaaaaaagtccattggcattagctttcctcaccagaactttaggatgtatctcagattattcttccagtttctagatctctttcccatcacaagactgaagaagcaaactacttgcagagatggaagtagccagatgtggagatgagttcactgaccactttgatgtttttctgccagtgatgataagtggtaaccaaaagggatgatcaagaacttcctcagtcacaacatagcctatgagcagacctcagaaacatacccttccccatttctctgtagatgtgaaatgtgaaatgtgacaagggccaaacatcagactcttcccaaaggttccgatgtccagtctggggacacctgggccaacacagcagccccagctgtgaagatggaaggtccaagaggcaccagagaagcagatgataaatggaccacctcaaaatccaaagactggaagaaaattaaaacaataaagaataaacttggctgggtgtggtggttcacacttaataatcccagtactttgggagaccgaggcaggagaaatgcttgagcccagaagttcaagaccagcctgagcaacacagtgagactgtctctaccaaaaaaaaaaaaaattagccagatgtggtggcacatgcctgtagtaccagctactcaggaggctgaggcaggagaatcacttgaacccaggaggcagaggttgcagtgagccaagatcacgccattgcactccagcctgggcaacaagagcgaaactcagtctcaaaaaaaaaaaaaaaaaaaaaaaaaaaacaggaaaggaaacgaaaaagcttgtggtactagctgtttcttctggataaaaaactggccttgatgactacattaaagaaagaatatcagataagaccatgcattctcagtgagtgcagtaacagcccagaaggggtgaaaattgattcttgggggaaaaaaagttagatattacaatggtttgtggccatccaaagggccacaatacaaaaacagatacacagtacatctgtggtattaaaattccattgggggtagctgggcacgatggctcatgcctgtaatcccagcactttgggagactgaggtgggcagatcacttaaggccaggagttcaagaccagcctggccaacatggcaaaacacaaaaactactactaaataacacaaaaattagttgggcatggtggtgggcgcctataatcccagttactcaggaggctgaagcacaagaatcacttgaacccaggaggcagaggccacagtgagcagagatcacaccactgcactccagcctgggcgacagagtgagactccctctcaaaaaaacattccactggggagtagacaattaagggaaaaaaagtctcaaaatatgataatgaacaaaaggttgaaaaataattagatgaacccaaagggttgagtcttagatgaaccctaagggcacagtgttcattaacttgtataatggtcatgggtagggtaactaacttgtcctggtttgccccggactttcctgcttttggcactaaaagtcccacatacggatatccctctgtcctgggaaaactggcatggtggtccactcttctcaagagagagatcaatgaaggcattcccatttcacaaatgaggtgacaccaagaaacacagtggttgtcacggattcacagcactttagcagcattcctgaggcaaggctggctctttccatttgtctagtcctatgctcacaactctctgcccctgatttccactttggcagagaatgttactcatgaattgattatgccacttccttctcaataccaaagccaagggcagtattaggaggatgaaggcaaacatggccagccagcataatcacagccatgtcttacagctgcctggtggaacctgaaggaactacaagtctgggctgaatatagttttgttgctactggattctgggtacaaatttgcaaaagtaagaatgccaggtgtaaactcctcacaagctaggaaaattcctagcttgaggttctccacatgtgtctgagcagcccgaatcttttacaaggtttttgtcccaaagatgaactcagttattgcttatgctaggaatcaggggttacccaaggcctcactctgaatggcaacaggctattctcctactcccctactcagcagtgaaatccttggtgaaagtaaaggaagaaaagaaaagggcatgctattccgtctttagtctacgtataattaaaatacaagactctctgctgtagaagactaaggtttgcagtttaaggccgactcagaaaaggataaagtattcatccttgctcagaaagagagaagattagctccacaggatgggtctccaaattgacaccaaatccaggagttagagatggctgtgctacagagcgtgatccaagcaccatctggagcccccagaaaaaaatccctaggaatagcgactaagggactagcattgtaagagagttcagattagctctcctgaaaagaggcttactacaagagactggcagacagcctctgcagcaaaacttcacttaggaaaggacagaaaatgaatgaagaaagacagggggaggctgagcaggtcagagtatgaatccacaagtatgtgaaaaagagaatccacctatttcgaaaaaggtacaacttcctttcagagcctttttttttttttttgagacagaatctctcgctctatcacccaggctggagtgcaatggcacaatgatctcggctcattgcaacctccgcctcccgagttcaagtgattctcctgcctcagcctcccgagtagctgggattacaggcatgcgccaccacgcccggctaattttgcatttttagtagagacggggtttctccatgttggtcaggctggtcttgaactcccgacctcaggtgatccacccacctcagcctcccaaagtgctgggattacaggtgtgagccaccgcacccggccagagactctcatgttcttttgaatattctcattaacggcaaatcttcattctttgagggtgaaaacatttattgcattcctatgtcccaagagctttcatgtgtaatacgtcatttaaccacccttcaaagtaaatattattcccagttttttttgttttgttttgttttgttttgagacggagtctcgctctgtcgcccaggctggagtgaatggcgtgatctccgctcactgcaagctccgcttcccaggttcacgccattctcctgcctcagcctcctgagtagctgggactacaggcacccaccacctcgcccgggtaattttttgtatttttagtagagacggggtttcaccgtgttagccaggatggtctcgatctcctgacctcgtgatccgcccaccttggcctcccaaagtgctgggattacaggcgtgagccaccatgcccggccctattcccactgttatgtagtggtacattgagccccagaggtgaagtaacttatccaaggttatgtggctaataagtggtagactcagaattaaaactcatgttcaccaccctccaaaaatctgttatttccacttcaaaagaactgttaactcatctgaagacaaggcaggtgacaaggttgcttacccatgccattcggggttaaatatatataggctgtgtgcagtggctcacgcctgtaatctcaacattttaggaggccaagacagaagaatcgcttgaggccaggaattcaaaaacagcctgggcaacacagcgagaccctgtctctacaaaaattaaaattacaaaattagctgggcctggtggtgcgcccctgtagtcccaactactcaggaggctttagtgagagtattacttaagcccaggagttcaaggttgcagtgagctatgattatgccactgcactccggcctgaaccacagtgtgagaccccatctgaaaaataataataataataatacagtatggtttaatatattaaagaaactgatctctcgcatggttcaaaaaggtctctgaaaacaattccagaggtggattttcaaaactgccttggacaacagccaaatcacttaggcacgccatcctcaactcccaccacctacacctgcacacatcactctaaaggagaacattcattggtggatcaagttcccacatgtcagttattttaaaatccattttgttacctttcagtttcacttaattagcctcttctcctgccaatgaaacacaccagggctcacagttggcctcagtagagaagtaatagctggccttcagaaaacagcagggaaggggaagtaagtgggaatcaaagtactaggcaacttttcattcctggactgccgcatccctactaacatttccatcacctgtaaaatgggagcagaacgtctcttctattgccaatttcattaaaacagcacatgtattcatgagcagattaaattcactaaacaaatgaaagaaaggggaaataaatgtggtgtggtaacaccatcttaaaaacccgagagccatgttctcaaaaccacagaccaagttctgacccatgttatacaaatatcaatcccaatatcgttacactctggctcccatcaaaatcctacccaatccccaaatctggctatacttttatcagaaaagaaaaaaacttgggtggggtgagagcagaaaagacacacacacacaacaaaatatctttcacaatgtcaaaaaaaaacctgtttatatgccaggcgaggtggctcatgcctgtaatcccagcactttgggaggccgaggtagacagatcacctgaggtcaggagttcgagaccagcctgatcaacatggagaaaccctgtctctattaaaaatagaaaattagccgggcacgatggcgcatgcctgtaatccctgctaatcgggaaggtgaggcaggagaatcgcttgaacctgggaggcggaggttgctgtgagtcgagatggcaccattgcactccagcctgagaaacaagagcgaaactccgcctcaaaaaaaaaaaaaaaaaaaaaaaactgtttataaacacatcactttcttctcttagcaaatatgtaagtttcattctcctcctgtctacttagtttgggttaacttaacccccgccccatctctcagatcatgtttttatttaggtttattgaggtgggaaagccaactgaactttaaacgaagccaggcatttaagaatattagaaaactgatcttacatatataggtagtcaaatatttttaaaagacatcaaatggcattctaattcctccggtgcaaagaaagccccagcctcacacgtgttagcatttcctgattcctggcttttcccactcagagccccattccaggggctcatatgtcaagtcattctctcctgacttctgaagcagggattttcaaagccaggattccgggaccacctgaatgagaaccccctggggtacagctgcccacgcaccatcttatcggaaatcccagggaatggagcccaaggcttatgcacaaagcccctagacgatccgagagataacactaaccagtctgtaacctctaaaggcaaattttccaggacaaagaaaaacaagcaataagagagtgacaataattccacatgggaagagacacacgggtctcggagatcaacaccaaaccaccccttcttcggacagatacggaaacttaggctgggagaatgaaacaggcaagggcactaaaaacaggtgcggagccaaagccaatctcaaatttccacggccccatctcctgccaataaagaggtgaatggagacattctgagtgggaaagataagaaaggtaggccttcggcagggagccccgggcccacttggacgtcccgctttggagacactagtgaggatgtgtgggtccccagaacactgctgggaaggcgccgaggccgccggcaggaggaggcccaggaagcgccctgagccccccgcccagctccagggccgggcggccctcaccgcccctaccttcggcctccggcagccgagtggcagacacaactcccacaattccaggcggccgcggcggcgaccagctccccctgcgcaaacgcggcggcgaccgtctgagccggt

SEQ ID NO: 1517 - DNA, 251656 bp, Homo sapiens; identical to SEQ ID NO: 1516

SEQ ID NO: 1518 - DNA, 2147 bp, Homo sapiens
taacctgctcaggtccccttccatgctgtggaagctttgtttttttgcactttgcagtaaatcttgctgctgctcattctttgggtccacactgcctttatgagctgtaacactcaccgtgaaggtctgcagcatcactcctgaaacctgtgaaacaacgaaccccccggggagaaacgaacaactccagactcgccgcctgaagagctgtaactctcacttcgaaggtctgcagcttcgctcctgagtcagtgaaaccacgaacccaccggaaggaagaaactctgaacacatccaaacatcagaaggaacaaactccggacacgcagcctttaagaattgtaacactcaccgcgagggtccgtggcttcattcttgaagtcagtgagacgaagaacccaccaattccggtaggagtaggaaatcacatcaccttcttttaatcagtctcaaatacctggccccttgtggaacctgcaagagccaggtttggcgaatgcaatgataagcaattgtctaatcactgccttgaaaaagagcagagcatttgagtatgctgtctcctcctctccctcacttcagttgggcccaacatgacagtcttaatggaagctcgggggtcaaaggctggtggcttacttcacgtatattgcagcatttcagtactgctctgcacgtgtgctcccccgcctgatgaggtaagtgttaaacagggatgatcacagcttcaagtaagcaatgggaattggatgttttatgtcctctggcgccatcttcagcagagaaatatataggtcacttttacttgtctggttttggtcttgaaatatgtactgaaacttgtgaaggagcagacctatattaggatagagtaaaagagggaaagacaaaaacctcttgggcttttcaggagacttggttcattctctgcttttcaagccatctcatggccacatgcctgctttggaggctgactcggaggcacaaccggcctcagggcgttcctcagggaccctacctttcttgctccctgaagaaatgtgcacattgcttgaataaaaacaatcaaagaacactcagtcaagatcgtctgctgcagtcttcgttgagggctggggatgctaaaagtcagatgattcatgtgtaccctgtccatcctaactcacctgctcttctacttccgcagcttactccagtgcccacagatacgacagagtgtcccaagtgcccctcacactctattagctgcatccttaacctctttttgccacaccataagcattgggttttgtttgttttgagatggagtcttgctctgttgccaggctggagtgcaatggcgtgatctcagctcactgcaatatctgcgtccagggttcaagcgattcccctgcctcagcctcctgtattagctgggactacaggcgcacaccaccacgcgcagctaatttttttgtattttagtagagaaggtttcacgatgttggccaggatggtctcaatctcctgacctcgtgatctgctcgcctcggccttccaaagtgctgggattacaggcatgagccacggcgcctggccagcattggggtattttattgaagatggaagccatgaatgttgagaaagcctcagcagatgggaacttgccagaggtgatctctaacatcaaggagactctgaagatagtgtccaggacaccagttaacatcactatggcaggggactctggcaatgggatgtccaccttcatcagtgcccttcgaaacacaggacatgagggtaaggcctcacctcctactgagctggtaaaagctacccaaagatgtgcctcctatttctcttcccacttttcaaatgtggtgttgtgggacctgcctggcacagggtctgccaccacaaccctggagaactacctgatggaaatgcagttcaaccggtatgacttcatcatggttgcatctgcacaattcagcatgaatcatgtgatgcttgccaaaaccgctgaggacatgggaaagaagttctacattgtctggaccaagctagacatggacctcagcacaggtgccctcccagaagtgcagctactgcagatcagagaaaatgtcctggaaaatctccagaaggagcgggtatgtgaatactaa

SEQ ID NO: 1519 - DNA, 26183 bp, Homo sapiens
ttatgttcttcatggtaatctagaatttttatttgattccaggtaactttggacaatagacatgatgagatgttttctctttgaataagttaacagtttaattacattgaaataaaatatactgtgggcttaatacattgtaaatattacagaagaagtactactttgctatagtaatttaatgactgaagctacatttaataacaatcttaccagtacttgtatacaaagtattatacagattactaacgaagatattgcagtggttgcaacgatgttaccagctcaacaaacatctaacaatacaatattcttctaagaggaaaagtaataatgttagatttacagacaataaagagtcatgtttcccgcttgaaacattggaaataaatttgaatccagatacaagaaaaggtttcctttcttgggaactctgatccccagtaggcctagtacagtcaatttacatgaagatagcttttaagatgccacggcaatgtaaagaaactctcccatccgaaaattactgatttgtaggccactgctcaaacatctgactttttagaaacctatttacatacattcagcccaaatcagtagatagaatgtttttttctatattacaataggcattgttaacatttcatcagaaggccagtgcaagacaattaattgttaatagccattgcccagcatttaggagattttaaaatatcatacaaatatacagttagagtgtgagaaatctaattgtgtgcatgatatgggtggtctcttttatggacatgaaatggcagaaattaatcaacaggacagtaactatagcgctactcatccagggcctaattctcatctggtggttgggcctatttcctgcagagtggatttaggcagcaaaaggtccttggcatttaataccagatagacttaactcaaagtgccagagaggcttggaaatcatctcaagtgtaggacagatgtctacagcatctctcagattcatatcctttcacatatatttcatacaaaataaatcagaggttcctcttggaggcagccctacttgtgcaaatgaaacattctaggactgattcatcatgactctgataaaaaaaaaatgagcaggttgggaatttggccctttctgaacatgtgtgatggtaaaatgcatggtcagggcaagtacatcatcctcagaggaaagtaagatacctctgatgtcagaccttataaaacttacttaaatttaaatcatttaaattaatggatctaattatggggttaattaatgagtgatattaacaaatggtaattctaatgagtatattcattggggacaatgttttcgtcacttgggttaagaaatgatatgaaaagtgtcaaagtgaatctaactagttttaaacctttttaaatgaaggttgtataacatacgtgatgatatttcacagatatttcttagaatatcaataagcaccaagtttagtgctgtcagccccattgtcccttaatttattatatatgatttagatcttgaaagcacaacacactataaaatctacactgcatacgcacaaatgcagtttcaaaaatgaatcgtgaaatttttctaccataacaagaatttctctagctcttcatagctgtgaaaagagcattggtactgcctggtgagctctgaaacatgtggattaatgttcaagatgatgcaggacaaaagactggcaattcttaaatgcaaactaaaccctggtgagttcttcttgtaaataatctctcctgtctttagaaagagatcttactaatcctctagcaccctgagccttcatctgcacatgacagagaggtaaagtaagggagccagcaggcagattcaaggtgtgcagacagacaatgcaaagtatctcataagccacatcctgccttagagcgtgaaccgtaagaaggggaactgccccatcaggctgcttgggtatctcgagagctagaaatcaccagatagatgccagctctgtacttcacttcagactatgtaaaccttggggccttgtaggagtcatgttttatctgtataagaagagattataattaaaatttgtcagggttaagtagattcttcagcaatatcattccttactggaaaaaggcccaacaagcacccatggcgccattaaggagcatgagaccggggtgtaagaagaaagcagctgtgtttatcttcatgcttgagtgtatcttgctaaccacgagcaaaggagagatttgttccttagcccaaacctaccaagacagagctgggtgctcagctgtcaccaagggcatgtgggcaaagcacagatacagcatagctagacgtcaatgccaagtgtatcggttcttcactgccgttgtgtgtctcatccactgtctgattcagcttttttagccacatgggctgggtgtgatagtcctactttaacgtgatgtatatagtgcatactatctacacacgctattgaaaaatgttaccattgtttttctgtagaactgtcttccttttagtgactgacatattgctcaatattcggtgctcagaaaccaaagtactctcctttcctggcaataacactacaaatacatcccttccttggatgcctgtcattattttttgctaagcactggtcttgtgtaatacctaaaggtcaatttagtaatacttgatccaatctcttaaggagggatggggtgaaatttttgaatggttggagtcagtatttttatcaacaagattacaggaagaactcaattttagaaactgaatccatgtgcaagagtgcagcaagtggtaaaagtttatacttggtcacagttttctcactttatgacattactgtaacagttacaggacagaaacacacatacacacatttatattcacactcacacacagtataattttactgatccagacactacttcttttcaattaaaaaaaatgaagactgttgtttggccacccaggcatgaaatctacttaaacctggaatataggaacacaatactattcaagtaaacagcaactgcacagtgataacgatatacattaagattaacacatgctgtcttaagagatccagtaatagctaaagactaaagaaagtcagagatgtcgctcaaaaaaagtcaatatgctttctctcttccattctgattataatccattagaacagctatagtccagaagataatgtgtcttcctatgaaaatgcagggctaataaatttttaagtatgaatgaattctgctcaatattttgaagtcttcaaattcttcttgttgaggtaacagaaaaataaacctttacggttatttcagtgtcaaaattaaatagagatatttgaagaaatattaaggtttatttctaaagttatatcatgggcaataatatagaaaaaaagtgcacacattgacacgtatccactgcttgtccattgttctcataaaagtctacctttcagttttgctgaactaaacaaatattaatagcacataaacactgatacacatctcacaggacataatacattttacaaaatatctctagtactataacttgtaaaaatggacatctctgatactacggacagttacatttcacattatagtgaaagttgtggttacaaaggcattattcatttgatggcatttttccatgggttcttagacttccaattgtgtagccaaaggtttccctcctatttcattgagactttgaaggatcgttcagtcacttaaacaacaggctttcttcactgtaaacccctggagaatggagtttgagtacctaaactatggaaacattagcaaactgataagtgatcatggtgacaatcaccttttcattgagcatggtaaagttaaaaaaatataaccaaggagacaatagactcttctagattttgagcttaaaaaaaaaaattcttttcctgtgctgccagggaggcatcaggctcacagagcctcggcagacgtgtctgtggacacagacatggttaccttggcaatcttgaccgtgctcttgatgcagctttctgcggccctgtgaacactggctgcattgtttgcgtgtttgtgcaggcagtccgagtcccccatgctgttatccagaggctgcgcagtgccttcacaagagggaaacatgctccggaaagcgtgtcgcaggtccttactcctcagagcatagatgatggggttcacggtggagttcagcaggcagagcatactgcagaatgcaaacaccgtcttaatgagcttgttcatcttcccaaagacatcatacaccatgattgcaagcagagggccccagcagatgatcaacaccaccaggatcaggaccagggtcttggctaacctaatgtccatgcgggcttggtctggccgggtcacctgtaccttcccatcctcagacgtgtggatgatgatgctcttctgggtgccacgctgaatcatgcggacggcgtggctgtgagccttccagagaatatacatgtacgcatacacgatgaacagaagcagtacgctggtgaccccgatccagaacatcaggtaggtttcatcaatgtgtgggaaaatgtctgagcaaacagattgcagtttctcgcagttccagcccaggagaggcagcacggcgatcacaatggctatggtccacatcaggcaaaacgccaccacggccttgggcctggtgacaatcctcttataggccaggggcctgtgaatggatatgtacctgtcgatggctgtgaggaacaggctgcccacggaggcagtgaaggaggccgtgaccccacccagtttgaacagaaacacgttgcggctatctttgcggtggaacacgtggaagtcaatgaagctgtagacaaaaatgacactccccaggaggtctgccaccgccaggctgccgatgaagtggtaggaaggcctgcagcggaggctgcgggagtggaggatgacgcacagcaccaggaggttctccaggaccgtgaaggtgcccagcgtgagggacaggactgcaatggccagctgctggctggggttcaggaccatgaaacactctatgtccatgaagttctccccacactggatgttctcctcattctccttgaaggacgagagagacttgttgtaaaattctgtaatgttcacctggtctgctgggactagctgggggttgtctcccgcagtcatcttctcttggaagggacttcccctaaaggaagttaaagggaatttctgtgggaagtaccctaatttggatgccatgtcacctttgatgtcttcgtactgaatgtcatttgagcccacgtacaggaggtcagtggtgatggtgcggaaggtggtatctgcaaggccatctaggatcgacttcataacctcagtctttgattaggctgagctcaaaatgactgagaaagtgacccacagggggcaatcctaagaggagggaaaacaaataagccgaatggtgagaaacaggaagaataaaaacaaagagacactgtaaatgtggcaaatgtactgtcatggcaactcattcctgtctctgaacagtaggaggtcaagttctcatcagattcagtcaacaaaatgagtaagtcactcagagaaaagctccccaaagttcagggatggcgtggcacatgccagaaatgtatcaccttttcattatttaaaccctctgtattgaagtcagtgtgtgaatccaggaaggacctccagggccaagaagactgaactaaatgaaatgtttcttggggacaatgtccatttcatagtcacgttaggaagtgtttagcacctggcttctcctgtcacacacacatggtatcccagtgctggttggggccggcgagagcactgatgtgtcacatgacccctactcttggagacttcaccttgtcagacaaatgagactaaatgtaaaagacaaccaaagaataagacagtgtagaatcaagtgatgagttgtgtggtctgtatgttacttgtagcgggggaggagggagctagtgagaactgaggaagcttgaggccatgtggggagagatgctcctcaagacaagtttcttcacccagagaaggggaggtctggacggagccatggctgacatgacttctaggatgtccacatcaaccaagaaaaatgtcacaaagaccaaacttgcaatgaggcgtataggaagacagagttttttttttctttctttctttctttctttttgatacagagtcttgctctgccaccaggctggagtgcagtggcacgatctgggctcactgcagcctccacctccccagttcaagtgattctcctgcctcagcctcttgagtagctgggactacaggtgcgcaccaccatgcccggctaatttttgtatttttagtagagacagggtttcaccatattggtcgggctggtctcaaactcttgacctcaggtgatccacctgcctcggcctcccaaagtgctgggattacaggtgtgagccactgtgcccggccaagactgagctttttcacagcagggatatggaggaggcctcctgatagtccccttcatgagcaggttggtgacacaagtgtgcctggtgacaggagacaggctggagagtgtccaaggatttccatgtgaacagctaagaggaaaggcccaaactttaaggttcttcgattctaagctaagcaatttggttttgtttcaaaataaacagccagagaactgatcttactatttataaatttttgtttaaaatgtgggctattcatttctttagtttatttttaaaaattagaagtatagagtgatatctataacaattaaaataagaattaaaacaatatattacttgttaattggcatttgttgttcctgaaacatatcacactgtatggggttgggggagagacaatcactatttcagaacaaattttaaaaatgttgaactaacaataaatgagttattaattcagagaccctaatatctgaattaataattcatttattcatgtattaacaaattatggagcatccactatgcacttgtattatgtctagctacggtactagacactagtgttgacagcatcaagaaagagtccctgcccttggccgggcacagtagttcatgcctgtaatcccagcactttgggaggctgaggtgggcatatcacgaagtcaagagactgagaccatcctggccaacatggtgaaaccccgtctctactaaaaataaaaagaaatttaaaaaaattttaaaaaaattagctgggcatggtggcacgcctgtaatccctgctactcaggaggctgaggcaggagaatcgcttgaacccgggaggcggaggttgcagtgaggcgagattatgccactgcactccagtctggcaacagagcaacattctgtgaaaaaaagagtccttgcccgcatgaaggatatgatctagcagaggaggcagacagctgactcagaaattaaaagaaagcatggggagagctacaattggggacgtacaggatgctctggggacacccagtctagagggctgaaggaggtttccccaaggaaaagatatttatgctaagaataggtagcatcactgtaggtggggacaggacacagagtcaatgaaaataattttatttaataccctagtgtcatgattcttaagaaaagtaatttggaacaggcataaagtgttaaatgtggcccaccttcccacattctgccacctccacttccaggatctcatcactgctcaccagggttagggcgcctgctttctgaccagttttcctgctcttctctggtcctgttcctttttgatcacttgccacacagctgtgggggtaatcttcataaacgtatgctgattatgtgactcccctctttcaatctctttgccctaaaaaccaaatataaactttcacgcagtttccttttcaggcccaggccctccagacatgtatgcaactctcgtctgccttctatgtttccatccagctgagctcctttccaattctgaccctcaggctcttgtccttaatactctccacaacctgtctccctaaacaggatggctttctatctcccacctgcaggatgaagtccagtaaaaagtttcctgtgatctagctcccgcccacctctccaatcttcttcttgccagccctggccttgccacttgggctacaccagatgaattttagttccataaacacagcaaattgactgctcctcacctcagtgctgttgctcccattgccccttacactcccgcctggtcaactcctccccatcactttgatgtcacttcttgccatagctccctgcttcccatggcgatgaacaccctttctgggctcccagaatacccaaacagagttctatcatggtactgaccagattttctaatacttctttgtgtttgcatctgttccactacttcctcccacccactagacagtaagttcactgaagatcttactggggactttatcttagtatctactcagcatttagtagaatgcctaacacacagaagaaggctccaaataagctggttgattggatatacgtatttcaaaatagaacaaaaacaagaagctcttttctacccaaagaaggggaaggattctcccaatgctgattaaaaaaaaaaaatgatcatgtaacttgaatcaagggatctagcctggagagctgcccaatccaattgtgctagaaatatgctctatttaggtaaggttattagcattttaaatgaagctgcctatataattatctagtctaaactctcatggaatgagctatatgcaataagcaactttggctacagagaggcaaacaagaatattggcaatgccataccaaatggtgaacagagaaagagccctcagcactaatgtgacaggtaagccagaaggctcccttagctcctccatggttgtgtaacccttttacaagatcactgtagcctgtgatggcagtaggaggcactgccaaactgagggccccgaatctcccatgggtaacttctatcatcactaagaaaattgagggttttttttagtctgggcttctgaaccagttctgcacacctttcctgcaactgtcatagaataaagcagatgggagccatcacctactggaccagaggcaggagctctaaggtacaagccacacagaggcacccagtgtgctggtacagtctgctaacgccaatcaagtcaaggcagtgtctcaggggcaaaggctagtggctatagaaataaaggatgcagaaataaaagaccaaagaccaacagccaagccagttgcccagtgcttctgggctcctttatctaaaatatctcctgagttcctaccctcagcctggctccaatgttaactctcgagtatccttagtatccttaggttccctgttcatctgtctgtctgtcatatcttttctcatatcctcacctcttctagaacatgctctatatgtcccacattcggctatttctcaggagtcaactcttgctccttgcaaacttatgtttgcttaacaactccatttacatatggaaagttttcatccataatcaaagggacacagaagacagccacaatgtgtgagagctgttccttacatggtccttgcacatccacaaacctaacttttgcctttcgactcccactcatacttaaacaccaggcttactggccctgagtgacttgctgctctttgaatacaccgtcatacctgcacaccttcctccttcaccttgtcccttcttttatctggatagaagctctctgcctactaaacttatctttccaggtctgtgccaatgctacttccatgtctgagaccttcctgaccagcccctcccactaggtataactagttccccagcacatccctctattacaggcctcatcacgtcgtataatcaggagttcacatatttatttccataactagaatgagatctccaaacacagaggcatctttttttcttaagtggtttaccagcctgatagcatgatagcaggagagcagacagctgagttcccacagaaatgttcacctgaacctaataaaatggcagttgaatttttattaggtggtaccttaaaacagtgatttgcatttgcctttttcttaaaattagaggacagaaaaaataatttatgcaatagacatttagcctgaaaaccagagtttgagcctccatctccaagtagctcctgtgagccattccagtcatcttcccattccttatgccatcttccctcaattaactaactccccctttacactttccaactggaaactagtttatcagaaattttgattatctttatgtattagattcacaagatttaagattcaaaaggtacagaaagacatacagagaaaagtcaatctctctcatccctatatcccagccacctagttttttttctcaaaggcaaggagtaagtttcttgttaccccttccagagatactccatgcatattcaaacaaatatatgtatttaccccctctttgttttctttttagcaaacagtaattaacattattatacatacctttcttttcttcttagaagtacacattgtgaacagttccatattcgtatataaaacctctctcttcattcagctgccttaaggatctgttagatgaatgtgaccagcctcctactgatggaggtttaggttatcatcttttgctattagaaatgatgctgcaataaattgaatccaaccacaggtcactcagcaagtcactcaggaccagtaagcctggtgtttaagtatgggtgggagttgaaaggcaaaagctaggtttgtggatgtgccaggaccatgtaaggaacagctctctcatatattgtgactgtcttctgtgtccctttgattatggatgaaaactttcatatgtaaatggagttgtttagcaaacataagtttgcaaggagcaagagttgactcctgagaactttttcacatttcttatggcattgtgagtagtctttctagtcacctaagttcctaacttggacttactatgacacctcctctttcttgacctctacaatcaggtagaccactaagtcttgctgattttcctcttttaagcatatagagagagcttcttatggactggtgacactgagcctattacatatatatcaattcctttatttcacaatggccctatgaagtaggtgctattatccccattttcagaagaaaggcacagagggtaagtaagttgctataggcaaagctagtaagtagtagagcaagcactgcacccagatgagagccacatttcaagtccttaatagctccatgtggttagtagctactatactggacagtgcaggtctagggcccttacttgtagctttttttgatacaccatctctctaagctaagacagggatattaccatcttccttgttttcttcactgattccaaccagtcaaagcacctagtcaatggaattaggagttagcagaccaagattggtgttagatggtacttgggcaatcagtctttctaagcctcagtatttcatctgtaaaatggggatgaggatgatgacaataatgcctaaatcgcagaactgatctgaaattagatgaaattaaatgcatgtaaaacatagtgcctgacacaaaagtaagtcttcaatgggtattattattatcattacttagtattatggctctttgctatatactatatactaattatattgtaagaatatattataataatataatacatactaattatatctcaagaatgctcattgccttaattattcaatcttatttttgcctcagcacttaaaacatgaagcaaatagtagatatatatagacatgggtaagggatggggaacctttattgaatgtctgttatatccagccatttgagaaactttacatatattctatcattaaattgtcaaggcaaccctatcaggtgcttatttataatccccatttcacagatgaggaaatggaggccatcagatgttaagtaaattgcctagaatatgatggatttgcagatgaatcgaagtttctcagactccacagtctgttttgagattttatgtgacgatttcagaattaacagtaactaggttaaagccattttgcatcttatatttaagtcttctggattcttagaaatgtgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaaatgtaaattaaggcattttgccaatagtaattaagactacctgctactaaatccctatttcctatcaaagctcatctaggtaagtctacctacttgcatggacctaaagattaaaatttagtcactacttggaagagctataaagcttcttcagtgaagacaaaggatcacatatcttattccagtaatgcaaaaaacatgtttctgtgacttactttagattaagatcaccgcaagtgtgatcacaacttcccattttaatgcaaccaagcactttcattaaaacaaactagcttgttaaaatctaagctagggcatgggtgtggttatatgataacagagtaatttctgtccaatataagccaattgaattaaagaatacagttaataatatatggattttatgtagttcaaagatctcagtaatgtcgaaatactactgtgcacaggctattttaacagttaatgggatcatggcaggaaaactgctctctgcattttgataattctttcctttatttctacatttggattattacagtaatttccaccttattattttttgcatcaacaacttcctttgagagttcattactaatacggcttaggctttgggggatgtagctgccattaattttgtttttgtttgctactaggaaaatcataattggaaatttctagcaagatgtatagatgcacctattaaagaagcagttggtttttattacagttatagtaaaagaatgattgaatgacatataagggaattttcctagaattctgctttaaaaaatatagccaacatattctaacagtgtaagctatataaatcatgacttcatagtaaagataaaaatatcttaatgtattaaatccattatttttaaaaaatcactccaatttttagactatcatctattctttttgtctatttctctgtatgcaaacctgcctctccactacctccttccaagaaaaccatatctatcagctagcaagctatggtatcatcaaaggaattttgtgagtatggctgctgcataaagttgttgttttttttaatgtttatccagagtctttatttttattcgtataaccacaaagggtttaaaatgtccatgtgttctaggctgaaaacactgtagaagtattggaaggactggtgctccctgatatattatagactgctttaacccatcatactccttctctgatattctaagtttctaagtgctttaaagagacagtgcctggcacagtgtctacattgacaggagtccaggatgtcaaatgcagaagttccagtcccttgcttaacttgttgtttttcctactttgttggttctgttgttcacttggctggcctcataaaagaaccttgtgaagagttcaagagaatgcagcttccagtggatatatttgttggttattttccattcatttctgggaacaagtctgttttctactaatttgatcaagaaaatactgtgctaatgtatttctctaaagttagtagggaaaattttagtcgactcttataactgcattatgtctaagtcatgctgtcaatatacacggcagatgccataggccaacatcataacttgatgaatgatgtttccactccagttgaatgggcaatgagtcttttctaactcttacctaatcattagagttttggaattattaaagaagcttggtcacttttccctcatcttctacagcaaagtgaaataactgattgacttaattatcctgataattcaggcaaaaatacataatcttttttccttatattaatgtcagctccttttcctacatatgaaagaaaattccattatattggtaacactcaattggctctcataccttcagtttttcatatattttgtaacataaaatagaagttatttaatgcaccattttctctagtctattctttactaacactatatgtgttatgtttttcataaaaatatatcaattgatatgaacttaggacattgacttatacgagtgtagtagactgtacttctgttcaaatttaatgtgaaatatgccaaagatttcacatttagagactagttaaaacaatttcagggctcaagaaaatgatgtcttgcaacttcattgggttaggaactacgtggtgatgatgctaagaaacaaagcctcttgaattaatgatacaaataaaatcatttgttgatctgtataacaaattccatttactatttaattttgctcttctgtttagctgtttcctccaattaagagtgccttggcacttttcttgagagagagatctttctacatactgggtaaagaaagcaattttttttatttttttattttttgagatggagtctcgctgtgtcacccaggctggagtgcagtggtgtgatctcagatcactgcaacctccacctcccgaattcaagtgattctcctgcctcagcctccgaagaagcttggattacaggtgcatgccaccacgcctagttaatttatatatttttagtagagacagtgtttcacaatatttgctgggccggccttgaacacctgacctcaagtgatccgcccacctcggcctcccacaagtgctgggattacaggcttgagccactgtgcccgcccagaaagcaattattaaagcagccttccactaacagagaacatacaaagttttcaattaagtaaaagccatggccatattcaaaatactctataaaattatctttatcttgcatatgagatttggtcattaaaagtggaaggtgatatattattctggtccacaaaatgtgtagaaactagtaaacaggctcttacttttgcagttcattatcaaggagtccatagcaacagtgaaaagtatgctatatgatatccaattgcacagcacacctttcacagtttcttctctcttcatctatcagtgaaggcatattttctctttgagtccataatcatgcaaattaactccaactaaaagccaagtcttatttctccagattcaaatctgagagaatttgggtaaatgcacaatagagaaaatcctaatttccaaatattttcatttaagaaacatttaaacttttattatatgccagtcatggaaaaaatatattatttttccttaatatttacatgaagtgggtgctattacaatctctattccacacactcagagagaaaaatcctttacccaaggtctctaactagacagggcagagctggaaatttgatccaggtctgcataattcaaagcccctgctctcaacacagagttccaagaaccatttaataagacaccctttcattcatttacagggaagaagagttggtttgggagaaggtacacgttatctaatgtgtacatgataattttatacagtaaacaactaaaatctgaaggaatgatctgttgaccaaagcacttgcaagtcatccttgctccacggtcttcagcaacaaagtatgccaattaactataaggtataaatcctaactctgcattagtaccttgtttgcagtcactggtgctaatggcagtaactggcaaataaaacctaagtcatttttgccactattttgtaagtaagggaaggtgtttttttgcttcattagtcaattgtcaggaatatagatggtaatgacactttccacaacaccagtgagacacgaatagggcaccttctttaggtctgaatgagacatgtttattagtaaatgaaagcttcaaacatccattccctacatggagaaattcaaacactcaaaatcacccaacttcccaccatgagccatgaggttttcttagaccagggagaagaagactttctgtggcccattcctaagttcctggctggaatcaaggtagacaaattatataaacgttgtaccatttgttgttccaacaaatgagtgaccgttaccatctcctggtgcccaatggatgtaaaactgcattactacagcaatgtggctaatagatataaagttacaggccttcaaatgcttgatttaacacatttttattgggcatacagtctgtgcctaggattgtggacattatattccaagatgtaacatttttctgtgatagatgacccccaaaatatatccatgcttcacacccatgtaagggacatgggtcaggtcaagaaagcaagggaaatggttctcccctccacccctccacctcgaatacagcccacccttctgtcttccttttcctagttgaaagagtagaataggttataaaaacatataaagggaatatatttaatcatcagatagtactgggctgtgtgaattctctttctctacatgctttgagattttctcccaggagaggtgatgggcattgctgagccatcctgtagttgtctttattgtgtctaaacccttcagaccatgaacaccttgagagctgggaactatcttataggtcctctgcctggcacagtgcctggcacagagtaggtattcaatacctgtttactaagtaaatgttggtatgcatcagcaacatggaagatccaacgtaacagaacagcttttaaccatggacagttttttctggcataaagccagctgatcatgagggcattaaacctgaatcttggtctcatacaaacaaccatctgaaaaagtgtccaaatgggaaaattatattgaatccatcaattatttaccccaggatgtcttatttcagtatcacatagaaattatattgatggcaagtggaagttatgggcacagatcaggtatttactttttattccaatccttgttcagcctgagtacatattatgaactgcaaagttcagccacttagcaatgacgtatcaagagtcttttgtgacatgcacaaccttgaatgaatcttaattatatgctgttgatagacctttaaagacaatatatgaaattactattataatggactttttttcttcccctaaatgcacattattgtgcattgatgtttcccaaatgggtttctccacttgcgagcgtgtttccaaaacttctcaagagaagtcacgtgaaaattcaaccactagatggagtggcttttataagccctcaggaatcaatttgttattctatttggtggacatagttctcgctttggttgagcaacttctcctcctgctacaacattttatgtattttacaactgaattaattaaaatacaaataggaaaatatgttatggagagttaaaatgggttattactactgcctatgaaaactaaatttctaattacttttctgaggcaaaagggcattgagaaaatttaatatattgataaaaattaattttgaatatcaggaattctgcctcaagaaagtaattaagaatgagaaaaggaaaggagttctacttaaaacaaatatgtttaaaccaagagatgttaaaagtaagaggggtggtctcaggaacccacaatcaatattaataaccaactcattctattttgtaaaacattcagctttccaatttccaaatatgcaataatcactactggtcctaactctgtgatgaaaaagaacagaaaattaatctctattattgtagggactaaaatggaatatttaacaagagaaatgaatcttgcttcaaatattcatacaaattgaggacacagtgactttctaaataattcaatttccttcctatcattctctcactaaaataattttaaataagtttttattattgcgtaaatccggggtttccttcagacattattttaagaactaggtacttatgtatcacctactttagtcgaaatgtttaggaaattttcagtgtgtgctaacaatgcaagacataaacagaaaaatatgctttcaagatgtaaataattacatacaaacagaactggaagaacgaggtttcagtagcaatgcaaaatatgctctggaaatgtagttgtgattaagaagtatgtatgcaaattggatgcaagtgcagaatttttatgccattgaaaccatgaggctgttctattgtattcattccggatcgagcccttcttagcgtttgtgtgatacaattaagaattaagagattccaggaactgaaaagtgttcagaaaaagtgatgtgaacatattgaattagtaaataagacaggtaccaacgggctgaaaattataatatacatctgaaagaccagtctgagaagttacacaatggtttgtaagtgcatgcagggttagtctataggtcattggctctcaaagggtggtctcccaaccagaagcatcagcagcatctgggaacttacgaaaaacacaaattctcaggatccagatcagatctatggaaacaaaaactctagggttggggtgcatctccattcttagcaaggcctttaggaggctctagcacattctgacgtttaagaaccactgtgaaagattatggagacatatgaaaaggactaaatgagaaggggaagtagatttaacctttaagaagaactaaggttagataagaagaaagaatattctgtaagtataggtttttagatcattgaaacagattgctacaggagccagctcaagataaaataacctcccacagaagatctttataactgaggtattcctatttggaatagaataatgtcatttagccagaaaataagaataaagagtggagaacctctccagtttttttagtctacaatccagggcttctctggactttttcaggaaacttttttatggattttgtccagcaaaggaaagtggcttcaaaatgtaatgtgtactgatataatacacagatatatattaagaactccacaccattttctcctaattctatttacaaaggctatgcaaagctttatagggttgctaagacatttccttcaccactactgtgaaggaacccatgattattgagcataacaagaaaaaagtaaaagtaattaacatgtcagcttatttctttcaagctggaaatacttgtttctgttcttcttttcctccaaaccataaaatactacatcttaagagatgaacccaggaaagaacgaactaaaatgaaaattttgctgtaggcccaagtaatatggatctactgcaaattattttacagaattactctggtaattatgcaatttacacttttcatagtggacctatttcaaaaatacctaaaagttacaaatatttagaaatatatcccaaggcacttaaatatatgactctgggcaaactgttctctctcttaattatttcgtcaataaaaatggatcacagattactcacaattagttactttagctgaggactaaaataattcaaagatttctccttttttgtttataagacattagatctcatttccaaaagtagctgtgtatcttccaaagtcaaattcccacatacgcagagacacaaaattctttggccaatcttgcacttgtttcagttatatgttaaattgtctagctttcgtttttcacatgcatactgcctgctcacaacttgtacaaaagctaaagaaaacatttagcaaattctggtagcaatgcatttcaatgagctgaaaattggatccatttagccaaacgccatggaataaaccaaaatactcagatcatagtggcattaagtccctcatataaagaataaataaatttgattaatttttaaatatagctgagttaaaagcaaacacaagtgacaaaggtctagtacctaaatgatctttttttttttaaagatcaaccattatattggttaacttgctatattaaaaacatcatttttaggccaggcacggtagcacacgcctgtaatcccagcactttgggaggctgaggcaggcggatcacttgagatcaggagttcaagaccagcgtggccaacatggtgaaaccccgtctgcacgaaaaatacaaaaattagccgggcatggtagcatgagaatcgcttgaacccaggaagcggaggctgcagtgagccgagattgtgccattgcactccagcctgggtcaacagtgagactctatttcaaaataaattaattaaaaataaataaataaaaacatcatttttagctttttgacccgaagaaatcaatgttatgaattacctagtacaaacgtccatataagtagaaatttatttaaaacaaacttaaaaaattttttttcttttctttttttttttttttttgaggcagagtctcactctgtcacccaggctggagtgctgtggagtgatcttggctcactgcaacctctgtcccctgggtgcaagcaattctcccacttcaacctcccgagtagctgggattacaggcacatgccaccatgcccggctaatttttgtgtttttagtagagaaggggtttcaccacgttggccaggctggcctcgaactcctgacctcaagtgatccacctgccttggcctcccaaagtgctgggattgcaggcgtgagctaccgcgcctggactagaatttgttttttcaaaagcatattagaatttatcgctagcttgaatgtaatactccttaaaacttcactcaattttcaggactcatattgattccaattttcttctctaaagttatgatctaaaagaatgaataaagaaatggtgaaggaaagagggggaccctctcatttaaacataaattttgaaaaacataatttcctaattaattaagaatccaaataagagtggaaaaataagacattaagtagtaaaatattgtattttagggcaaatttatttgccttttgtgttgagagaaaaggcaaactaaattcttgcattcaaaaaaatgcaaaatgtacttttgaaaacattcaaaaatatagaatattatgcaatagcacaatgggttaaaaaagaatttgctcaaaaataatgatttccatctaaccagtctctacatattcaaaaacaaaagaaaacaaagcaaagaaagcaaaactttgaaagctttcttaaagtgcaggtgtgaacatttctccagctggggctcaaatacaattcatagtattcccagaacaactgcaatgactctgccatgcccatttgctcgggttttgggagtaaacaattcttccctcaaaaacccatacaaactatgaacctcgagaattccatggtgattaagttattagcttaacctgtccaagtgaaacttaaattagaggctgtccattattaattcatctatatggaaaatacttcaaatatatggaaaatatcaatggaaactagatcaagaatatatacatgcaactaactgtcctctaaactattataaaaaatatactttttttcattatggggccttgttaaatcaagaaatataatccaggaaagcttttagtaaatactttgataagaactaaagataactacactactttatgtcatgactttgacctcttattagcaatatgtattaaacatgccatgtgagcaagtttgagatggaagttgcttgctctcacatcaaacaatttcaaaagcagcaagagaggtgacagcgtctactaaaaatcacccaccttacaaacctgcccccctaacaaatttcctatagttttaactcacttgtggtaacgttgtaatgtgttatatataaaaactataactatcttaatatgcattctgagatatggtaataaccttctgtattttcctccaacttgtacagccctaatttccaaaaaataataaacaactaaaaggattggctaaaaagaaactgtcttaaacccatcagtgtttatgataaaattataatcaaatgtggtgatgttcaccctggcatacttgcaagattcttagaacgcatgggactggcacggatttccacctatcctggaaaacaagaatggcctcgtttccattcaaggtggatatctgctttaactcttcagtgtccatctgcacagctgctttgaatgcggacatttccccaaatttgtagtatttatttaaaatcagaattacatgttcaaatgtataaaggcaacatatttaaatttttatttcagtcatgatttacatctataaaaatgtttatacatgtaaataaaagtgtgtttctatgtccaggtgtccaaaattacgcaatatatactttgatattatacatatattctgggtgaagttactgtttcttttaatccaggaaacattttggagaaatctgaatttataaagtcaatccaatctaatctaagaatatacagagaattaaatgcttatcaaagtattaactagcaattcagtggcaaaaagttgaatcccccaagtccccaaaagcagcattcatgcagccataatataaagttaccatttctctgaggataagattaggaaagaactggagattcagggaagaaaacatgaagttaaaattttggcaacacaaagtatataaactgattttgatttcctcttattctttgacttctctaccagtcttcagtatataagagaaaaatcagcaaagcaggctgcctctcaaaatacagatatgcagtatgtaaacctggccctagcacagtgtttcaaacaatgttgggtccacattgttttagagccaacagcagaattataaataatttaaacccaaagcctggtttcactctaactatttgtcagttcaattagaaaatgataaatacaaaaatagaagaaacagacttacactggtggaggcatggcatccttttcagcagggaatgaaagctctcatctatgttctttatgcaactgagctaacatggaatttggtaagtaagatggagcctgtcctttaggttactgcctgttatcatgctttaattgctttaattagcatttaattcactgtatattcttagattagactggattaactttataacatagatcaattcagacttctccaaaatatttcctggaataaaagaagcaataactttcacccagaattcttataaattcaagaagctataaccaaatctttcattttgctagttatgtgtcattaggtattttccaattcaatttgttactcttgtttttgcagcattcctggatagctagttatgggaaataatcccttatttggccaactgttttctggtaagaaacatttggtaagcgtggtgaactataaactgctattagaagttccatctcataatagtttattcttacatagcaaagtatttgatttctaattccaaacactaatatgcaagacaaccaagaagcctgtctaaatttccccgtggttaatgttaattttgagtcaaagcaaagaacagtgttatacgactgttttgaaacagtttctcaggctttgccttagtaattaataagctgacactgcatactaaacacttatcaacacaatcaatggggctgcttccttcttgggaaaataggtaaaccgaatcaaagagttttcttttggaagaggctgaaatatgccacaaatacagtggttctttttgagaatttcattcccagcagtttcatcttggtaacatttaacaatttcactattttaccattttgaaatgccaaaaagaacacactgatcctgcagctaggcttattagagaagagcaatctcacaggcaagacagagaggaacatggtccactgggaaatgggtaacagaaaaagacagaaaacagtggataacaaacaaagccaagcactacttcaatgtgagacctggtgttcatcagaatttaaaactttacacactaaataataatcacttatggcttatttaaggttctagtcataacattctttttacatacatatattaatgttattaaaattcaggggcatgaatatctaatttgctttcctaacaacgagtatgcaagcacagtaattttatttgtgaaaggccagaattgggtatttccaccttgtggcatcattgtacccccatggacactgagaaacacaatgagacctctccccatcagacacttgatacatacctcagccaagagcgctcctcgcctggagtgggagacatctttgaaacaaaaagagtcggtttacagtaagttctcctgataagctaaaatggattagttttttaaaaccatgtcccacatcaagtctcttgccccactatggtaactgccattgtgcctacaaataagtgcctgtagtatgcaatgtttaaaattctggaggtgcatgtcttctgctcatgtatggatataatctgaaagtaatttgtctcacttaagaaactataaatggccttttatttttataaaattgctcttaactgagttagagagcgggggagggggaggagtaccagggaaaaaaaggacagagaaaaatcaattagtgtatcttcccttgcaaactgtcagtagggtaggattagaaaagcaacactttaaatcacataaagtcctatgggaaccttaaaggttggttgctctgagcttctcaatattctgcaaaatagattgatgtcagtggtgaccccactaatactcagtgtccgctaagcttcctctaagaaattgcatttcccccattgttcaaaagatattaacttggtaataaaaatgaggagaagttatgggacccacagagatatctttcaacacctttaaaaccagtaaatctgttctaatctcttattggattacatgcccgaggaggcttactatatcaggaaatcaacaacaaaggcaagaatagcacttatttggaggaaaataaaaaaagatgggaggcaaaatgattaatacgttactaaacatttcttttgtttttttatctgttcaattttaaatatctgagagacaatctattaaaatcagaaacatgcatgttgcttttaaacttccaaatgaccaaatgacagtttctcatgtctattacagcaaacatatttttatttgagaggtgatccgtttatgatttgtaagccttaacaagaaatgtcttttaaaaatgcaacattaactttagtcatctaacagctagttctgagttaaacggttccatcaacattcaattttaggtattagttacatggacatttgtttttcctcaaagagaagtggttcctgtagctttttatcaaaagtttattatttgacatacatctctttatatgacatttactattttacattagtcagtttctaggcttgcagcagagatcgatgtatttccctgggaagacttagctgctaacatggtttataggcattcagcaccaactcaagcgcccgtttttcaaacatgcacaattacccattttctacaaacagacatcagtgcatacagagccaggtgcacacacattcaataaatagtaaatggtagaaatctccagaagtagaacagatcacagttaacaggctggggccatacagctaagtaaacaccgacgcacgattcgctcacacggaataagaactccacgaaggacacttggggaccacactggtcgtacccgagggggcgggaggcggaaaaagtatttccaaacgcaactctgccaggtcttacccttcgcatcccctggtcctcgggacagaagctcccttggcacctctcgcccagctcaggggctggttgtccgctagaacgaaatatcccccactgactacggagagctctgcagggagccgaggcccccgcccgggccaagggaaggcgctggcgccgcgggagacaagaagaggcggaggcggaaaagaagtggagaaggaaggggtggcagagggagtagcgtgcgggaggcggcgccggcgc

SEQ ID NO: 1520 - DNA, 26183 bp, Homo sapiens; identical to SEQ ID NO: 1519

SEQ ID NO: 1521 - DNA, 26183 bp, Homo sapiens; identical to SEQ ID NO: 1519

SEQ ID NO: 1522 - DNA, 26183 bp, Homo sapiens; identical to SEQ ID NO: 1519

SEQ ID NO: 1523 - DNA, 5472 bp, Homo sapiens
ttatgttcttcatggtaatctagaatttttatttgattccaggtaactttggacaatagacatgatgagatgttttctctttgaataagttaacagtttaattacattgaaataaaatatactgtgggcttaatacattgtaaatattacagaagaagtactactttgctatagtaatttaatgactgaagctacatttaataacaatcttaccagtacttgtatacaaagtattatacagattactaacgaagatattgcagtggttgcaacgatgttaccagctcaacaaacatctaacaatacaatattcttctaagaggaaaagtaataatgttagatttacagacaataaagagtcatgtttcccgcttgaaacattggaaataaatttgaatccagatacaagaaaaggtttcctttcttgggaactctgatccccagtaggcctagtacagtcaatttacatgaagatagcttttaagatgccacggcaatgtaaagaaactctcccatccgaaaattactgatttgtaggccactgctcaaacatctgactttttagaaacctatttacatacattcagcccaaatcagtagatagaatgtttttttctatattacaataggcattgttaacatttcatcagaaggccagtgcaagacaattaattgttaatagccattgcccagcatttaggagattttaaaatatcatacaaatatacagttagagtgtgagaaatctaattgtgtgcatgatatgggtggtctcttttatggacatgaaatggcagaaattaatcaacaggacagtaactatagcgctactcatccagggcctaattctcatctggtggttgggcctatttcctgcagagtggatttaggcagcaaaaggtccttggcatttaataccagatagacttaactcaaagtgccagagaggcttggaaatcatctcaagtgtaggacagatgtctacagcatctctcagattcatatcctttcacatatatttcatacaaaataaatcagaggttcctcttggaggcagccctacttgtgcaaatgaaacattctaggactgattcatcatgactctgataaaaaaaaaatgagcaggttgggaatttggccctttctgaacatgtgtgatggtaaaatgcatggtcagggcaagtacatcatcctcagaggaaagtaagatacctctgatgtcagaccttataaaacttacttaaatttaaatcatttaaattaatggatctaattatggggttaattaatgagtgatattaacaaatggtaattctaatgagtatattcattggggacaatgttttcgtcacttgggttaagaaatgatatgaaaagtgtcaaagtgaatctaactagttttaaacctttttaaatgaaggttgtataacatacgtgatgatatttcacagatatttcttagaatatcaataagcaccaagtttagtgctgtcagccccattgtcccttaatttattatatatgatttagatcttgaaagcacaacacactataaaatctacactgcatacgcacaaatgcagtttcaaaaatgaatcgtgaaatttttctaccataacaagaatttctctagctcttcatagctgtgaaaagagcattggtactgcctggtgagctctgaaacatgtggattaatgttcaagatgatgcaggacaaaagactggcaattcttaaatgcaaactaaaccctggtgagttcttcttgtaaataatctctcctgtctttagaaagagatcttactaatcctctagcaccctgagccttcatctgcacatgacagagaggtaaagtaagggagccagcaggcagattcaaggtgtgcagacagacaatgcaaagtatctcataagccacatcctgccttagagcgtgaaccgtaagaaggggaactgccccatcaggctgcttgggtatctcgagagctagaaatcaccagatagatgccagctctgtacttcacttcagactatgtaaaccttggggccttgtaggagtcatgttttatctgtataagaagagattataattaaaatttgtcagggttaagtagattcttcagcaatatcattccttactggaaaaaggcccaacaagcacccatggcgccattaaggagcatgagaccggggtgtaagaagaaagcagctgtgtttatcttcatgcttgagtgtatcttgctaaccacgagcaaaggagagatttgttccttagcccaaacctaccaagacagagctgggtgctcagctgtcaccaagggcatgtgggcaaagcacagatacagcatagctagacgtcaatgccaagtgtatcggttcttcactgccgttgtgtgtctcatccactgtctgattcagcttttttagccacatgggctgggtgtgatagtcctactttaacgtgatgtatatagtgcatactatctacacacgctattgaaaaatgttaccattgtttttctgtagaactgtcttccttttagtgactgacatattgctcaatattcggtgctcagaaaccaaagtactctcctttcctggcaataacactacaaatacatcccttccttggatgcctgtcattattttttgctaagcactggtcttgtgtaatacctaaaggtcaatttagtaatacttgatccaatctcttaaggagggatggggtgaaatttttgaatggttggagtcagtatttttatcaacaagattacaggaagaactcaattttagaaactgaatccatgtgcaagagtgcagcaagtggtaaaagtttatacttggtcacagttttctcactttatgacattactgtaacagttacaggacagaaacacacatacacacatttatattcacactcacacacagtataattttactgatccagacactacttcttttcaattaaaaaaaatgaagactgttgtttggccacccaggcatgaaatctacttaaacctggaatataggaacacaatactattcaagtaaacagcaactgcacagtgataacgatatacattaagattaacacatgctgtcttaagagatccagtaatagctaaagactaaagaaagtcagagatgtcgctcaaaaaaagtcaatatgctttctctcttccattctgattataatccattagaacagctatagtccagaagataatgtgtcttcctatgaaaatgcagggctaataaatttttaagtatgaatgaattctgctcaatattttgaagtcttcaaattcttcttgttgaggtaacagaaaaataaacctttacggttatttcagtgtcaaaattaaatagagatatttgaagaaatattaaggtttatttctaaagttatatcatgggcaataatatagaaaaaaagtgcacacattgacacgtatccactgcttgtccattgttctcataaaagtctacctttcagttttgctgaactaaacaaatattaatagcacataaacactgatacacatctcacaggacataatacattttacaaaatatctctagtactataacttgtaaaaatggacatctctgatactacggacagttacatttcacattatagtgaaagttgtggttacaaaggcattattcatttgatggcatttttccatgggttcttagacttccaattgtgtagccaaaggtttccctcctatttcattgagactttgaaggatcgttcagtcacttaaacaacaggctttcttcactgtaaacccctggagaatggagtttgagtacctaaactatggaaacattagcaaactgataagtgatcatggtgacaatcaccttttcattgagcatggtaaagttaaaaaaatataaccaaggagacaatagactcttctagattttgagcttaaaaaaaaaaattcttttcctgtgctgccagggaggcatcaggctcacagagcctcggcagacgtgtctgtggacacagacatggttaccttggcaatcttgaccgtgctcttgatgcagctttctgcggccctgtgaacactggctgcattgtttgcgtgtttgtgcaggcagtccgagtcccccatgctgttatccagaggctgcgcagtgccttcacaagagggaaacatgctccggaaagcgtgtcgcaggtccttactcctcagagcatagatgatggggttcacggtggagttcagcaggcagagcatactgcagaatgcaaacaccgtcttaatgagcttgttcatcttcccaaagacatcatacaccatgattgcaagcagagggccccagcagatgatcaacaccaccaggatcaggaccagggtcttggctaacctaatgtccatgcgggcttggtctggccgggtcacctgtaccttcccatcctcagacgtgtggatgatgatgctcttctgggtgccacgctgaatcatgcggacggcgtggctgtgagccttccagagaatatacatgtacgcatacacgatgaacagaagcagtacgctggtgaccccgatccagaacatcaggtaggtttcatcaatgtgtgggaaaatgtctgagcaaacagattgcagtttctcgcagttccagcccaggagaggcagcacggcgatcacaatggctatggtccacatcaggcaaaacgccaccacggccttgggcctggtgacaatcctcttataggccaggggcctgtgaatggatatgtacctgtcgatggctgtgaggaacaggctgcccacggaggcagtgaaggaggccgtgaccccacccagtttgaacagaaacacgttgcggctatctttgcggtggaacacgtggaagtcaatgaagctgtagacaaaaatgacactccccaggaggtctgccaccgccaggctgccgatgaagtggtaggaaggcctgcagcggaggctgcgggagtggaggatgacgcacagcaccaggaggttctccaggaccgtgaaggtgcccagcgtgagggacaggactgcaatggccagctgctggctggggttcaggaccatgaaacactctatgtccatgaagttctccccacactggatgttctcctcattctccttgaaggacgagagagacttgttgtaaaattctgtaatgttcacctggtctgctgggactagctgggggttgtctcccgcagtcatcttctcttggaagggacttcccctaaaggaagttaaagggaatttctgtgggaagtaccctaatttggatgccatgtcacctttgatgtcttcgtactgaatgtcatttgagcccacgtacaggaggtcagtggtgatggtgcggaaggtggtatctgcaaggccatctaggatcgacttcataacctcagtctttgattaggctgagctcaaaatgactgagaaagtgacccacagggggcaatc

SEQ ID NO: 1524 - DNA, 58605 bp, Homo sapiens
agatgccaccaccactgccaagcagctgcattcctcgccgggaaattcctccaggcaagagaacgcagagacgcccgcccgcagtccgggggaggacgcttcaccaggtgctggccacgaacaggaggctttcctgggtgtgaggggtgcgccagggtcgcccacccaggagcggcccgcgggaggactaggcgaggcccctaacggagcccccagtgtgtgtgccgaagaaggctccctggggccccgcaacgcccgcagccagccccccaagggcgcgtctgatttgccaggtgagcctccggccgagggcgcagcgcacacggccagctccgcgcaggcagactgcacagcccgccccaagggtcacgcccaccctgctaaggtgctaactttggacatctacttgagtaagactgagggggcacaagtggacgagccggtcgtgattactcccagagcggaagattgcggtgactgggacgacatggagaagaggtccagcggccgtaggtcggggaggcggagggggtcgcagaaatccaccgactcccccggcgcggacgccgagctccctgagagcgctgccagggacgacgcggtgttcgacgacgaggtggcgccaaacgcggccagcgataacgcctcggcggaaaagaaagtgaaatctccgcgggcagccctcgacgggggcgttgcctccgctgcgagcccagagtccaagcccagccccggtaccaaagggcagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctgtaagtagccgcgcaagtcccggccgagttgctgtccgcacacgtgctgggggtccgctctgagaggctcggggtatctgcattgtggaagaaacgtctggtcactgaactttcccctccatgctgaacttaagatagtgaagggccagtttacacagtcaagatttaagatgacacctgtggcagcctcctcagttaattccctttttaacacaagatttaagtttaacgaatgtaaaaataggatatccgttgaagctcaacgtttatgtagatgagagataagacctcatggcctgacatgagctgattctattctttattcaaaatgtacaagggtgttccaaggtgggatgttcttaaaatgcatgtgctgtgaatttcaaaatatggagcaaacagtaacatgttaaatacgatccagtagctttgacatgtgtgagttttaagagaatttgcagaaccttttatggcactcagtgcatttattggcaaaaagcttaaaaacacacaagaaaagttcctaatacaagtatcttggttgcttcttcccctttataatgttagggagtctggtgatacttttggacccaggctgaaaagtagttttcagttactgaaataaagatcagtgttcttactggaagattatttgctacatgaaagcagctgtgacaggtgtgagtttaagataattccaaaacattttatggaacttagtgcattattggcctaagcctttttcaaaaagtccctaatttatgtatcttggttgcttcttcctccttgtgctgcatgaaagcacaaaacaactgtgactacttgctgttaagtttattcatttcacaagtaatttatttaatactttctgtgcaagatattgtgctagtcactgtgggggaaaaaaaccctacaactgtgactcaggatattgccctgaaatttttatagccccatctggcacacaaaaagcacacaaatcaaataacaatacaagatgatatctgatgaaactgccaaacgaatgttaccatctgtaaatcctggggaagtgctagcgagcaagaaatcactgctggtgctttgggggagctgggccttgtgccttgatgataaatgcaatttgtataggtggacaggatagggaaggtactctatgaaactgataagaccctcccttctcacacttctgctccctcaccactcccacttagcacaggtgaataatgattaagtgcttaagtttttcctccattcacatatttgttcaaggagtgggtattttaacaacattatcattataattcttgaacctaatggtttctttcattctatttgatttcttggataagtaagcttaagaggaggagagttctgattgggagaactctgagaactctgagagggaagtatgcgtaatgaataacttgactacctcaccaactgccaacctggagacctttgatatagtcagtgatttattctgtgatggtaggtagcatcagagaaatgagctgggtgaatgatgcctattatttatagaagaccagtgtgattgaatgctaaagcctcctaaatgtgagccttagagaaacattgctgtgtaccttatgaaggatggttcacctgtcttccaattagaagacaccagtagaaaaaccagaaatgttacactgtgaaatagtaggctaaacaaacaggaaagatgatcttataatgaaattcttcgtttgctgttctctgtaatagaactaaaccaaatatgtctttcccagttctgattaatttatacctaaaaattttctttaccagacattcaatgtatttgttttgcgcagtgccttgcacatggtcatttggcaaattattgacttaaaaattaataagtatttctagtcctttgacccatttctttgtgactgatggttttttcagaccctttaattcttcctatgaccgtatcgcaagatgttaatcagattattctttaaaacaatttgagactgaagagtaagaaaaactatttcgtatttcctgaaaaatgacactgaagtagcatgttcctttatgctgttagaaaaattattacttcaagttctctaccaagtgctgaatgttgaaattcttaaaatggtatatgtagaataaggagaattttcctcttataatataactatggctttttggactccaaattattttcccctgtctcataatgaaggcattacaacatgaattataggagccttccttttaatcagtctgaagtaggttaattgtagtaactcttggtagcacaacttaatagcacagaaagtttggttgtaaaatttattctgatcttcgtgtaaatctttaatgtgcagatacgtgtttcctgtccttaaggtagcctgttggctaacctgtagtgttttctatttacatcataagatatacttcgatgtttgaattgagtacccttccttgaaatgattagtgagaatttttaaaaagtatattctctggtatgtgaccatccctcattaactgatagcaaattgaagctctctatttctaatcatctcactagtttcataatttgatctttgaggaaatgcttataaattaattttccttttaaatttaaggtatgggcctgcaataagggagcctaagtatcttatggagatattggggaaagcaatgcctgggagaaatttatgagcagagatcaaatttatttatttatttatttatttatttatttatttatttatttatttatttttgagacaggatctcactctgttacccaggctggagtgcagtggcatgatcatggctcactgcagtctcgacctcccccggctcaggtgatcctcccacctcagcctccctagtagcagggactacaggcgcaccaccatgtctggctaatttttgtatttttttagagacaggattttgccatgttccccgggctggtctcaaactcctgggttcaagtgatccacctgcctcggcctcccaaagtgctaggattacaggcatcagccactgatcccagcctcaaatttagtatcaagtaaaatttgtaaaaattaaaatctgaattctcagtgctgcttttggagagaatattttatccagaaggataagttgactcaccagcagtcatactgcctgtcccttctagaagctccttaggcccaagcttctttttttttttttagacagagtctcactctgtcgcccaggctggagtgtagtggcacaatcttggctcactgcaacctccacctcccaggtttaagcaattctcctgcctcagcctcccaagtagctgggattataggcctgtgccaccacacctggctaatttttgtatttttagtagagacagggtttcaccatgttggccaggctggtctggaactcctgacctgaagtgatccacccgctttggcctcccaaagtgtagggattacaagcatgagccaccacacccagccaggctcaagcttcatgaaggccaagtccatgaaggagaggcagtatgggatttcagtgtctccacttgtgtgttctcattatcaaagtggcctctaaagtctatgttatgttatggatctcatgataattcactgactttaaatgataaagatggaaagaaccagaggagctcattcaggcgggtatagtccaagcctatctggggaaccagaatagtatagtggttgggagcatggcatctgaagccagagcacctcacttcaaactgtggccctgtcacttatcagctgcataacctcagggagttacttctcaacacttcaacttcctcagccaaaaatagaatgtataaagtcgtatattaattaagtaagcccgatgaagcatttgtcaagggcttgacaatcactgattgttagtggttatgctttatctctcccgttttataaaccactggactaatggtttagactttttttttttttttttttttgagacagagtctcactttgtcacccaagctggagtgcagtggcatgaccatagctcactgcagccttgatcttctggactcaagtgatctcccacctctgcctttggaatagctgggactacaggcacgcaccacttcacctggctaatttttttgtttgttttgtagagactgggtctcagtatgttgcccaggctggtcttgaaccccttggctcaagcaatcctccctccttgacctcccaaagtactggaatatatatatacatatatatatacacacacacacacatatatatatacacatatatatatacacacacatatatatatacacatatatacacacacacatatacacacatatatatatatacacacacacatatatacacatatatatacacacacacatatatatacacacatatatatatacacacacacatatatatatacacacacacacacatatatatatatacacacacacatatatataagctttggaatcctttcttctaagaaagtttaaataggagcaataaataaaacagatactaggagtgattctgcttgaaaggagagtggacagccccatcctcatccctactttccccaactgcagcccttgaagagaaccccagggattccttcaaccataagttgggggaaataaaaacaactctgttctaaaccatctcattttttttaaagatgaagaagttagagtccagagaggtaaagtaacttgaccaggttcacacagataattagcataaaagccaggaccagagccagagaatgccaaacagagcacattttgtttctctgaaagaaagcactgtgtacattcaaagacttattatttccactgggggtaattatacccaagaaatgtgacggagagaggggagactctcttgcccaagaagtggtgacaaaaccaacagttgcataattgataagtaaatgacggtacatccatatgatggacttccatgcagcattaagacaacttttcaaacaaattttttggtaatctgaaaaatgttaactataaggttaagtcattttatttcttgaaaaagcaagatatcaaattatatgaacagaataatctcaattctattcaaaatatttaattatgcatataaaaagattagaaacatataaaaatgttaacagggatattgtctgactggtaggattatcagtgatttttaaatattatccaaagttgctatagtgaacacacttataatcagagaaaatcttatgggggaaggatgagatgaataaaatatccaaagcggtcaatagtagatgaatttttaaaatctatccttttgagataatatttaaaaagttatgctaaaataaaaatacataattgatgttggagcatgagaatgcattaaatatttaaatttcttctaatgttgttcaggccttaagatgtcttccaactctagtgccaagcactgtgcatacatgctacgtactcaataaattagttcatccctcatccctagagtttcttggctatataatcttccgatccctcatatgcaagcaaaacacccattaaaaatagttggtagtgtacttaggactatttaaaaatagtttcattaaaaaacaaatgtggcagagaatggtggctcatgcctgtaatcccagcacttggggaggccaagatgggaggattgcttgaagccaggagtttgagaccagcctgggtgacatagaccccattctacaaaaaaataaaaataaaaaaattagttgggtgtgtgatatgtgcctgtagtcccagctacctgggaggctgaagcaggaggattgcctgagcccaggagttcgaggctgcagcaatctatgatcacactgctgtactccagtcttggcgacagagcaagaccttgtcttaaaaacacatgtgtgcgcacacacacacacacatacacacacacacacaccacactccaaatgttatatatcagggagatgttggcttttcatagttttataattaattggtttgtgtgttcactttttaaaactaggtcaataactttatcttcctgctttttcctcacagccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccaaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatggtaagtagcaatgtgttattatttatttggggtatttttaaagcaagggaagagaaggatgatgagcaactcatgttattcttttagaaatggttaagcttatgtgctatagtttttattcattcatcacatatttgaaaacctgcaatgtacaagggaccgttagagtgcaagaaaaaaatgtactaagagtcttcactgaaggcatctgtagtcttgcagggagataaagctacaaatgctctaaggcacatgatctttttttttttttttttttttttttgagacagagtctcgctctgtcgcccaggctggagtgcagtggtgcaatctcagctcactgcaacctccacctcctgggttcaagcgattcttctgcctcggcttccctagtagcagggaatgcaggcgcgtgccaccacgcctggctaatttttgtatttttagtaaagactgaaaatacaaatacgggggttttaccatattggctgggctggtctcgaactcctgacctcgtgatccatctgcctcggcctcccagagtgttgcgattacaggtgtgagccatcctgactggctggcaataaatcttttaaggcacatgtgaatttatatgttgtattatgaaaggtataggtaagcttttagagttcagagacagatgagttgctttttcttacctattctatgtaaaaatgctcagtgctatacttagaattttgaagatttgtgaaggagcttcctctatttgggaagtccccagccagggaaactttttcttaatccttctctctgtgagattcactctttgttcccataagtagcaataggtgtttatcctatgcaattgagacagtattttgtctttattgggaattagttttcattagggaaatattttttttaccctgcaaagctgtggggaataaagaattttggttttcattggatcttttcttaaatattagagagaagacagcaaaacatgattttggggaataattttgatttctgcatcttcttttatctcacttcagaagatgtttactttactcggtttttgatgtgaattgcgcctttttgttaccaagcttatttaaggtgagaaaggactatgagagaggaaggtggaatatatgtttagtgatcagctctgccaggctagaaacctgagtagggtttgtattctggtggtccatcctgtgaacccggctgtctggcaagtgtggacctcaatccaacacagtttatctaggcagaaaataccttgcacctttcctcgtctgtacagggtactgcagcatggttcaatgtattgtattggcttttactacaatcctgtcagagaatgtgatgttgcaagctctttcaaaatatatggttgggtttccagcagaggtgcagatccctttttcatgtgatttcataaactttcataaagtttgggtttcagatgtttggtgttaggaccctttatgtttaaaaatgattgagaaccccaacgagcttttgtttgtatgggttctgcctatcagaatttattatattataaataattgctgagaaaattgtaaaacaccagaaagtagaagtgcacactgcaccagtgctcagagcaacgatgtcatcacacatcatggagccttgtactccgctggacatttgagacagagatgaaaaaggcaggtgacctcttcttattatgaaaatagttttgaccccatggactacctgaaagtatcttggagacccccgcagtggcctctgaaccacattttgagaaccactgctataaacaaataagactgaatcagcctatggtactcagaaatcataaaattctaactatttctattaatagttatataatagaaatattaactatttctctcaagcacaaaatttccactggtccacttcccattcattactactttgttctttttaattgttcttagatcgctttccttatttaactacagtctgacaaagttgataacagaatatacagtttccctatgaaaatcaagtcaaatgacataaaaaggaaaaataaaatctttatactttttctaggcctttttatgattaaaaaatatggtctttctttaggtcctgggcttttattgattgtatattcaatcatgaaggttttacctgaattttgttttaaattttaggctttttcttcagtttatctacttctaatgtgtatatatacataaataggtatataccatctggcttctgataaggctctaggggggcccttatggcctttttttttttttttagagtcagaatctcgctctgtcacccaagctggagtgcagtggcatgatctcagctcactgcaacctctctgccttccaggttcaagcgattttcatgtctcagcctcccaagtagctgggattataagtgagtgccaccacgcccagctaatttatgtatttttagtagagacggggttttgccatgttggccaggctggtctcgaactcctgacctcaggtgatctgcccacctcagcctcccaaagtgctgggattacaggtgtgaggcactgcgccccagccttttgtggtcttctgggcatatcacactctggtgtgatgcaagagcagtcagagcaaaggcagttcctaaaataggcatcctggtcagcactgaaagtagttcacgttttgtaatatttttacatgtataattactattttattatcttatgcatttctggttttactggtcttgtcagatggtcttgaaaatgattagttttggagccatattgaaatgtattttgtctatcaaaaaagcgggattaggccgggcacggtggctctcacctgtaatcccagcactttgggaggctgaggcaggcggatcacgaggtcaagagatcgagaccatcctagccaacatggtgaaaccccatctctactaaaagaaaaatacaaaaattagctgggcctggtggcacatgcctgtagtcccagctactcgggaggctgaggcaggagaatcacttgaacccaggcggaggttgcagtgagccaagatgatgccactgcactccagcctggtgacagagccagactccatctcaaaagaaaaaaaagggggattaaatatactatgtgcaatgtacattatgaaatataccatatataccataaacacttctatttagactagtggttgttatatgattgtagatttactatgagaaaacaatatttatatggattcagatagggtatgtatatgaacacaaaattgattcagctctttctaggtaagtgattaatatattctaatttatctttatttgagatgatactgatattatttgaattagaatctcttagctgagttcctattctgtgaactgacatgaaacatatgtgccctgaattttctagcattggtggaaatagcctagacatttaaattaggagaaattgaaatggcaaattcagttagaggtgaaaaaacctcaatttaaaagcataaactcaaagagttttaatacaactttagcatccattagagtggaggtttcaaaatcgatacaatgtgggaaaagtgtgatctacctacaggatcgtgggtggaaaaagaggatcgttatgtgaagttgtaattatttgttgtgtttttgttcatctgattgcagacacttagaggaagtgtccaaaataaactcaatccccgacctggaaaggtaagattattttctgtttctagtcttgattctattttggtctgacagagtacaacaaagtgtgctaccactttcgttttcttgcaggtagtgatatatagtgaacccgacgtctctgagaagtgcattgaagttttcagtgacattcaggattgcagttcttggagcctctctccagtgatactcataaaagttgttagaggatggtaagaatggcactttaagttcctgatgtcaagtgtttgagttttacatacttaattaactttttagtcctcactactagtttaaaattatggctttagcaatgaaaagcacaggaaatactactcgtggtaagataagggattcatatcttaacaatgtcattttaaatcatgtttctgattatagcagtgatatatgtttatgggagaaaaatcagaacaatacagtagaacaagcttctttttcccatgcttccccataatattgttttggactagtcatatatcagggcccataacatactcttggttgatgacctttaaatgaggttgataagaattgcactagttatgttgataggccagatacgacttttcaaaaacctataaggaaacttgagaacacgtaggaaaaggcaaagtaaagaaacaataaggaaaaaaaatctataaggtaaaacaaaaataatctataaagaaaggcatttttctaactttttaatgacagttcaatgcagcactaacttaaaatttaatttactttccaatatttccacaaaagattgttttggctaagtaaagaaactggtgaaaaaaataaatattttgacagtttctgaaatcattttatcagcttcattgcctcttggagatacacaggaagttgggtagagaaaggcagcttaaaaaaagaaatcgctgatctggcataatagttatcttttggtgcctacttgtaaacttgtttgaagtaaagagggtagacctctgaatgtttatggatttacaaattcataagcttttcttttggtctccatttgattaaatatgcagcagctttcctattagatttttaggtgttttaatattttttcctatatatccaacatagtcatgagaaaaacaagatttgcttttattcttaaatttgaagacaaatgctattttaattgctagagaattggccactaatatacaatatataatagtggcaattttttacacaaattttgtttttatggaacagtactttttcctttcttttgcaacttttgtcggcttctttttcttgaaagcataagcatttacactgccatatattgacatgaggtttttctttagtgtttggctgttgttgggaagaatattattaaaatgctttccattaccatatctatagtcttttgtgccaacatattcattgatatgactgtaatatgtaagttaaagtctctctaagagaaatgttttctacacatataaggagacaaaaggccagacatggtggctcatgcctgtaattccagcacgttgggaggccgaggtgggcagatcacttgaggccaggagttcgagatcagcaggccaacatggggaaactcagtctctactaaaaatacaaaaatcagccaggcttggtggcacattcctgtaatcccagctactagggcagctgaggcaggagaattgcttgaaccagggaggcggaggttgcagtgagccgagatcgcaccactgcactctagcctgggcaacagagcaagactctgtatccaaaaaaaaaaaaaaaaaagagacaaaaaaaaaaaaacctagtacagtaaacatccatttatctgacatattatcataagtctctaccacttggcaattacttagaacattagtagctctatagcattcatataggtaactccaaagttctctaagatcctgatatagttcatgagttatcagaggcttaattatacccagtaaaatattagtgttagggagagtttaagctattttaattgctagataattggctgctaatattctatatatatatataaaatggcaattagccaggttatttgagtaatcaaaacctctctcacgaagactgactaatggttttgctgtgttttattgttagttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggtaggttgtggtaaatatggattttatttattcagctaatatttatggattcttactttaagggaaatgatcattttacgaaatatgtgattgggaaacatatttggtgccttatggatatattttctgtattttaagtatttgtacactttaaataatttaaaaagaaacataattggttagataatttttcacaataaaccctttaggtagatcttttatgcctgtccttctattcccatcttccaaatatattttacctggtaacttggtttaaatgagttctgcctctatgaacaggtttttcatttatttagtgtttttgtttgctgtatgagttctgattactttgagtggtttataggaattctattttggaaaaataaataatccaaaaataatttggttgattaactctgggatttcatgtgggtttaacaaaatattatttactctatttgaggccactttatgggtgaggtaaaatttcttggtttcttgttatttgatgaggaaagtgttgtcagagtctttctttgtggctcttaggatttgatgattctttaccttaaaaatgcaattaatgatgtcttctaagtagaaaattaaaatcccaagttttaatggagacgagtgtcaagatgcaatacagagaaaaggaacattcttacatgagaatgagtaaggatgagtaacagttttggcagaggaaagcatcgcttacttcctgagtcaacatttctgagtaacttaggtggtaattggtatgctaaatgatttatcttttatttgttttaagtatataatacgagaagactaagtaagacttgagaaaccctatttcaaaatgtcctcattagtggaatattttgcctagagtttttatttactgctcaaataatattggaaataaagcaatgtttaaaaagatcatctgattcccaccatcatgaagtgtcccctccccttttattttttgaattttctaccctttgttggccatattctagtctgctttttctgcagtaataatcataatacaggtacaatgctgttccacccttctcacctaacactgtggttctcaatcctttttttctctttataccactttcctgaaaatcacactccccttggtaacatctttgtgattggcaactggggaaggtatcagaatctggtggggtgaggatttgggtgcattcaggaagatggggaagggaaacgagatctcttgttttgtctgataatagcagacttactgtagcaaatgcttttcatgttaccacaggtttagggtttagctgaatatcatattccattgaaatgatacattatttattgtttagtacataaatgaggtaccattatttatttattatttcttctttcagtgaatcttaaggttgtttctagttttttactattataagtaatgccacgagaatgtttttgtgcatttaataatttataattttcttttttttttttttgagacagtcttgctctgtcgcccaggctggagtgcagtggtgcaatctcagctcactgcaacttctgcctcccaggggttcaagtgatcctcctgcctcagcctccagagtagctgggattacaggcacatgccacaacacctggctaatttttgtgtttttagtagagacggggttttgccatattggccaggctgctctcgaacgcctgacctcaggtgatctgcccgcctaggcctcccaaagggctgagattacaggcatgagccactgtgcccggccagtaatttataattttctaatttgtttccttggggtacatttttctgaatggtgtcatgttaaagggctatgatatgtcatggctcccagtgtgtcatggattatattttcttcacagatcgtgtgcatggtttcttgaaacataaaacataagtcacagcgtatattttcaaggttacctttttagctcattagagttgttccttttgataatatttgaaaagcctcatctgagcttattcaagtgttaatatttcttctgtcactcagttcacccaactcagctgcatagatgagtttcaataaatattccattaacgcttaggcactggaccagaagaggccttttgaagactgtttggaccacagatatgcggggcatggaacaatgaccaaagtacagagatttgtaaatcactatgaatgtgtgcttttgcttttacgacttagatcaaaccaatatcatagaggtttactcagtcaaggagagttaccacaaagcaacagagggcttatggacacaaaacagtggctgaggaagactccaagagcagccattctacagactagagtctctgtgcttggataattatatcagagcaaaggaaccaaaaccccagaccaaagaggaccaagtgaggatgagaaaaagaaatatattccaaaactcaaataaaatacatttctgatgatctttgcttgaatgcaacactgagttatataactaaagcaagtgtgtctgccccgaaataggtgtattattaattcatggatgaaaacaggaaagggctaaaatggcaggtgctctgtgaaatgtgtttgtaaatttaaagctcattttgattagttgtaagaagaagaagaatgagcttactagagagtgaaatacatggtgcaattcttactatctatgcatctatattttttcaggattacagagttagtcacattgacttatttactgaaccagaagggttaggaatcctaagttcctactttgatgatactgaagaaatgcagggatttggtgtaatgcagaagacttgttccatgaaagtacattggggcacgtaagtatttttttttcaaacaaattttaatgaagtttttttgtgagtgtagtactggaaaaagaggacttaagatactctgactctaatttgtcatcctgttaagtaattattaactgtaaggtatatttttataaggcacgtaaaattctgattcttttgcacctatgttatgattcatctgtcttaaaaacagtatcgatttattataggaaatggggggggattgaattttttaatgtaaggctttccttgtcacagagaaatctgatttattcaaagctgagtagcagattatattttcatggtgattcagaggaggtaattcaaagcacatgcccctgatatttctggggggggatggaagccaacacacatggtacttccttgaatattttcacacaatgctggttcaaagcccctaggaggttggtttcacaaatcacaggaaacagcaagaatattttgaaggaaatgggaatacctcagataggggagaaatgaggatagaaagtatagactgcaatactgaagaatgtggtctccaaagtgaagcacaaagccccaaggcatgtgaaagacattcactgagatgcaggaaaaaacactaaagcttctttctatttgattaaagtctccacctcttaagattttatttttgtatatgttttctaatatgcataatgtattagttcagtggtaatgtatataatttataaatattcatatattcagagaatgctcaaatgtttttactaatggtttatacagtcaaaaaagtttacagcctgtccctaaagtggtatggagtatctctgcagtgaacaataaggcactccttaatcatgctttttgcattctatttattactaaaagccttggtttgccattgttcatatcttagaaaaataatttgcttgtgtaaaaggtaggaataggataaattacagatcatagaatctgatttttgatcctcagaaatgagaaactaaaaacttctaggcaacttaacaggaagtgtggctattgagaattggtagcagctatccttgaatagttggaaggtggtcatatagaagagatattagacttgctctctgttattccataggaggtcccaggaaaaaccagtagaaattagagagatggattttgacttgacccagggaagaactttctgatggttaatacagttaaaatggaagtgggctgccttgttaggtaaagagtttctcatcgcagggagtactcaggtagaggatggacaagaatttatccagagctttgtagggaaaggaaagtatgagttaggtacctcctttacgacagtttgttcatttatttatttacttttaacattttgaaatataagacacctagaaaaaagttcacagaaggtaaatgtacacttaaacaaataaagtgagcacccaagtagacaccacttgagccaagaactggaacattaccagcaccccagaagcccgatggtattctttccctatggcagcccgtctcagaaaacaaccttcctctcccagaagagtgagaaaataacaagggaggactatagtgatggttcgtcaatatacaaaggtgtagttactagggcagaatttggggtgtagagaacaatattaatttaaatatctcctcttgatgtataaagttattttccaaggatagtatacattttactgctttttaaattatttttaattgacacataataattgcacatatttatggggtacaatgtgaggttttgatacctgtatacattgcataatgatcaaatcagggaagttagcaaatccatcacctcaaacacgtattatttctttgtggtaagatcattcagaatcctctcttctagctattttgaaatataaaatatattattgttaatcatagttaccctactgtggaatagaacaccagaacttattctattatatatttttaccacattttctttattcattcatctgttgatggacactcaggctgattctgtatcttggctattacaaatagcactgcaagaaacatgcaagtgcgggtatcctttgacatacttgatttcatttcctttggatatatactcagtagtgagattgcaagatcacacaggagttctatttttaattttttgaggagcctctatactgttttccataatggctgtgctaatttatattcccaccaatagtgtggaagagttccctttgctccacatcctcaccaatacttgttatattgtgtctttttgataatagcctttctaactggagtgaggtggtatctcattgtggttttgatttgcatttccctgatcttgagtgatgttgaacattttttcatatacctcttggccatttgtatatcttctttaaataaatgtactgttttttgtgtacattttgagttatatcatttggtaccccgtagtccttgaaaggctctgaaatttttaaaggtggttagtttagaagtagaaattaggaaaggcttttatttcctctgcataccctgtctaaatatgacaagaaattgggactttaacaaatataaacccaaaagagtgtctatgagatgtattaaatatattcagtaaatctgttaatcaagcatctaccatgtgccaggtgcttttctagtcactgggaatacagcagtgaagacataaaatgatgtccccattctcctggagctgtcagtctagcaggaataaacaacacaaatacatatataatgtgtcagatggcaaaggctacaagaaacataaattacagaggggcaggcatgttgctattttagatagggtagctagtaaaggactctggtgacattttaaggagggaccggcaggaagtgagggagtctgccctggagctagctgagggaagaggggcagggagcctgtcccagagaggaagcacaccatttgcaaaagcccttctgggcatgcttgggcaatagctaagaggccaaggcggctgaagctgagtgaagtaggaggatagggataagacagggctcaggtcacatctggcctttcacgccttggggaggaggatttagatttactctacgtggcatggagaatcattggcgaatttttatctaacttgtgttattaatagaaggatcagcctgtctgttcgtatagaaaatagtctgtaaagaggcaaaggtggaagccaagaaaccacgtaggatgcacttgcaatcatacagccaagaagagatggtggcttagacgtgcgatggtggtggtgggaaatggtcagatcttggatgcattttgaaggtagaactaacagcatttctgacagattgtgtgtggggtatgaggggccaagacatgcccagggtttggaaccccaacatttattgagacgaaaaagacttggaggagcaggataggagagagagtgagattcaggagctcagttttggacaggttaaggctgagatgccaactgcaaattcaagtaagtgggcaagaaggtgactatgtgaggctggagttcaggggagaggctggaggcataaatttaggagtcactggcaaagagaatgtatttaaaccaggcacaggacacagtcccaaaggggagtgggtgtagttaagggaagagaaggcacttttgtatttagagactgggaagaaaagtgggaatctaagcaaaagaaaatgccttcatctcttgctgcctttaatttttttacatgaaagaagtctatacacttttttttaaagaattggtgtcaggttgagaaacaccactttccttagaaaagaatgaaaaaggcatctgttatcatattttaatctcagtgtctggaaggtgccatgactcaggcttggctatgttgaagcacattaatctaccttaaatgatatttcttacctttgcagtaagtttagctttgcctcctgggtggtagttaccagcctgtcacagcttacaatttatgacaggtttgtgtcatggtgagcatcttcttttctggctgttcatttctgttgaacactgcctcagatgttaattcaaagtttgggctcgttgaacttggttggtgagcttagacaccaggtcattagtgcttttatagatctcaaaggaaagtctcaaggggttgagaagatgtcactgatagtaagtactgaagctcattttgcttctgttgatgcactggttcccctgaactgggataagaagtctttgctgtagagggaactccttaagaatccattaggtgatttattccagggcccattcactctagattaagctcttctactcatacacaaaataagggtgttacttgtctggtcaaattcttgtttgaggaaatgagtgatttctaactaaacttgcctttcagattctgttgagagtaatttgtttttaaatctttcttttaagcagctggctaatcctggcacccatcctcccagaggtgaaagcatattgggttttttgggggcggggtgtgtgtaggggtggaagtggggggtggtatatttatgacgaacaaaagcaaagaagtttagaacttcaaagggagtataaagatgatctggcccaacaccatcatttgactgaggaagacaagctttggtcactttctccagactagggttagctgttagcagaatgtgtactagaatgcaggtgttctaaagtcaagggacttcttttttaattgacaaacattatttgatcatttgtactgtgtaatatttgacatatacagaataatatatgtatatatgtgaactatgaagcccaataataaaacaatcccccgtggacccaccatccaacttacaacctagaccattaccaacattgctgcccaccgtggttacacatgtaaccacactcctaagattactcatattgatgggtacatctctatgtatttttttcattgctgtgtaatagtcactgtatatttcattgtggaatataccatatcagagcccaattttttattataaaagttttcaaacatacagaaaagtaggaagaatagttcagtgaacaccaatgtaccattcactttgacccaataattgttatcattttaccatatttgtgttatttttctgagcacttcaatgtacattggagatatcatgacccttcattccacataggattcagcctgactctctttctaatggtattcccctgcataagtatcattattacacttgagaaaattcacaaagtgtccatgataatatctgttcaatagtccatcaccaaattttcccaattgcttcaggaatgtctcttatagatttgcattttcaaatcaggatccaatcaaggttcacataaatgcgtttgattgttctgtctcttttaagtctctttttaaagatctctaaaataccccatctttgtttcccaagccactaacttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccactaacttttaaaaagatttaggccagctgtcttagagagtgtgccacattctagatttgtctgagtgttccctcatgctactatttagcatgttcttctgttgcccgaatttcctatctactagggcttaggtcttaaggtatggttaggttcaggccaaacagttttggcacggatacttcatatagatagtgccatatatttatgttgtatcacagcaggtggcatgtgctaactagcttgccctttagcaataccaagtttgattgcttggttaaagtggtgcctcctccatctttccattgtaaaggttcattttcccctttgacattcatagccccctctcttgtgaataacctcaaagtcagtaccttcatatttaatttttcaagtatccagttggtttctgtgaatggccaatattcatgtacagccatgtctagggaacacaacttaagatccatctggaagtgctgtttttgtttaagagcaagtgaacaagataagactgatttttcttgtgtgactcaaagggtatttctaaaagagtaattggacaaatattttaaataaacatatagatggccattgttattactttaacaatattcatttgtaggtatacatttgtttgtttaaaaaataagcttgggctttataatcatactgtttgttaagtacgacaataaagttgtactttttaatctatattggcgaaagcttatgacccaagtacatgggaaaataaaagattacctttagaaactgaaataaccctgcctggagatagtttccccctctcctgatggcctcataaataatgtatcttattggaacagaatttagaaaaagtgaatcatactctgcatatgagttttcaaattcaaagtccacccagcattaataaatgtctgtttgaattacccagcaggccttcagcactcatttactaagggagaactttcagaacagcagtcttttcaaatgcattcattcatgttttcggttttttcacaaattcccctctacccagaatgactttccttccatgaatgttatgcaactaaaccacatgcttcaacagaagtgaaatgtttagtattagatgaataaatcccctctgaactcaagctatagaaggaaagacttaatgaaaagggtacttcggtaagaatcatttcaaaatctcagatcgcttgctcgtgagccgtacattcagtttttgaaaaattaaacctgttcacttgtaaagaagtcagacttgggacctgcttggttagcctaataccataatgtgttacagaactgccattattttgttagagaacaaaatccatgggtactgtgcctgtgatagctttgagctccaaaatacatgtaacgtatccttggctgtcatgctttaaacataaggaagtgtaaagtaccctattcttagcgtctgttttcttgtggtttagaagcattacagtagtatttaaaagataagcctctttttttccttaaggtaactttttttgaagcataacatttgtacaaaaaggtacataaaccctaaatatataagctgagtgaattttcacaaagtgaatacacaagcgcagtcaccattcagatcaagaaaaagaacattcccagcatcgcagaaacccgtttctttcatgcgtcctcacgccctcttccccaggaaccatcatcctgacttctaacactgtagttctgacctcctacccatatcccacacctggcctcccaacattctttcatgtgtgtgttgtcaaatcatcagtaggagcctggttgtaaatctctgtataattagagagtctagagaagttaccagtttatccagcggaatcttcacaaaaaccaccgccaaaaatgtgccttgggccaaaattgggaagaagaaaaaagcaaagagggaggggtcagacccgttttgttggtaaaagatttcatttacagccactctcttcttggcatggtgttctggggaacacaacatggtggagtaccacggctaaaacattttagcaaaactaaccgaattgatgagtgtaagtgatcactaagaagtctatgtttgtttatgaagcaggtacattaacccctctcttatagaaaagtcacttcttcagcatcctcaccttctcagaacccttcccaggaacgaagatgtttacaagaagaccttgtaaagtttagagacagggctagtaggcatggttttctggtttcctgatttctggcacattagaggagggtggggctgctggttccccaactgaagcagaagtgacagctgacaagctgatagaagggtgtggtattgaaaagccataacaatcagaaccaagaactcaaaaagctttgtggcctgggaacaagcagccccacagaacttcagagcccctgaggacaccactgtgcattaaataatgctcacagtgatgatcctgagtaactgtgaaaagagtaaactgtgttcaatgcacttcctgcaatgagaaaaattgccatcacaaaaatgattagggctgggcatggtggctcacacctgtaatcccagcacctttgggaggccaaggcgggcggatcacctgaggccaggagtttgagaccagcctggccaatatggtgagaccccctctactaaaaaaaaaatgcaaaacttagtcggatgtggtggtgtgtgcctgtactcccagctacttggaaggctgaggcagtagaatcacttgaaccaggaggcagaggttgcagtgagctgagagcaagccactgtactccagcctgggtgacagaacaagactccgtcaaaaaaaaaaaaaattgattaggaacctggttctggaatcggcttgaatcattccagcctttcatacttatagctgtgtggccttgggcaacttacttaactttatctataaaatggggacaatagcttctcttcctcatagcatggttgtgaggattagatgaagttctcagtggcattccttgtaagctctagggagatgttagctgttactaatgtttggcaccatgacaaatgattagatggaactttggagcaattaataatacaaattaaaataaggggacaaagccagccaaggagaaaagtaaaagatcaagaataggggcatataatggctttatttttccttgagtctagtgtgattctaacacctgagtccaaccattcattatgtaggtccgtatcctctcctgttcttttcctctcatcctgggtaccagacagaaggaaaaactgaaacaaatgatgagtcggctccctttctttccttccatggtggctatttaggtggctgatttatgaagaacctggatttcagggtgttcctttcatcctggaacctggtgaataccctgacttgtccttctgggatacagaagaagcgtacattggatccatgcggcctctgaaaatggtaaaaatgaaatccaaatgtccttgtggtgattctttgtcagcttgacgtggtaattcacagggtgtgactttgaagcaataaagctgacttttaagaaacaaatttgtagtagattggacctattgctcaatagaaatcatggaaagaataacttgctagatgctatagattaaaaaaaaaaaaaaaaaggcaggtaagactatgtcctttgtctttaaggcattctcagccctgcagagctgcagatgggtgcgcaaagcttcagcgcagtgtaggtttaacaagtgaggaaagtgaagaattaaacattggtggaaaaacaggacaaagatacatacaattccaagttgtgggtgatgtgacagaaaagggataattaggaaagcttcatgctaaattaaattcagtcttaaaaaattagcaggatgattttttaaatggagctgtcggtgaatgcactgtgtgagctagggtgcagcctgagagagagcagggcacgctgaggaccggctcggctgccgtgacacgagtgggtggtgtcttgggggtctctggggctggaccagatgagtgttgtcctcctgagtatctgctgtggaagctttgtgcttcctctcccttgtcccagtgtcttgctttgttctttgtttcttccgctagactgtcagctttgggaggaagcaggccgcatctgtcttgtccccagtgttgagcgcagtgtgtgctgcagcatggaagttgttccctaaatacccacagtgagatgaggctcccattacaaacatgtttttgaagctgcacttcgcagttgtcttctgagacagtttgagacaaattagaaagttaggaagacaatttttttaatgttaattttacccatccttccaaagtatttggtttaattatctgtatgtttgctggtcttaatgcaaatgatttgggcttttgtttctaaaattaaactcactttcaaagaacaaagttttgttagttttgtgaatgtatgaaagaattcatccaggttttaggagcagtttgtaatgatgatgaaaagtctccaaagtctatggtgttcaaacaggattacttttgaaaaggtcatgtgcttagttgtataatctctggtttgctgataatatcagccacattcctttttcctttttttttttgcttgttttttcataaaagttaaggaaaccaacacattcttttataattatagttcatttggtgcctttgagcatccttggtggtacttttttttaaaaagctattaaagatatattaattttaaaaaaatccaactttcccattgctgatttaaactcttgaactatttaatatttttgtgcaatatctttttaatgtaataccatttctctgattttagtgagtttttttgtttttaaaaagctttctattttataacaacccctcatagactcatcctttgggatgttttaaattttatttaacagtttatctaattattccatgagtcccccagatcttattatgtgaacttcaacacataatagtttcgtaagccctggttgcaaaatcaaataccttcaggggccaggcagcaaatacaaatggctgagagttaaaccgaagggaatggtagagacggcaaccccgggcctgtgcccagctgaaggatgaactgagggcaggatcgttaaatgcagaagccgaagacagtggcctgggagaatctgggtccagagatgtcagctcttggaactgctttttcaagagaagtatggatttttatgataaattttccaagttaaaaaaacttgctaggtcaaaaaacactcctacaacgcagatcagcttatagactgcttgtgcgaggctccgttctagcctgccttcctcgtgtcttcatctgtattgttggtaattttagaactatctcacgtaagttaaaacaaaccagaacatagtcacactgaaattcaatgttttactgtaaactgctatggctaatataaaatggtaatgtatcagtgaaaaactatttttcttactatgttgtttttttcagggtggccgtaaagttgaattccctacagatccaaaggtaaaaatatatatgtatttttgtatgtatgtatatgtaattatttaaacatatacacatatatatgtacttaatgttattcccactccatctctatgaagatattgcttatgtgacttctcatattaaacctctgtcacacataaatgcagccaaaggaagttgccaacttacacttgccatccttcagggtggaagatgatgctaatggcactggttatcactaagagtacatttagccatggctcagaagggtcattgttatattgagttaacaatttgcagttgtatttactaattgcagggcttcttgctgcttgccaattagccaggaaaaaacttttttaagacaaactttccctactccaaaataccctttctgctattcccaattcccacatcgatgccacacactataacttttcaattttcaattttaacactactttagaatcctctggttccttctatgtggttctaaatatcagttttatatatacatatatatgtgtgtgtgtatatatttattttatatatatatgtatataaattattttaaaactgtttggaaccatggctttgggctataccacattagggaaaaaaaaaagccagatttttttttttctttttactatcttatcagatgccattatttagggttttttttttttttgtggagaccaggccttgctctgtcacccaggctggtatacagtggcaccatcacggctcactgaagcctcgatttctccagctcaagccatcctcttgcctcagcctcctgaatagctgggactataggcatgtaccactacacccaactttttttctttttagcagagatgaggtttcaccatattgcccaggttggtctcaaactcctgagctcaagtgatcctcctgccttggcctcccaaagtgctggaattacaggtgtgagccactgtgcctggcctagttaattttttaaaatatgattagaacattttattttattttattttattttattttattttattttattttattttattttattttgagacaagagtttcactctgtcacccaggttggagtgcagtgacgtgatctcagctcacttaaccctctgcctcctgagttcaagcggttctgcctcagcctcctgcgtagctgagattacaggtgtgcatcactatgcccagctaatttttgtatttttagcagagatggggtttcaccatattgcccaggttggtctcaaactcctgagctcaagtgatcctcctgccttggcctcccaaagtgctggaattacaggtgtgagccactgtgcctggcctagttaattttttaaaatatgattagaacattttattttattttattttattttatttattttaattaaatttaattttattttattttatttattttattgagacaagagtttcactctgtcacccaggctggagtgcagtgacgtgatctcggctcacttaaccctctgcctcctgagttcaagcggttctgcctcagcctcctgtgtagctgagattacaggtgtgcatcactatgcccagctaatttttgtatttttagcagagacggggtttcaccatattggccaggctggtctcgaactcctgacctcaagtgatccacctacctcagcctcgcaaagtgctgggataacaggcgtgagccaccgcgcccagtcagaaaattttaatttgtgtgtcaggacttagtgatattaaatgactgatttaatgttaagctgttgggatacttcttacagattactggtatatctcatttctattgtaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatgtaagtacatgggtgacttgttaggatttcttttttttccgaaatattaagtaataaatgtgccctttcccccctaaaaacaacattcctgattctatagtatggtgaattttgacagttatatccacattctcctcagcctatagtgactggatttaagaaagcagtttgaggctgggtgtggtggctcacacctgtaatcccaacactttgggaggccaaggcgggcggatcacctgaggtcaggagttcaagaccagcctgaccaacatggggaaaccccatgtctactaaaaaatacaaaattagctgagcgtggtgtcacatgcctgtgatcccagctacttgggaggctgaggcaggagaatcgcttgaactcaggaggcaaaggctgcggtgagccaagatcgcaccattgcactccagcctgggcaacaagagcgaaactctgtcaaggaaggctgatacattggcctgttcaagttgatcaaatctacaaccttgcttattagaattatgctccaagctattgaacagtttgatagttcgctttctgatttttatatttttgcatcttatagatcttgcacatttcccatagaagtgcacactaaagttgctcttgtaaatcgctaactattcataatatttttgttactatctgaagtgagtttatccagttttgcttgctgaggttcttttgagtcagccctgattaaacacacacacatacacaccactcacacacacgctccccttcccttttttatacaactctgatatatgtctcttaggttattttcttggggccattctgttattctcctaaattttaaagaattccaatgataataaagcagaaggtcatgtctagctttataactatttgtatttttcaatgaaattgatatgtaccttgaaaaaatgttaacatgtctggaaatgactactcctcgtgttctttatgttgcagttgggttgcatatgagaaacctggatttaccggtcatcagtatttgctagaagaaggagaatacagggactggaaagcctggggaggttacaatggagagcttcagtctttacgacctatattaggtgtaagtaaaggacaagctaatggctaatacttggtcttctttggataataaatggctagcctttgaattttgaattttttttctcaataggatttttcaaatgctcacatgataatgtacagtgaaaaaaactttggatccaaaggttccagtattgatgtattgggaattgttgctaatttaaaggagactggatatggagtgaagacacagtctattaatgtactgagtggagtgtaagtgaaataatccagttggaattttaaacatgcgttttaccttggtttgttttaaactggtaagagtctatcacagagtaggcattcaatacacaaatatctcaacagcttaacattaaatcagtcatttaatagttgctgtcatgatattttcgttaactctctttaaaaatcgttctcataccatctcttctttttacgtttggggtaggctttgggtatcatgatagaaatctacagatctgtttcccttgtcattctgcacagaaagatagtgaattttttaaatgatggagatcaaataataataatagtaatctaacataaacctgaggctgggtcaaagtcccagtagattttcctgtggtcctacacctgttccagtatatttcttcactattagtttgacataaaaataattgttctatgtacgtggagttagcagttgactgttttattagtggtgaagcaagtttttattgaaagatgtttagtcaagattctttgggatgaagtgactgcaagccaagctaaattggctcaagggattaaaatggaacttactggcttaagtaactaaaaagtcctggagaagattttgcttcaggcatgcctagatgcagcggatcaaacactatcagaacttagtctctgtgtcttgactgggcttttttctgtgttaacttgactttaggtaggccttttgcatttggtggcctgtggccacattcagcttttgttctcctaactctttttttttgaggcagagtttcactctgccacccaggctggagtgcagtggcaaaatctcagctcactgcaacctctgcctcctgggcttaagcgatcctcctgcttcagcctcccaagtagttgggaccacagatgtgtgccaccaggcctggctaatttttgtatttttttttagagacaggtttttgccatgttgcccaggctggtctcaaactcctgagctcaggtgatccacccgccttggcctcccaaagtgctgggattacaggcatgagccaccatgcctggccccagctcatttcttgcagtggaaagagcttctctttctcacaagttccatgtttgactttgctttcctaggcttgggtcatgtgcacatgcctgaaccaatcactgtagccacagagacggccatgtctgggctacgtgtccatctccagagctgagatgtagggtctatcccataggagccacttagatatgaatggggttggtggttccccagggacatcagaaagagtggggagatagatgccagatgggcaaaaacagcagatggctgttatagggagttacataattattcttgtaatccaggctaatgtctattctaatttgttataagtgagagtattctcaaatagttacatgaaataatgtgacattggttatgctgaaagtgtttggtgttaggtttttgttgtcatagtgacatagactatttgaatcatcctagcctcaaccccattgtatctcatggggcctcccacaatagccctggatatttgaaaagtgtgtacaatgtactaaaagttgatgaacatgcttaacttttactcttagtaaatagagtaaaaaaaaccttgttcaacaagttcttgtctaggccgttgcatgtggtgccattttggcagagtatcagtgatttccgggtattccattctcagcaggaaatgcctactcttgggtcctattctggagccctaacattttagaatcagtagcctgtttgcaaaagccagaagtcatctgaaatataaggtacaagttatctgaaatgttgctggggctctgcagtattttagattgtctttaaagctaattatttaggaggaaaacatagtgaccaacttagtctggtgaaacagttgtacattttgatactcaccagttgtgttggttctattagtcagagcctagtcatccaccctggcagaggaagcaaaaggatgctgggtagaatgaattcccttaggtattttgtagatgatgctattaacacaggtagaattattgtgccttgagccaatctcctttcctttttaacccaggccttgcttacttgaaatcagttccctttataaagtgctgctattatatgtttctatttttagtcatttctaattgcatttcctggcttaagcttcttttttctggctgtagcagttaagttttggtagaagggggaagttgaagggagctacgtacacatacgtggacacacacacacacacacacacacaccacttcctttgaaattctttgcatatggaagggcttttgtatttaccagggccaggtgcttcctcatattttgttcgatttgtcatttgacaagtatttattgcggtctgttatgtgcaaagcattgtattatgtcctcaaagaagttacggtatttatgtaaaacataattattgctacaaaagaggtacagattaaatgctctgggaatccacagcagagagagattaatttccagtctggacacagggaaggaagactttgtggaggaggtggcattggagttaggcctgtgggataggataggaaggctgagatgagccaagatgatggaggaggactacctattcactttaaatagtttcaaaggaaaattattgtattttaatggctttatttttattggcaattaagtattttagcttggttctttatttcttattatggcatgcattgtcagaaaaaaactcttctgaagttcttgttccatgaaagtatctcccaggaggctcaccatcacatgggtaatacatcccctgggcagtaaactcatcattagtcctgaaacagagaacagccttcaggaaggatgcccatgaaaccagcaactgaggtttttaggaactgcatttgattcttactggaaatgtcgaaagaaactccctgcttatcagtttctagttctatgctatattcttgctcaaatagtggaaactgggctagttttttaaaactaggagcaaaatgaaatatttctggtattcagatgaaaacgaaaagtgttgttgttttaaattctttttcctttggccttccacggaagggcaggtttaccctgctgcccttatcttctgagcaattattccaccaggctgggacctgctagtacttgtgtacatgcctttcccccgtctccccaccagtctttaaacagaggagtgttgattcatgtgtacagaatacatctggacaaggacagggagggattttcttaagagccccaagtgtaagttgtaagtagactctcggatcatagagcagagaatctcagatctgggttttgcggcttctcccctcccccactccccccattcatgggtgattcatcaggtatcttggagggaaaacaacactactgtcagttcaagtaacatcttaataaattgttttccagcttcagcttcagtgaattagagataggcttagctgggtgttgggtatttacttacaagtagtttagtttcataggaaaatacagtacccatacttgttagtaaaaagaacagagtactggctaaagctgcttccagggctgtcctctctccttggcattcagcctcccacctcactgtcttttttccctccaaaccttgaagtcaaacagaaaggcctttaaccctcttatctctctacttgttacagactcggagccctggtgagaaccctttttttgatgtggctctacttctttaattgttcgttgtttttttaaagtcctagtgtttgtaacgtagattttctttttttttaaattttattattattatactttaagttttagggtacatgtgcacaacgtgcaggttagttacatatgtatacatgtgccatgttggtgtgctgcacccattaactcgtcatctagcattaggtatatctcctaatgctatccctcccccctccccccaccccacaacagtccccggtgtgtgatgttccccttcctgtgtccatgtgttctcattgttcaattcccacctatgagtgagaacatgcggtgtttggttttttgtccttgcgatcgtttgctgagaatgatggtttccagtttcatccatgtccctacaaaggacatgaactcatcattttttatggctgcatagtattccatggtgtatatgtgccacattttcttaatccagtcatgtagattttcttgatgtgcagacactcctcccacatagcagtgctccctgctctggctttactgttgcttcctttcatgctgggggtaaagcctgaggccctgtgggcagaggcagcacatgcgggtacccgtgtgctgtacagcatcacctggtcagcccggggaccttggcccactctcctacttacacttgaaaatacaaactttcacaaaggttaagtgagttcttcaaagttatctgaaagttaatgtcatggccacaggtggagccaggtctcctatctcctcacctctcagtgataaaggataggtttttaggccgggaacagtgctcacgcctgtaatcctagcactttaggaggctgaggtgggtggatcacttgaagtcaggagtttgagaccagcctggccaacatggtaaaatcctgactctactaaaaaaaataaaaaataaataaaaataaaaaagaacaggttttaaaaattgctagtgaggttctgaaatcgggggatggggggtggtagggggctgtatttcctgaaagactgagtggtgcatatagcagcttctccatttggatggctgggagtgagtgcacagatgttggctgttattagctacttctcactggagattttggcagtgttctttttttccttgatggctgttcatattctagtaattactgtacttgagtttttgtttaaatcagccctttggatagtaaaatcataatctgctctaattataaagtgtgtggactgttttaggcatggtttactagaacagtaaatgaaagggaactttccagggcacatggcaggttgggtcacaaagcaaggagagcctggtgggcctcaggacaggtaggttcagtcacgttctggccaatagtcgattgtgtcaccctggacaagtcatttcccattcaaaacaaataccaacaaatacttccatgtgatgctgcttacccatctgtgggctttggaggacagagattttgtctttttcatctttgtatatctagtgccagtctagttcctggcacctggtaaatgaattaacttactgtgtcttaggtttttcccatctgtaaaatgggaacaccaatacctccctaggagattaaatgtgataacagatgtggaaacattttgcaaagttctgatcaccctacataatacatacatagatattattcctttaagctttgagaggatcatgagaatgatgaattaattgaaaagatacttaatgtcttcaatataatggtattaagtatctctttaatataacagaactgaaaaaccttttcctttcaaagactttatctttgcataggaaatagcatcattaaattggttttgttgattttcctctgggtgtagatcacttaaaagagaaaaaaacattccaaaagagatttatttttagtatttctatgagtttgctcaattttgtttatttaatttttacatatttatgtgatgttggaaacactgttggaaacaatattttagttctgttctgcatttttaaaagcatttcttctgttaacttctttttcagtgtggtttgttgtgtaatagacacagcttcctaagatctttctgcaaaaatattttaaggttgagaatgaaaggacttattgattgcttattaaaagaactaggttcttcttgaaagtcctgtttgttttgtttccttagaatacaattagaaaaaaaaaagcacagagaagtattgcctttgtagctttctcaagaaatagtatttgataagcgagaacgccaaaaagttcatgtcaagatacccttacgcttaccatttcttttgcattaagttttttttcaactcttattttagattcagggggtacatgtgcaggtttgttacatgggtatattgcatgatttcctgaagtttggggtacggttgaacccgtcaacctgagcatagcatgcaacaggtagtttttcaaacccccctccctcctggccccttttgtagtccccagggcctatttttttttcttctttatgtccatgcatgaccaatgtttagctcccacttatgggcaagaacatgctcataagtatatgttcttgctcataaatatttggtatttgattttctgtttgtgttaattcgcttaggatagtgacctccagttgcatccaagttgctgcaaaggacttgatttcattcttttttatggctgtatagtattccatggtttatatgtaccacattttctctatccaatccaccattgatcaatgaacacctaggttgattccacatcttgatattgtgaatagtgtggcagtaaacaagacacgtgcaagtatctttttggtagaataattcgttttcccctgggtatatcccagtaatgggattgctgggttgaatactagttctatctttagttctttgagaaatcttcaaactgctttccacagcagctaaactaatttacattcccaccagcagtgtataaatgttccctcttctctgctggcttaccattctgatttgtcctatagacaaacccatctgcttctaaaggttaatggagaatcagaaaaattaaaatttcaattggcaaaacaaatgaaagtttctgtatgatacatagatatccaaatatgtgatcgttttatatgtaaaatatgaactccaacaagtgattgcttttgtttcttagatgggtagcctatgaaaatcctgacttcacaggagaacagtatatactggataaaggattttataccagttttgaggactggggaggcaaaaattgtaagatctcttctgttcaacctatatgtttggtaaggagttatatttttgtatgagaatatttaactgaattctggatttccttaatgtgtgttcctggttcatgtaatagtaattgctatggaaaatattctgagtttatttttagcagtaattgctaataatctagaagaaaaaaactttttcaatgtgtttgttctattcatttccttttctccttcctttaaaaatttttaggattctttcactggcccaaggagacgaaatcaggtaactttaaaaatattcttttatattaatatataaagggccttccattgaaaagctgaacttatgtttcaaatgtcagacatttggggccgggtgtggtggctcacgcctgtaatcccagcactttgggaggtcaaggcaggtggatcacttgagctcaggagttcaagaccagcctgaccaacatggggaaaccccgtctttactaaaaagacaaaaattagctgggtgtggtggcttgtgtctataagctcagctactcaggaagctgaggcaggagaattgcttgaaccccaagaggcagatgttggagtgagccgagatcgcaccactgcactccagcctgagtgacagagactctgtctcaaaaaaaaaaaaaaaaaaaaaaaaaaaaaaatcagacatttgggacattttgttagttttactcatttttatgcctgaaagcataattgtatttaaaaaataagatttaagtttactttaatggttaattgacagtactgacccatgtctaaataattcttataaaatgcttattgtataaagctgaattttatatcattacattgactcagtttatattaatacattgagattaatatttcaaacaatagcatctagttattgtgatggtaaaatgaattttcatatttgctgtgtcgacactagacattttttatggtctcactcaagctttctgaatgctgattcttaacatcaactggggtgtacatttgttatttcggccttttaatggaagtgttcacagagccataattatagaggaacaaacaccactatagcctcctttattggcattcacaggattccgataagtcagcaagtgtcttccattgagaaggaaggaaactacactatgtctttccaaaatactgtttgtcgttaatgtcagaactgatgaacaatgatttctgaccacaataaagctttaaaatacctcacagcttcacaacagggtgttctatagaaagttacctttgttgttgcattttactttgatgtctctgaattaaataaatagtcacgaatggcgcagctaacatgtttctaattgatcatgaatgtagacatggaaaattaaaggatttctaaaattcgtaccagtttactgtaacaaaagtcagcaggtcatgtttaggtcatcatttcaaaggctaaattagttaatgtgtttaggaaaataattttatgtgtttctgtttactttttcaaagattcacttgttttcagaaccacagtttcaaggtcacagtcaaagttttgaagaaacaacaagtcaaattgatgattcattttctaccaagtcttgcagagtttcaggaggcaggtaagtgaaacaaaggcctggcagagctgaatcactggagtaaaacagaattcacacatcagcaagtatatagtgatgcctgttaggtgcttggcactatgcgaaaccaccatcttagtccaatggcgtgcttcgtgatatctgagtaccagacgccagaggacacgggcttcaggttggttggagaagctgaagatcatctcattgtgtaatggaattcagagcaggttctttactctgtatgtcttcccatcatctagaaagggagagttgggctctagttaatccaaggtacctcccaaggtggattgttcaaaggacaggatcggcactctgcattaacaggaaggtagaaagtacacgctggagtggagctggtggacacgcgaatcagggagcataccagtccggcttgctgggagggctttgtactgggaggagaagcaaagctgagcacactgagtttagatggcttccacaggaaacacaagacccagggcaaaggcaatgggctcaattgtttcatgctgaaacaatccttgtacaaaagcttcatggagaggggagagcccaaggtcagggaaactcggtcaggaaagccttggagcaatctgtgcaagaggtgttgaggatttaagtctcttaataatagtagtaatagtgcctttaatcacgtggttctttatggttgaaataatgctatcctgtcctttagtattgcacagcaaaaaagcactgactttgcattcaaatacacagatggaggccgggtgcagtggctcctgcctgtaatcccaacacttagggaagccaaggcaggcagatcacttgaggtcaggagatcgagaccagcctggccatcatggcaaaaccctgtctttactaaaaatacaaaaattagccgggcatggtgacacacctgtaatcccagctacttgggaggctgaggcaggagaattgcgtgaacccaggaggcagaggttgcagtaagttgagatcatagcactgcactctagcctgggcaacagagcaagactgtctcaggaaaaaacaaaaaaggcaaatacatagttggatagtaaagcttcctagtttgttggacatactgctaccacatccccactcctcgttatcccctgcctgcttcatttattacctccagtcctgtgcatgtttaaaattacctgtctcagctcactagagtattaacttcaggagagcagggactttggttctctgctgtatccccagcaatagaaaagtacctgacacataatcctcaaaaggcatttgttgggttaaaaacaacaacaacagggccaggcacggtgactcacacctgtaatcccagcactttgggaggccgaggtgggcagatcaccaggtcaggatttcgagaccagtctggccaatatggtgaaaccccgtctctactaaaaatacaaaaattagccaggtgtggtggcatgcacctgtagtcccagctactcaggaggatgaggcagaagaattgcttgaacccaggaggcagaggttgcagtgagccgagatcatgccactgcactccagcctgtgtgacagagcgagattctgtccccccgccaccaaaagaaaagaaaaaaaggaaaaaaaaaaaaaaggcccacaaacttctaggggagcatggcaaatcaccattttatgaataatgttgataccagagaggctaagtgacttgtctaagtcaatatagtattttgactcctggcccagtgcagaggtattagaaatgaggatagaggagtgtgcgagaaattttggaaggaaatcaatagaccaaatcaataggccttggtgattaactagtcacaaagcttgaagaaggattattcaaaaaggacttgagggcttgaagctccactggctgggcaaacggtggcacccatgagaagagcaaggaaggctggaggctggggaagtcagaaagaacgtggagaaagaagtttgtttcccaaatgcaaagttaactgacttattatgaatattattttgccacaagcagaaatgcaataaatatatccaaatatttttgaagaaagaactctgtttgccagaagcattgtgtttattttatagcaggccacctctaaaaatcagacttcttgaataggagtgctcaagttgcatattctgtgcatgtgtgtggtttttcccattgtagctgggttgtatatgatggagaaaatttcactggtaatcaatacgtgttggaagaaggccattatccttgtctgtctgcaatgggatgcccgcctggagcaactttcaagtctcttcgttttatagatgttgtaagtatgtcattgtgaatagtgttgcagaaatgtatgcctcatatagctgatggtcagagtgaggtaaccagccggtagaacctgctcttaaagttagttaagggcttggagatggaactgtccatttggctctgtgtacatctagtttattgattctaactggtacacgttttccaccaccctgttttactcacttaatcctcatatgcatatccctatggacctgagtgggagtctcttggactatatattaggagtagaattactggatttcacatgtaagaacaggcagtttcattcagtactgccagatcccaccacttgagactcccaccagcagtacacattgttgccattactgaatattctctcattctaatttttgtcaacttgatagaatgagcagaaagcagtatgtcgtcattgggttaatttgtatttcactattagtgaggctggtatctcttatttataatttgcattttctattcaaggaattgtgtattgtatcctttgcaatttggcttcctctacctttggttgttattattgaagaaattccttataggtttttagtctattattattctgtgttttagagatttgcaatcaaatgacttctcccagtttgccactatgtgctaatccagattatagtgccctcttttggacagaagtctttcagtttgatgtagtggaagtaatattcaatagaacaaaactgcaagatcatgttgagatattaaagtctggaagtatctgtcgtttctgacatttttattagtttttggtaactgctttctcataaaaagctttaaacacacgtaattgctcattttagttttaaatgtaggaagaacgtatgtgagttggttttcatctcatccctgcctgcctgtttaaatagcaaaaatgctactgagacatgaaaatagtaacaaagaaacatgaaatgaggtagtaagattcattagcttacaagtaatgaataagactttgattgttattctgcctagaattctaaaagctacctacaagtatatatttgaaaatttcaatgccttccctcaaccagaacttggcatatatgctcacaacactctgaggctatagatgacatctttttatgttttaattgtgaggaaatgaatgttttacccatatgaagactacatatctttgtgacttaatacttcaaaattatttaattgctttttaatactaaagtgtttagaacatttttgggcttgccatctcaaaagtgcaataaaagtgcaaagtagtaatactactataatttttgtcttctttcctccatgtatgttttatataaactaattcctagaccacacaaactacttctacacactaacatgctctgtttactgatggacaaaatctttttaccagtcaggacacatccacataaatgaagcagtaaggtaccgcaccctttccacaaactttaagcaggatagggaaaaaattgtaatccccacatgcttttattttttttttttttgaaatggagtctcactcagttgcccaggctggagtgcagtggcatgatcttgactcactgcaacctccgcctcccaggttcaagtgattctctagtctcccactcagcctccaaagtagctgggattacaagcatgcaccaccatgcccggctaatttttttgtgtttgtttgtttgtttttgtatttttaatagagatggggtttcaccctgttggccaggctgatctcaaactcctgacctcaagtgatccgtccacctcggcctcccaaagtgctgggatgacaggcgtaagccaccatgcccggcctcccacatgctttttaatgcatcatttatgatcttagcagtactatcattagagattaatgtagaatcaaaagtgtctataatttgaaaaaacaggcataagctgccaacttttcattttcctgaacagtgaacgtttgtgctgttgtcctctttaaaatgattgacagtttgaacatagagcttccatcctgttgttttttttctctcctcttgacaatgattcctacaggaaagtttgggagcatgagtacacagaatcattgtcttagtgatgaacagaaaaaaaaaagacatttgaaaatacatacaagaggaaggttccctgattaggcaataccactgtacactaagtgactaaacatcagatgccacagccctctgacccttggcaattatgtccatgactttccagcccctccttgtcccagtgaaaatggctaagtcaaaaataaatgccatcagaagtgttgatattcccagcgtatacccatttctcttttttttttccccctgttttacaaactatttatatttacctgccttcctatgcaatggagaaactaactgcccctctgtgctttctctctagcttggagtacacaaacatccaggctcccttggaaaaggagtttatggaaaggccaaatctagcagattttttgtgctttgtccttgtaacaagatgattttcacataagtttgaattattaacaaagatgaataacagaacattgtttttgttcctcaacaggaattttctgaaccaacaattattctctttgaaagagaagacttcaaaggaaaaaagattgaacttaatgcagaaactgtcaatctccgatccctgggattcaacacacaaatacgctctgttcaggttattggtggcatgtgagttacctacttgttgactcaataaaatagatcattttaaaaatcaagtttgggctgggcacagtggctcacgcctgtattcccaacactttaggaggccgaggtagaaggatcatttgaatccagggattcaagaaaagcctgggcaacaaagtgagaccccatctctaccaaaaatttaaaaattagccaggtgtcgtggcacatgcctgtggccccagctacgtaggaggctgaggccgaaggatcacttgagcacagtaggttgaggctgcagtgagccgtgttcacgccactgtactccagtctgagtgacaaagcaagaccctatcttaatttaaaaaaaaaaaattgatcagatttctccctctcttatattatcttaaactaattgacatataccctctctttttgtaagggttaataattatgcacctttgtagaacacttttccactgggaaaagtcatatgtaaagcatcttttatttcattatccagatttttagtttatttaaggtaaggattttgtctttaacacctctcatagtctagcaagtaagaaagagctgactttacttatccctttaaaaaagagcaagtcctctgattttggagctcagggttgggattttcctttagctgggaatgactggcagatgttatacaaatgattaaaggtcaacttggaaagatttttttcccctcaacttcgaatacttttgaataagatataaaaatgaatgagtaccatcaatgtaatacatgtttttaagaaagtatttttcttttattcacaaaaacaataggtatggtctacctgtgtacaacagatgttggggtggactacatctatttaaaaaataatcaggccgggctgggtgcagtggctcctgcctgtaatcccagcactttgggagggcaaagcgggtggatcacctgaggtcaggagttcaggaccagcctggccaacgtggtgaaaccctgtctctactaaaaaatacaaaaattagccaggtgtggtggtggggcccctgtaatcccagctactcaggaggctgaggcaggagaatcacttgaacccaggaggtggaggttgcagtgagctgagatcacaccagtgcactccagcctgggtgacaagagtgaaactccatctaaaaaagaaaataaaaaaaatcacagaagctgggcgcagtgactcacgtctgtaaccctagcactttgggaggtcaaagtgggcagatcactggaacccagcagttccagacaagcctgggcaacatgttgaaaccctgtctctattgaaaacacaaaaattagtcgggtgtggtggtgcacgcctgtagtcccagctactcaggaggctgaggtgggagatcacttgagtctgggaggttgaggctgcagtgagctgtgatcgtgccactgcccttcagcctgggcaacagagtgagacctacctggaaaaaaaaattatagaatattagggtggtagaattatgggtgatttttttgcagtaggttttaatattttgtttttatgataagatgactaaaatgataaaattttatccaggatttaagttccaggattaaaagtagagtgcattcttccctgatgtaatatgcaagagaggagggcgctgggctgcttccacgccagtctgcgcttaaacccatacttcctcaggtgtgcagcagtagcatctgagcggaagggaactgagtatcttagcagttttttagatttaacaaagattactctcactgcagacaaaactttttatttaaccctatttagcacctactaagagctttggaaatattaacaacttaaagacccattattacaactgaagctattttatgaatagttcccaggaagaactgaggaatccactaaaagacaatatttcactgctttacggaggaaaaaacttacctatttctcttcaagaatggaactttttggcataagtactcatgtaacaaaaatttgctatttgtcaagaaattacttcttttaagtgttctagaaaagatcatttttcccccaatgtatgttaaaagtatatagttcagtctagaaatggaaagcattctaaaaataaatgtaattggggtccactgtcaaatgaaaattgccacttactgtggttatttttgttttcagatgggttacttatgaatatggcagttacagagggcgacagttcctattgtcacctgcagaagtacctaattggtatgaattcagtggctgtcgccaaataggttctctacgaccttttgttcaggtattttcttcctctccatgctctgcatagactcttctctgaaatttttttgtaaatgcaatccaactttttatccaatttttttattcaaagtttataactggcctcaccctataaactccttccctgccccaataatctgggctcagtttctggtgctaagaggtgtggctgcttcagaaggccatcaaactgaacatcaaacgcagttatccacaggcaggcaccctgcctcaggcgctttgacattttgtcaaactcttctcattgagaaaatttaaaacctctgagactcttgagtatggtaattacccttaatccatatctcactttggattcttcctgatattcatgcttgttcagtgcttccagcagcacatctggtataacaactgctgggggttttgtcttctagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcagggtgagctttaggattccacgggggcctgtgatggctttgctaggaggtgactcatcctttcatatgcttttgatcttttcttcaagtagatgcaatttcacaattcctggagtactttcagaaatgaatttgtttttttcatgacagtatatcctagctctgatagaaccagtctaggaacttaaaatgaaaggtaaatatagcactgatccaagatagaatatttatttctatgcttgatttttatatagtagtagaaaaaggaagtgtgttattcttccctttttccttaatgtaactgttacagaaacaaactataagctccagccctgtcaacaaaaatcactcttggtttgttttggggaaatccacagaacgggatgaagggtaaagagatccctctgtgtgctgcacagtccatttcctaagtgtcatacgttgtaaattagaaaatggcccatgtccctcctgcatcattcctactattaacagacacttaaaagctgactgtagtaagatttttatgaaagaagctcatgcttctatggtagataaaacttttttactccttgattttgtgagcttgaccgttggctcctgattttctttaaaaaaacaaaacaaaacaaaacaaaaaaccaaaaaaaacctggtgccccgtgagtcagcagaaggaacacagccttgcgaaaaggagtacaactcgttaattgggtctgttgtgctggagggggaattctttcagtaaacagaagtactgtttggacatgcatagaagaactagcaggaggaacagaagtagttgtaatatggaatcatgaaaagaagctttctgcctttgaattgtcttaatccaagaaaatggtgtctttcagcagttatttctaacagacatttcagtgatgttatttaacaactttgaattcaataggtcaatgagaaaaagtctcctagattatcacagtgctttcatctcaatatagaataatatactttaattttttttagacggggtcttgctctgtcaccaggctggagtgcagtggcactatctcggctcacttcaacctgtacctcccgggttcacgcgattctcctgcctcagcctctcgagtagctgggactacaggcgtgtgccaccacgcccagctaacttttttgtatttttagtagagacggggtttcaccatgttggccaggatggtcttgatctcctgacctcgtgatccacctgccttggcctcccaaagtgctgggattacaggcataagccactgcgcctggcctacaataatacacttttaacaggcatttttatagcaacattgttttgtttttgtgtttgagacagagtctagctctgttgcccaggctggagtgtagtggtgcaatcacagctcactgtagcttcgacctcctgggctcaagggatcctcccacctcagcctcctgagtagctggggcccacaagtgcatgccactatacctggctaatttttaaaacttttctgtagagatagggtctcacaagtgatcctctcaccttggcctcccaaagagttgggattacagttgtgagccactgtacctggccagtaatttttgttaatggcatgtgaacatgactgccatacattatttatatattaagggtagattcacttcagggaagggctcataaaatctttgcattaaaacaccctctagtgagtctgcatttttctgttttcatagctggaaagcatgcctgtttagaaaattttaattctcatgaaggaaagacaaatgctaataaatgcaattccgagttttaaaatgataaaatgccctttagccacccagtgctacaaaattagaggtgcagtcatatactggaaggtcaggccaagcagaggtggagatgtcagagggagatatagctacagaacctgcctgggatcatggtcacttatgacagggaaaaatatgatgggcagttctaatgttatgaggctttccctactagtaagatagtcttgcaaagggcagaagtctctgacgatgcacaaacattgagattttcccatcattcgtgtcatctgaaataaatggcataaatatttattgtccgattctagttggctaagagctgaactgcctcatgtggggtaaatgaagctaggaactaagataattttaaagcccaatgtaaccagagaaataattgctatgagacttacagctggatacatatttaagatatctggtcttttccactgagcagatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaaggtaagggtcacttcctttattttctttattgtaatgtgtatgtcttttagttaaggaaaaatctattcataacttttgaaaatgatgaatgtattattagtagtaacagtaagagagcccctactgtgtgccagctgctgtgctagccactttcagtacaccatgtcccgtcatcttcacagccgccctatgaggcctacattatcccctctccctcttttctccccagttttacagacaaaacaacaacaacaacaacaacaaaaccccggaagctcaaaggggttggccagtttggccacaatctcacagctgtaactgctgaaccagaatctggccataggctgacttcaaacatttattttattataatagtgttaggctaaaaatcacaagctgaaaggccgtgattgcacttagttcggtagagttgatgattctcatgtatacacgtgacctttcattgaaaagatctaagatctcaaaggaattaacacagcctacaggatttcaatgcaacatgtgttcaatgaagctaatagggagtgaactgatggtgcttgggggagaataaatttagcgtggttgtcctcaaactttatttgcatcagaatcacctggagggcgggttaaaatagactgtggggccacatcctcagagactgagtctgtaggtctggggtggggcctgataattccttttctaacaagttcccaggtgttgccaatgctgctggtctgaggcccacacccggagaaccactgatagtcatttaaaaataacataagaatgacctaacctctgtgtgggaactcagtgaactagtgtgttgctattgacaggtgcagatggtgtgttcatgtcatctggggtaattctgctttaaattaatgggcacttttttattccctatcaggaaagtcagcacaattgtgttttgtagcgaactggtgataatgtaaccatactacatactccattaatttttttaaatttttatgagtatattacatactctattttaaatcatcactacaaaatgactcaattttactttaatcagggatttaggccaatgctgtcattaaagtttatgatgtaggggtaaagagccaggtgccgtggctcacgcctgtaatcccagcactttgggaggccctggtgggtggatcacgaggtcaggagatcgagaccatcctggctaacatggtgaaaccccgtctctactaaaaaatacaaaaaaattagctgggtgtggtggtgggcgcctgtagtcccagctatttgggaggctgaggcaggagaatcgcgtcaacccgggaggcggacgttgcactgagccgagattgtgccactgcactccagcctaggcgacagggcaagacttcgtctcaaaaaaaaaaaagttgtagggacaagaaagtgctgtaatctgatttttaaaaaacaacttttctggataatggagaacgaatctggacattttcatcaggggctttggtaactgtatggggagcaaaagtggctgtcacttctgaatgatctccaggtaggtagcttggccaacccacttaaaacaatggacttaggatcagacagaatctgagaagttggaaagatgctcagaagcaaacaatgcctttgccttcattaaagggggcacttagggaacacaaactaagcactgcaactacaggctggatggagaccacaaagatcatataaaatgcaagtagtacccttggatataagaaaataaatgcaatattcagaaaccaaacagtaacatatagtacagctccctcaccttacatttggtacaacagatttgtcaatatgtagacaggtgaaatactcattttatagatgatcaacctgaggttcaaactagttaagaattatgcagatctttgtttattcttattttgataaactttattgcactagagtgcttcagtgttgacaagagtttcaaaatctccagagacaccaaagaaatgtgactcaattggaaaaaatggagtttttgacacaatgttagagaaagtagggtatgtagttctcaaaggaaatctgaccaaaccttcctgttttttacaaatgtgatctgcttcctatgtccagggtggacaacactatgatccttagctagagctttcttctcttattctttcaacatgtattcacggggtacacactatgtgccaggctcggtgctagacacggagggcaccagcgtgaaaaaaaaaaaaaaaagcctcctccttggcttcagacagtttacgttctagatgcgctaggcacacaggatgtccctgacttgttacattagcagcggaccagaaggaaggacacctcactccttgtcttggctctgacatgaaccgtgggactctaggtttcttaagacttctttttaaagctccagagccccttcctaaatgacactatataaattactcaagtgcctgctgagtaagcataatgtcccgtatatttgtgaaatctcagtatctagcacggtagcaacaacagtctttttttttttttttttttttttttgagacggagtctcactctgtcgtccaggctggagtgcaatgacacgatctcggctcactgcaacctccgcctcctgggttcaagcaattctcctgccttagcctcctgagtagctgggattacaggtgcctgccaccacgcccggctagctacaacagttttaattccttgttaaactgaatttaattttctcagactgggagaatggtgccatcttgtggacatgagagagcagcgccgcacgtcccacaccccatgcaaaggaaaatataaacacgtctcttctcgttggtgcacttactagcagaccatgatttccattagctacaactactgaaccatttgttatctattaaaattgccctaagaattattagatcatgcatctgtcttctagctcatcttcttgtgtttgggaaatgagttcttttggtagacattcatgtattattccagaccacataccttgtaacaacagtggaagctgattcatgttcactttaaaaaacatgaagtctgcacaatttaaacactctccaaaggcaagagaatgaatcaaattatttctcaagaactttctagttttcatgattctagttgaatttatatgaaagtattttaagatactttacttttaaaatacaaaagatactcttaaaatacaaaaagtattttaacatactataatgaagaatgaaaagagacattgtgactttaatacttcctgaaatttcagtggagtatgctgtgtgtctctgtctcggcagagtgtagggtttgctggtagttttttccctactgctacaaacttacacataaaggcccaaaacaccttacccttgtattctatagtacatctagccatacatctagctgtgtagaggctgtagattaccaatgatgataaatcagtgtctcacaagagaagagacgatttccttcctcaactataatacctagatttattgtgtaaattcccaaacctttttcatattttgtaaatgcttcaaaggtgaaaagaatgtttatttcttcttgatccaaggaggaagcatgctttcaataccagtcactccctgcatcaaaatgcacagatttttactttgatggggtctttgttgatacatccttggtgctgaggtttatgctaaaaaaaggataagccatctgaagggatctttattctacactggaaaaaaaaaaatcagataacccttttgttaatgatacttctccaaagaaagaagccatgaggctgtttttagcactaaagtatctgaaacatccagtaagcacctttggaaaatcttacaaacattctggtaacagggagagagttcatgataatagttttacaatactgtggtactcagcatcctaaatgctatgaaattttatccaccaactgagtccccagtagtgacaatgctaccgcgtccccttatgtacttccgggtgtcatccaaacctcccctttgacctaatacagcccgttttcattgttcatgcaagtgctgttcctcgataaccattcctcccacctttccaccactgccaggactacctgctctttcctcgctggtgtctcgaatctaccatctcaccaccaaatatatgttagtctctttactccttttcccttctctcgggttttcccagttcccttgaatttcagacattgtaagagtgactgtggactagctcttaagaactgggtagaaaaaggagcccgtgaggtgggatgtcctgtgtgaaggtgctggtgccccaatggtgggatctggacagattcacccatggcaggttgaccctctcatcccacaggggcccaggcttccctccctgccttgcctccttgaggcatgcagttctacaccttgtttacttgcttacttttgctgtactggtgttaggggaattgtgtctgctatagacccttcaccatgggtacattcatcttttattattttcctttcttttagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgatgaa

SEQ ID NO: 1525 - DNA, 24878 bp, Homo sapiens
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgggaccccggggtttccggcaggtgggcggggactgggcaggggggctccccaggccggggtggtggcttgcgtgtgctcggggtaaaatgaggagccgagctagagggagaggcagtacttgtgtgagtgcagggtgctgcgccgcccccgccgcccctttgctgactatactggtatgaaaacttgccctggctttcctgcctgagctccgcgtcacagcggaggattagatttcttaaaaacctgttgatggcctctcattttaaagcttgctccgggcctttgtgtaactaaagggattctcccgattgtggaagggctgttgaggggcccagagccataggtcaatctctgcttgcaggtgccctggaagaagggacgtcagagggtcagttgtgcgggcgctcggcccggcctcagacgggaggtacctgggagtcacagtggtccaagacctcgcagcctggtgtgtgttttggaaatgggaacagttgtctgcgcgagacacaccctcccagcggacaaatgcatgattcggtttctgtccaaaagttgatcggtacattaaaaccctccaaaggcatgtttcacatcatggaagctgttagggaaataatttaaaatatcatatctgccatccaagaaactcctgtccacaattgtagaagagagctaaacagcttcattgttgaataagcacaaactaaattgcctcacacatcacgggcaatttgctaatgggatagcaggaagaattctaattcctttaaatgtagctggacagatagaaccgatttcatattacatacgtgttctcaagataaaaaataatttgtccttaggtaagaggacttgacagtaccatttgctacatgtagtttatcctgaatttactggtaattggggtggttgttatctaattgcctttatccagaggaaaaataaaaatatctttatgatgtggaaccaggtgcccaggctaaaaactcacagagttggggagattggggatctatcttcctggaagagtaggtttcaaagagtacgctttcgaacagtaggctccaaagcttttaagaaagtctttcttgggctgtaaaactggccaaatgcttatttcacttttaaaaagatttacaggctgggtgtggtggctcacacctgtaatcccagcactctgggaggccaaggcaggcggatcatgtggtcaggagttcaagaccagcttgaccaacatggggaagccccatctctactaaaaatacaaaaattagccgggcttggcggtgggtgcctgtaatcccagctactcaggaggctgaggcaggagaatcacttgaacccaggaggcagaggttgcagtgtgccaagattgcaccattgcactccagcttgtgcgacagagcaagattctgtctcaaaaaacaaaaaacaaacaaaaagatttacatttgtatcaaagaagcagaaaaaggagttttgttttgttttcagacagggactccctctgtcacccaggctcggtgcagtggcgcaatcacagctgcagcggcgcaatcacagctgcagcctccacttccctgggctcctcccacctcaccccactaagtaactaggactacaggtgcacaccgacacctggctaatttttccaattttttaggagatgagttttcaccatgttgcccaggctgatttgaacttggcttaagcagtgctcctgcctcagcatcccgaagtgctggaattacaggattgagcctcctcacctggccaataaaggatttttaattacaagtttgcacgagggaatgctttaagaaaaagggagtggaaggggaaggtctctctcacttttgccactaggtataattcagctttttttttttaaagatttgtatgtacccttactgtattagtccattttctgttgcttataatagaatatctgaaactgggtaatttattaggaaagaaatttatttcttagagttatggaagctgagaagtccaagattgaggggccgtagctggtaagggctttcttgttgtggcatagggcatcccaaggccagaggggcaagtgtgttaacatgctgactcaggtctcttgttcttataaagccaccagtcctgctcattaatccatgaatggattaattcattcatgaggacagacccctcatgatccagtcacctcttaaaggccttacctctcaatactgccacattgggaattaagtttcgacatgagtttcgcaggagacattcaaatcatagcatttacaaagcctaatttgttgtctttgcccatgtcagagatatttttgtataagtacattgggaaggtgtcctggactcagatatcttctcagttatactgactcaatctgatgaatgtggacagtcttttaaacttaacagttcccataatcatcattatcttaggtaaggcagcttaaaaaataatttgctcacagtcccttcttcctgaagctactcctttatcattgaagaagacttgagaaatgctcatttcatcatcaatatggtttggctttgtgtccccacccaaatctcatctttttctttttttttgagacggagtcgcactctgtctcccaggctggagtgcagtggcatgatctcagctcactgcaaccgccacctcatgggttcaagcgattctcttgcctcggcctccggagtagctgagatgacaggtacacaccatgtgcctggcgaattttttttgtatttttagtagagacagggtttcaccatgttggccaggtgatgtgcctgccttagcctcccaaagtgctggaattacaggcatcagccactgtgcccggcccaaatgttatcttgaattgtaatcccataatccctacatcgtgggagggacccggtggaaggtaattgaatcacgggggcagttcccctcccctccatgctcttctcgtgatagttctcaggagatctgatggttttattaggggcttccccctttgctctgcactccttctctttcctgctgcctatgaagaaggaagtgtttgcttccccttccaccatgattgtaagtttcctgaggcctccccagccatgtggaactgtgaatcaattaaacctctttcctttataaattacccagtctcgggcagttcttcatagcagcatgagaatggactaataaagtcatcatcacgcttagatttcagaagatgatcttttgttttttgtttgttttgtttttgtttttttttgagacggagtcttgctctgttgcccaggctggagtgcagtggcgatcttttctttgttttaaactcacacctctaatccctttgggaggctgaggtggaagaatcgcttgagcccagagttcaaaaccaggctgggcaacatagtgaaaccccatctctacaaaaaatagaaaaattagccaggcatggtagtgtgcacttgtagtcccagctactcaggaggctgttttgggagaaacccttgagcccaggaggtcaaggctgcagtaagctgtgattgtgccgctgctctccagcctggacaaaagagcaagactctgtcttaaaaaataaaaaataaaataatttttgtactaacgtggtttgagagcattgaaaaagacggaaacagtcccaattcatccaacaatctaacgtcataacctgacaaggatggtaagaaaaactataaatctgtctcaactatgaataaagatataaaaatcttaaaatattagcaagtcaaatctatcaggggattaaagtaataatataccaaggccaaatggacatggaaggaggagtcatactagaaaaaggaaaagccacatgatgacctcataataaaaaggcattaaaatatttctttccatagctgaagctcggggaaaaaaaaagaaaaaaaattttatcatttctgataaaaacttgcagcaagtaaggaataaatagaaggaaatgttcttaagttgatcaagtacatccatcaaaacccaaaagcaaatatcgtatttaatagacacactagttagtagcatccttatcaaactcaagaacaagagaagggtgtctgctatcacagctactattcaacgttcttctggagtcatagcttgataagaaaacaacatgcataaatattggaggcagaattataatcgtaggtggcataatgatttacttggaaaaatccaagagaattaactaactactagaagcaatgagtttaataaaatatcttgagtacaagtaaatatacccaaatcaataacttcttgtatacatgcagtaacaattcaaaattttaattgaaaatattttatttgacagaatgagaccctgtttcaaaaaatatatatcattcatgatagctataaaaactttaaaaattaggaattcactttaaaaactaggagttcctgtagtgagaagataattttactgaagggcctaagactacataaacaggcatattgtgttcccagttggaaagattctgaaccatgacagttatcttgaaatttgtcttgctacgttataatgtggtagtcacttttcattccctttgagaattctaatttctccttgatttactggaggagaccacaaaccaccgagcctaagattctttcacagtcttgttggcacagagctagatggaaagtagaacacatgtttgactcctcacctgtgtaatagcagtccaaaaactcaccagtggaagagctgagtatttgatgatcgccctcctgtaaaatttttagagttttaagttttacatttctttactaaaaagttatacatggtttttgttttgttttgttgttttgagatggagtgttgctctgtcgcccaggctggagtgctgtggtgcgatctcagctcactgcaacctctgcctcccaggttcaagtgatgcttctacctcggccacccgagtagctgggactacaggcatgtgccaccactgctggctaatttttgtacttttagtagagacggggtttcaccatcttggccaggctggtctcgaactcctgacctcagcttatctgcctgccttggcctcccaaagtggtgggattacaggtgtgagccaccgtgctgggccgataaatggtttttattagaaattcaaagagaatatatagaattaaagtataggctcattattttattttttatttattcatttattttttgagatggagtcttgctctgttgcccaggctggagtgcagtggtgggatctcggctcactgcaacctctgccgcccaggttcaagcaattcttctacctcagcctccggagtagctgagattacaggcatgtgccaccatgcctggctaatttttgtatttttagtagagacagggtttcagcatcttggccaagctggtcttgcactcctaacctcgtgatccgcccatctcagcctcccagagtgctgggattacaggtgtgagccaccgcattcagctaggctcattatattaatatactaggaggaataatggttgagaggaaagagtaatgtaggagtaaaaagatctggattctaaagccacttttgctattattaatcagctatgtgtcccattaatgaaaataatatactagtcactttaaatattctaggtacaaaagtgctttgaggtaggcactattaactcccacttagcagatgagtaaactgaggctgagagagcctaagtctcttacctggtaagtagcttatttgggaatttgaactagacaacctgaccccatagccttggcttagttttaactaccacattgtgcctcttcccaccaagtgagaattctgtgatacaacaccgtgaaattttatcgttagtgatttaatccctagaaaaattttaaatggctatttataaagaatttatacatctataagctttctcttttttaaaaacaaaaacaaaaacaaggtttcattactgtcacgcaagctggagtgcagtgatgcaatctcagcttactgcaacctctgcctcccaggctcaagcaattttcccgcctcggcctcccgagtacctgggattacaaggcatcctgcaccacgcctggctaatttttttctgtttttagtagagatggggtttcaccatgttggccaggctggtctcagactcctcagttcaagtgatctgcccgcctcagcctcccaaagtgctgggttcacaggcgtgagccactgcacccagtctataagctttttaaaaatgacttcatgagataacatagagtggtatgattttgaaatatctcaaatatggatgagttaaatttatcacatttctgccatgcatgtgcacgtgtatgtatgcatgtgtatatgaaatcatacaacttcagggctgtgtaggaaactctggagccagttacagtattaagccaacccttttatttgcagatgagaaaactgagacccccaaaaatagtaagtgacttacttgtaactttgatttttcatttctgtggtttctgctactaactacccctgtgactttaggcagatccttgaacaatcctggcttcagtttcttcctgtgtaaaataagaggtttggatgaaccccaaattctttccgttctaaaaagttgtgtttttatcattctttcctttatcttttcaagtattctttgggtgaaacgctattttataaggtgttaatgaggccaacagtgtattcaaaagtaaaaggtcctgattaagacttggtagtgagaatattctagctttgtagctgtgacattttcttaacatttcttatttggcttcctcagggcatcacatattatatatcacgtaccacatattgtttcccatgtgtaatctatacttgtccctttatttatttttgtgtgtgtgtgtgtgattcttctttgagcaatatacttagttattttagttacagaaataatacctgtttattgcaaaaaaaaaaaaaagtactgttgagtacagggtagaaaataaaagtccttcataatcccactacccaaaaataatcacctttaacaattttatttacttattttttttttaatagagacagggtctcattatgttgtgcagactggtctcgaaccactggcctgaagtgattctcctgcctcccaaagtgctgggactacagagatgagctgctatgcccagcctaacaattttatgtgttttaagaaaaaacacagatttgagatcatgtaacacctattgttgtgtaacctcctcctcacctacccttgcccctccccccaccaccccagtaagagtgttataaaatggcttctgttcttcctgtggtgatttctgtaaagaggattttttttaaggtaaagccataagtttaaacatcattgagcagatccagcatttggctatcctagctcttcttcaaaatgtcaggttttcttttgtcatcaccaccagcaggactattattctaggatcctagtcatcatgccttgtataaatcaaacaaaaatgccacactagcaacaagattggtttactctcatagctttccttctatctgatgtgctcagaaaagatctgcttaatgcaaatcatatttcctaattaatctctttataggtaagtgttcattggatgggtgtacctcgtttttaaaaggagaagcaaaatgttatcagcatttgaggtatatagtatttgcatgaagtgtcttactaacagccatatgccaggtgaccattgactaatttcttggtatctataagcctacacttcccagctgtaatttgagagtactacaagtatcttcttcctaaggatgtaaagtgcttaatactgtgcctgccatacaagtatgtattcgatattgttttaaaaattttaaaaaaacaggctgggcacagtggctcatactattatcccaccactttgggaggccaaggcaggaggactgcttgaggttagaagtttgagaccagcctgggcaacatagtgagacccccatctgtacaaaaaatgtttaaaattagccgggtgtggtgcatgtgctaggaccacaggtcctacctacttgggaggctgaggcaggaagatcacttgagcccaggagatcaaggttgtagtgagccatgattgtgccaccgcacaccagcctgggtgacagagtgagagcctgtttcaaaaataacctcgtattgattttagcttaacttcaaataactttcttcttatgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagtaagtacctcaactcagcaagcaagctctttccattcttacacactagcggtaattgtgaccctgaataaattacttaacctctcagaccctcaatttcctcatctgtgcaatgtggctacttatacttaaaacataatgtttgtttacttctgaaaaacacagcctaatagtgatatgattattaatgtgattatagatccctatgaagttggtcactggcatcacattcgtaagtatatctaatcaacgtttaccatttcatggccttttaaattatttaaaattcagcagtgcttcagtaaaacaatgaatgcatctaacatttaagtacatactttaaattgtatatcggtcttatgaatatgattctgatgctgatggtccctggaccacactctgataaccactaatcaatgtaaatggctcctgcaaatggagacttaacactaagactaaagagcttaatttgaacatgtgcttcttcctactcttcctcacaaccctccagcatgaaaaaatagttaaaacaaaatttcgtaattgttttcagccaatgccctttgttaacattgtcataagtacaaaattattttgaatttatagttttttttagcccagctttctccagaatggcaaggtttactgtaaagctctataaacgtatagggagatagagaatctttgtgcattatgtactctttcagttataaatgacagaattcactttaaattattttaagcctaaaagggaaaatattgagctcagctaacttggacagcgaagaatagcattgatttcaggcacaactgagtccagttcaaggttgcagagttcccagagttctctctttctctaccttttggctttgcttatggccgctcaattttatgtattggtctttatctttctggccacaaagtggttttcttcaccagggttgaaagaaagccactagcctctctaagccttcatctctgtagctcattatccaaaaggtacagttgttcttctaggatccagtgttaaccctttggatcaatctccggggcaatttctggatcagtcgagggaccatggcccatgtttattgaggcctggttcacatgagcatcctgcagctaagtagcagggatggctgtgaatacaagtgaacaacaatcccagcagggaccgtgtgggacagaggagatgccacatctgcccccgtggaaagagagccactagacaagcaaaaacaatagctagtgattaatgtgttagcctgcctttaaagaagtatttctgatggcataattttgtattcctctaaaataagttgtagtcagagtaggccagtacccactggagaagaagtactttcttgagcagcgggggtcagtgccctcaccatcaattatagtaccttaatctgctttaacaatacagttaaaaaaaaaaaaaacttttctagtaactgcaagtccttcgaaagaacttgaaattgtaaagggaaagtttatttctcttttaatgctaagatcacccttaacggtaaaatggagtattgagctatttctaagaagtagattttggcagtctttttcttttttcctgctagaatagcatgtcttcacttgacaagaataatttttagcatatttttcttacgagaattaaagcgatttaattctttcaatgtttgagccaaaagcacatggtaacatagtattgcaaccaactgtaagacatcccagattattttccctctgaatatttgggtaccatttctcttcttttttttttttttttttttcttttttttgtggcagagtctcactctgttgcacgggctggagtgcagtggtgcagtctcaactcactgtaacctcctcccaggttcaagcgattctcctgccttaacctccccagtagctgggattacaggcactggccaccacgcctggctaatttttgtatttttagtagagatggggtttcaccatgttggccaggctggtctctacctcctcacctcaagtgttccactcatctcggcctcccaaagtgctgggattacaggtgtgagccactgcgcctggccctgggtaccatttttcaaactgtgtggaacctgattctgcaagatatcagtgcgttcccaccacttccactgctgaaaaaatgaccctttttttgtgtttagttcatagacatactatcgtcaacacacccctcttcaagattcccaatgcacatggacatattaaagaaacatgcttactcttgttatactcagattttcctaaacttagataaccatgggaaaccacccccccttatttttatggaacatctcttaacattttgagggattagtgtttcaaataatacgtgttagcaaaacactactttagtattctaaatccaaaacactaactttagtattctaaattataacacttttccagttttgcctataatggagaagtcatataactcatctcaaagaaaaataattttatttgtaagttgcttcaagatcgttatagtatctctataaatttttattgtatttctcaacattgtagtttaaataattatatatcttaataatcttattttcaatggattttctttacctataaaagtatgggtagtgagatttttttaaaatatgaattaaatatttgtatatgggaaagagatttccaaaaagccgttgatttttaattgtatttgtggatgcaaagaattcagtgaacggagatgcatactgaagtcccagtcctgctttttttttttttttcccctcgtaggctattattcgtgaattgggtggtattccaattgttgcaaacaaaatcaaccattccaaccagagtattaaagagaaagctttaaatgcactaaataacctgagtgtgaatgttgaaaatcaaatcaagataaaggtaagttgactgaaaatcacaaatgtataaggttttctataaataaaaaataacaaaaagatgagtaatgaaactttagtagactatcctttgtaattttacagccaaggattacctttagaggaatggagaataagacagaagagggagggacctgaactagccaataagaggtacaataagacttttgtttcagtaaaataatgcttgtttattctacaggttatcctctacatcagggacaggcactggtgacagtaatagccttaaggctataggcaccaaccaaatagtgaatatagttggctgaaagttgggacaagactttgcgctagaactagaactagtattacaagagattcattcagggagcatatccgatgctacatattcataaatatggttgttaatgcatacagtttggctagttttgcctttgaaattaagtgtactgtatgagtgtattgcaaagtgttaagtcactgtatgctttagctctttcaatggatgaggcaaatgtgcaaatagattaaactgacttttacagaataactgttcctttatcttgttgtatggggagaaatcctccattttaggatgcacataaaatgctaacctacgttactgacattgctttaatgctttttcaaaaatgttatttatgaggcagttaacctgtaaaaaaaatagttaacttggtaaatgccaacagttaaaacacttcagccatggcatatatagccagaacccagtgataccccttggttatagaaaagagcagtgttttatgtttattattgaaacaggactcccatgttcaaactagaaattgtcattcaacagaacaaatcaggtcaagacaatcacgaaacaagagacaggaggatgtgctcctatgaagaaaaaaacaacaaataaccaaactttatttccttgaatataatgttgatggcaagatttgtaagaggtaatctctgtatttagtttagataaagacttccagcccaaaacactgttaagcagtaactgtgaggagctatgcagaagtgatgagaggcaagtactatatagactagaaaatttaattttctacagaattacagattactatgctatgaagcaaaagcagaccattcttaatgtatcaaattggtgagcttattaatttcaataaaaatatatgacccccatcacacaaacaggtaactctaaatctactttgaaaatctgatcagtcaagaagtattaccagtttggaggctatgtaccaagtgtcataccaaagataaggctgctgtcctcacagaatatatggggtcattgacaatcaattagaatatccaatgaagtggatattctaatatttggagaaatattggaaaactagcaaagtgccctggaaattatgtgttcttgcccttccacaagacgtatagatccagatgagattagtttggaataggggtctttttttagtccagaaaatctttagagtccaatacagttatggctaatcagagactaaagaacctttatgaaagtaagtaggattggaagtccttggaaattgagaacgcttattttgaattagcatgttttaatcaaaggtatagaattaatcaagtatcagttaagaatttctggaatgcactccaatgccagaagaccactagcatgctattttgtactatgaagatttcctgatttgaaatagaaggtaaaaaaaaatattgccagccataaaataaattttactctacttgcttagttctccaaagaaaaatcttacttttttcccataagaaactcactggatcaaatgaatgttaattaaacaaaagattgtgtaagtaaaactgggcaaaagacaacctctgaaatccatgaaagaattaatcatcaaaagagaagaatcatttttacagtagccccattgccgtgagagatattttcatgagcctgggccacctctccaacatatagtgagaacttattacaggtttcagccaaccaatttccattccagcttgacaggctgctgcaaattgctgagattcctccttggttgaggaaaatagagtaacgacaattttactagactcttttgccatagtgtcccatgggtttatttcaatggtaccactgttgccaacacctattacttatcttccatatgacaaacaattcgcatatttactaagatttatattagctattatttcaataatcacatcaattcctttcttatcacacatttcttaattttatcaacatagttaacttctttgtaattaaacactttgtgggctccattttgcaaaagtctttttgtccctcagtaccaactgtgcccaaaacctttaagacataaactctagcaatttggcatgttgctactgcagctcctccactagccccatgaaccagaacactctccagctttcatacagacactgtgaatcagagctcgatatgcagtaagatatgggataccaatggcagcattttgtttaaagtccagtttttcaggcagtttgtaaacagcgtaatctgctcccagagattgtgccggtagtgaaaactgtcacttttcttgaaagtagatgcattccctccaacagcttccgttaccccagttacatctgagcatagaataaggtggttttctattataaataccagagtaaatgtatgtctccatggggttgacaccacacgcatgaaccttgattacaactaatggtcttttggaactggtactgcaacatctgactgagtttcaggacttctggtctaccaaattcaaacactctaacagctctcaccagcttttgttcagttgccatggtcatctagataaaagctctagagtgggaatcaaaatctgcaagggctccttcatattccactgaaggaggctggccaggctgcttctaacttttgcagccaacaagacttttggagttggggttcagtttaatctaagggtgctaaaggaaccaggccagggtcagataatgtcagcagaaaaatgcaatattaggaaattatgttatttcaattcaatatttatcaaacctcctgctttgtggtgcagagtatacaaatgagcatgatgcaactcttgttctaagaaaggtggaaggaaggataaggcaagtccttaaataattgtaagtcaaggcagaacataatgaagtcctttaaagaaaaatgtaagtaaaacatgattgagtacatagaaaggagagatttcatccaaaagtttctgtaagaggtggagtctgacctggctcttgagaatgttaccctacaggtagagttggggaaggagagaattccaagagaacagaacaagatgaggtggacacagctgcaggaataactaagctggtccatttggtaatcttgttattataattgaaatggtaaaaagattcagatataataaggatgtaaacagtccacacattttaggaaatgccttgaaagacatcagcatcttacagaagtatatgatttataaagagctaaataaatgccatgtttttaaaggatggatgtataattaaattgtaaccaaagagaaccagttgactttcaaatgtaaattagggccaggcgtggtggctcacacctgtaatcccaacacttgggagccacgacaggagattgctggaggccaagagttcaagaccagtctgggcaacatagtgagaccccatttctttatttttgtttgtttttgttttgagacggagtctcactcttgttgcccatgctggagtgcagtggtgcaacctcagctcactgcaacccctgcctcctgttcaagcaattctcctgcctcagcatcctgagtagctgggattacaggtgcccaccaccacgcttgcaattttttgtatttttaatagatatggggtctcaccgtgttgaccagtttgggtgagaacccatttctaaaaaaaaaaaaaaaatttattagctgggcatagtggcatgcatctgtaatcccagctactcaggagtctgagacagggggaatttgaggctgcagtgagctgttatcacaccactgcactccagcctaggtgacagagtgagaccctgtctctaaaaataaatgtaatttagatcttgaaaccagattaaaagtttaatctctcattgctttactgccatttagtttctatggtaacatggatacatttgggattttttttaaattaataattgtttatgggacaattggtaacttaccacttcaaattaggaaaattttcttagcagttagaacttttggtggagttcagatttgcttaagtgattagtagttatctgtaaaacataatttttgtaagctagaaagcttatggccaggccggacatggtggtgcacacctgtaatctcagcactttgggaggctgaggcaggcagatcacttgagctcaagagtttgagaccagcctgggcaacatggtgaaaccctgtctctacaaagaatacaaaaattagctgggcatggtggcattgcagcctgtgcggcagtgagaccttgtccccccggaaaaaaagaaagctcatggccagacacagaaagtagagtttcagaaaagtttccatcacactgagtttagttgtgtcatgtatgatacaagagtactacagcattgcattactttttaccagtgatagttaacaatattatgaaggggtgaattatatatatatatatatatatatacacacctaggtaaataagaaccttaggccaagtataattttgttctgcttacttttgataggattaattctagggaaagattctgtttcacattatcctcccattctttacttctgaaatgatgtagctctctagaccctactgctaaggtacttattactatgatacaaaatggcctcacatcttcttccctgatcccagtgtgcgcagaccgcagaccagttgaaaccgaaaggtggactaagatgggaggcctccaaccagggagaagccactggtgttaacagcatgatctctgggcttggctattgcatccccacctgctgtctgacattgggcaggggacccgagctctttaaagacttaaaagtccttgtctgcaagatagccgtaatagtacaacacccaactcattagagttgtcttcaggattaagtgaggagtatttgtaaaatgctaagcactgtgcctggaattaccaaaggaagcttttaaaaagtcaacaacttttgagggccagatagaaatttcatattttggccgggcacagtggctcacgcctgtaatcccagaattttgggaggccgaggcgggcggatcgcgaggtcaggagatcgagaccatcgtggctaacatggtgaaaccccgtctctactaaaaatacaaaaaaattagccgggcgtggtggcgggcgcctgtagtcccagctactctggaggctgaggcaggagaatggcgtgaacccaggaggcggagcttgcagtaagctgagattgcgccactgaactccagcctgggagacagcgagactccgtctcaaaaaaaaaaaaaaaaaaaaagtcgtattttttgaggagtcggttccatcctgagcagtagccctactccactgtgcagaaaagtggctgttcagtagaaaaattttggagattctaagatgctcattttcctcccctgccttcagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtatgaagagctattgtgtcaagcttattaacattgaaatagtatttgcaggccacctatcttaagttgatgtgcctcaaagaggaagatttattaaaaactcacatgggcccaagaaagtatattatttttagtcccaaatattccattgcaaaattaacttttgaaaaccatctgttgtttcacttatcaacagattcctgttcatttggttttctgagaagctagcttccccccaccaaatataggaacattgtgattaaaaggagtctgagtaatagtagtggttagttgaatattttgcttacctcagggttaacaaatcatttttttgattcagttatttgttgaaaaatatttctaaaacaacttttaagctgtagtaaatgaagtgaattgaatatatgaaagatgtctcagtgcttcactctgtccagttaggttgatataagaggcaacagatattgagctgaattaagtaggaccttaggagatgccctataaaaagtttcttaagtaaatctctcatattagtgtgcattcttatcaattgccatttttcaagaaaaagtagcataaaaatagattgtaggctaattaaaagttctgataagtcgggttgattgttcatcaaggctttttaccatgttagtctgtgttctctggaacagttgagagacaaatgcataagcattttagaaagaccaaatgtgaagccatactccaaatattcaacatcactgcagttatttttgagtttatcaagatgtgattacaggagagtcttactgtagtcctgcttttatgtttccaaggtgtttgtacatggactttcctcttttccaatagccaaacttgtttggatgtgatccaagatgtaccaaaaggtattgaaaattaaatgtaagagtagtcttctagcaatattgcaccattcccaggcagtttccaacgtgcatcagcatgtctgtctccagtggaacaagataacttccagcccctgaacccctggggaaactccttccctctttactgtatgttgttgccactgtaggagaaatctctcctctgcctgactctgcagctgctttacccagaacctcaggaggaactctgagtccagagccaggctgagttcagccaggcaagtctggccttggggctgtatatatctgtctcagacatcgtctgtgttttcatatattttttgactttttaaaagatgacccagaccacaatagtatgttctatttttgttttgttgtgttgtgtttttccattacattgcttagtacagtatttctaggatagaaaatttgctttcttggtctgccttggaacatacctaccaattacaacattgattttccataaaaattgagtttaaagttccaacttgcaaatgaacttttggatagccatccatttgttagtgggaaagtgtgtctgatttaggtattttcttagtaaataaccactaaaatgaatgtttaaatatcgtattttgcttaagtcagggatctcactgtactgtaataaccgtttgggtacaccactgattgataacttaatgcagatagtggaggattaacataaactgtgtgcttgttacatcctcaatgaaaacaaaactaatggtttaaaatgtcctagtgtcaccacaagatggtgcatgtgacgaggaaaaaaaacatgtcttaatatggtttcaaaccaaaatccatatatttgtttaatctgtagttgtactctaactgtatatatatttttttctcatatttaactcccttctacaaagaatagcaacatcagattttaatacaggataccaaatagctattgctgttgctattccctggttgtatacctgccctcattgactattagtgggtcttagattttgacttcatccaggcttatttcgtaagttcaggaccatcctatttcatacctcctgttcctatttttctaattgaaacttcattgacattggagccaggtgtttttttcctaacacttattcctagtgttgctgatagtcagtcaggccagatgagatctgatagtgacctccacggagtgcactaaagaagggtcagaagtctcctttactctttcaaccccagaggccttaatttattaatagcatctctttgaaaaagacaatctctgcatattcaagaaatgttaccagtggacactgctgaggattggaaggggccaaaagcatggtggcttttgtttttaccttgttctcttttgcattacttaaaatttttatcatgaccaagtagtaattttctaaaaataaagaaatatttgataaaaacagtaaaattaagcaaagtattatgtcatcctcaaataaattagtatctacaacatgatcaaagaaattgtgactatacaggatatttgcataaaagaccaaaaagaaaatactaaaacttttctttctcttttttgacacagaatctcactctgttgcccaggctagattgcagtggcatgatctctgctcactgcagccttgagcttccaggctcaaacaatcctcctacctcagcctccctgggactttggtcacatgccaccacgcctggctgatttttgtatttttggtagagacggggttttgccatgttgcccatgttgctcttgaactcctgagctcaagtgatctgcccaccttggcctcccaaagtgctgggaatgcaggcatgcgccaccgcacctggccaaaaataccaacacttaatcgtgatcatttctggttatgtaaatacgggtaaattttctttttctttgtggttttctatttttttgaaagtgctatggtaaacatctgttgcctttgtaataaaaaatttttctaaaataatatccaggttccttcccagctctagtgaagagcacatttgtcccatttccctgagttagtacccccctctatgcttattttagttccaggtatcttgtagaaagtatggtttcacatggcctttgtttttaaaagacttggaaccaacccgaatgtccaacaatgatagactggattaagaaaatgtggcacatatacaccatggaatactatgcagccataaaaaatgatgagttcatgtcctttgtagggacatggacaaaattggaaatcatcattctcagtaaactatcgcaagaacaaaaaaccaaacactgtatattctcactcataggtgggaattgaacaatgagaacacatggacacaggaaggggaacatcacactctggggactgttgtggggtggggggaggggggagggatagcattgggagatatacctaatgctagatgacgagttagtgggtgcagtgcaccagcatggcacaagtatacatatgtaactaacctgcacattgtgcacatgtaccctaaaacttaagaataataattaataaattaaaaagaggcattctatttgagtcttgttattactgacttttcagttataagtgataagaatgctgatattttagctagtcacccattagataacatttatttgcttattatttatatcattgctgggcatggtggctcattgcctgtaatcctagttactttgggaggccaaagtgagaggattgcttgaggccaggagttcaagaccagcttcagcaatatagtgagacccccatctcaatcaatcaaccgatctatcagtttttatcactgtgcttatttatatgattgtaaaacactttcacattaaaagataacctcaaaaattcatggtagcttaccaaaaggggccatattgttatttatttagtcttggtaaccaaacagttccaaaatttttactgtttaagtagaaatgagctgagctttgagagatttttttgttgttgttttaaagattatatttctttatttcttttttgtcgggggtgaagatggggtctaagggtctcactatattgcccaggctggagtgcagtggctgttcacaggcacaatcatagcttactacatccttgaacttgaacatccttgagatgggaaggctcaagagatcctcccccgctcagcttcccaagtacctaggactacaggccgacaccatcatgcctggccatacttcacttaccagtaatcataatgaagatcgtgtatttaacagatgttaagcttaccaactgttcagatgtgcatgtgaattgggggtagattgtgaagacatttgcaatattctatctccctgacattataattgggaaaaattaggtttaaataaccgtgtgatagaaaacctgtatctctgtgataagttctctaagagtggtacaagacatttgcaatattctctctatctccctaacgatgtaattggaaaaatgaggtttaaataacactgttctatgataggttctctaagagtgctgccaagtgttataagagttcagaatgagacctttaaagtagaatgaacggagaaggtttcctggagtagagagaatttgagccaggcctggaagcttaggcaggactttaacaggaagacatggtgagagaacagcatgcctgagagagaaaattcatgcttgccagtctgagataagccagtatcatcttctttcaggtgcaagttttgaaactgcttttgaatttgtctgaaaatccagccatgacagaaggacttctccgtgcccaagtaaatagcttatatatttattttgtaaatatacacatatatacatttgaacagacagacagatctggaaagattaagcctaaaatgttaacagggattctctctgaggagcagtattaaaggtggttttttaaattcattttgtatgtgtaaatttcctaaattttttgcaatgagcctcttttacttttgaaaaacatttttaaaaattcaccctagcaacaataaattataacttttttctctacccaattttgggtacaattgtgccatcccatattttatacttgaactgtttgtgtttacatgtatcttagtatccactgaaacagcagtactgagtccccagcatatgctagatgagacacaccagtgagcacagcgtgacatggtacatgtcctcacgaagcttacagtctagtggagagacaaaaatatataacaagtgaacaaggtaattaaaagctgtgataagtgttctgaatgctgggatagaatggagctccactcctgtagaagaggaaccatcgtattcatctgctcatccctattccccacccagctctgtgccctgtggtgtatgggcactaaatgtttgatgaaaaaatgagttcccatgaaaaccgtatgatgatcttaaaaaagaaaatggttgtttttcccaaataaccacattctaaaattccaaggaaattgtatttttccagctgaaacactcccttttttccattagtattacagcgtgggggtacataaggttttatacatctaagttatgaaattttgggttttctgtgacaaaatttttttaatgtgagatacattttaaatgtgaatttaaaaattttaaaatgtgagttattcaatgtagttttaaaatgttaaaatatacatgaaaaagttttcatatattattaatataaaataatactcattgtttcatatttcaggtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatc

SEQ ID NO: 1526 - DNA, 24878 bp, Homo sapiens; identical to SEQ ID NO: 1525

SEQ ID NO: 1527 - DNA, 24878 bp, Homo sapiens; identical to SEQ ID NO: 1525

SEQ ID NO: 1528 - DNA, 24878 bp, Homo sapiens; identical to SEQ ID NO: 1525

SEQ ID NO: 1529 - DNA, 24878 bp, Homo sapiens; identical to SEQ ID NO: 1525

SEQ ID NO: 1530 - DNA, 24878 bp, Homo sapiens; identical to SEQ ID NO: 1525

SEQ ID NO: 1531 - DNA, 261981 bp, Homo sapiens
gagacggagtcttgctctgtcgccgaggctggaatgcagtgacgtgatctaggctcactgcaacctccgcctctcaggttcaagcaagtcccctgcctcagcctcctgagtagctgggattacaggcgcccaccaccacacccggctaatttttgtatttttagtaaagatggggtttcaccatgttggccaggctggtcttgaactcctgacttatggtccacccgccttggcctaccaaagtgctaggattacaggtgtgagccaccgctcctggcctggcttcttttttaaatcatgattatttagacagaagaactactgatgtgtttggaaatatttgtagttggaataagaatcagaagatggtttgttgcttgtttacattgttattgagattcagctagtaaacatacttgcaacaaatggagaaaacttgccaagttcttgattttttgttcttcctgcttgaggctgaaggtcacgctgcttggtcttcactgctgtatgttgactttttcactgttaattctaaggctcctttagatgatgttatgttgtcaagctctgtaacagggtttccttccctatcatagccaaaccaacgtggagggtcattagtgttgtattcctgctgctgaactttagatgacattctttgagctgccttcctgtaataacagtgcttagcattagctagttgcagaagtaacccctagtgcaaaattttcaaactcaaccaaatttggagttagggaattcactgtcacaatctgaattcacatgagacctctcttgccttgctgagagtgaggatatgggtaagtgtacaaataaacagggtcccaaagcctcagtaactctgattcagccagttcagaaattaacagatacagtgaatgggtaaggaaactacacatggccatggaagaggaacactgaggcctctatttatttatactgctttaagtaagccccttccttggtatttctagtttctctgatgagggagtaacctaaccagcctacctgtgaaggctgaccatgcaccaggccaggagctcttaacccagagttcacagatcccttttgactacatggatgaacttcagggaggtccatgaactccctgaaagttcatgcagttttgtctataatacacatttttatgagaaggtttgtgactcaaaggtgtcacaacactataacacagtattaaaaaatactgttatagtctttcttagcaggaaacaagaaagtaaagaatgcatcagaaaaaaagtaggtctaacttgaaaacaaagccattttgaggacagaaggaagaatttcctttcctagaaagttggtttgaatcacgagattagtactaaagaggagatgagtaattgaccacttctgtacgattagaaatgagtaactatgatgtttacccatgaaggcactaccttccccactcttgccgtatgttaccttgagttattaattgcaaaagtctggaaactgagtcattgatatggagctggcattaccatacacttcgagttaagtttgtgctgaatggccatatgagttcaggtaaggcaatgaaataggaagaaaaaaaaccaacaacatagagataacagtttaaaatgctatttcagttaaatcaaactttagatgtattaaaataattgtaaccaaacttaacagggaggtaaccaaagcattcctaattctgcctctaagcacattgctttttagcttattattggctctcacacaaaacttctacaaacttaaagaacaaattgagtaaaagcaattatcatatactaattcctagtttggagccaccaatccctatggactaaaacttggcaaacaagtttattctcttcagagaaatatttattctcagttttgaaaatggtaagtttattgtcaaagataatgttttgcattctgttaattttttaaatctttttttaaggtgctagcctgcattttaaacctcttatataatctttacatatcctcaaagtagaacattactatgcaaaagtagtgggtttatatcttttgcttttcccacattattctcctaatgatatttctcccttttcaattctataaaggtgagattatcatatctttcaacacattttctgaacatttttccccttaagacttactgaaatataataccaaatgttgaggcatataacattagcaccatcagtttcatgtaacaaacagcaaggctccatcattacccttcacccatctctatcagtctaaacattatccatttttcaaaactccaaaccaatccagcctccttggaaatggctcaaacccagtcttctcctcctctaaacatctacaggaagttgatcatagaattaatttctttctattacatagcttcagggcattaattatttataattttaaactttgttattttccttttgtttaagaaggtagtaagttacttaagagtttattacatttctttgcatctccctgaaactcatcatgaatagctcaaacgagagatttcagcagcttacaccaagaagggaagtcctttaaccctcttggcttctgctggattgctggtctagaaggggcattcttatgttcctatttccaacaccctcctgccccctgcctcccaaacaccagagttctggacacacactgcagttcacagttgttcataatcattcaatgccactgatgttgactgtagtacaagagtagcacagttagaggcaacaatgatcttgacctataggaaaaggaaatgcttgttttagggagtaaaagatttgcaaatcctcattcaccaagttacatcttaccttaatgtcagaagagcaacagttttgacggctctagataactggtaagaggataagtactactaatgataagtctgggaaagtgtaaatattgagtcctatggttgctcagtcagctacaagccagggtaaattagatggtaattgtgacataaaacaattagcaagtagtgggggtttgagaaaataacaagaaaaaggaaagtgagaatgctgactccttaatataagataaggaaaacagtgagtgaacagggagactactcatttaatgcagtgtgatgggacagaatcgaaatgagctgcatgttgaaccccagccatgggtgaagtgcccactggtatatgcatttctttaatgtcctcattccttagtccctgtcccccttaccctagctctgctctccagtccacccacagacagctttagtgaaaccaaacatcagtgggtccctgactattggaagtgatgcttactgactggaggggagcaaaggatcagatctcagacccactctccttccagactcaagttctgggaggttaaggcttcctccacctggtatgtctttagggcctgttttagtctgaagtgctttcacagcaagggtggtcctagggaaaaacagaaaatatgaatctgtcctggagcaaatctaggattatttttagagagctatggatactagtatagactattccctattccacttctttcctgcccttcagaaaatccttagccgtgactagctgtcctcaccacctttggcatcctcacacggactgactaacctaagacccaggaccttgccaagagaagagatcggcaagtggctgccagaaggtttttctgagttctttatcatagcatcctatgtagctgtgtgtttgcacacacgcacctttaaaaaaaaatttagattcagggtgtacacgtgcaggtttgttatgtgggtatattacataatgctggggtttgggctgctattgaacccatcagccaaatagtgaacataatgcccagtaggtactttgttaaccctcgccatcctccctgcctccccacatttggagttcccagtgtttattgtttccatctttatgtccaagtggttagctcctacttttaagtgagaacatgcagtatttggttttctgtttctctgttaattcacttaggataatggcctccagccgcatccatgttgctgcaaaggacatgatttcattattttttatgactgtgtagcatcccatggtctgaatgtaccacattttctttatccaatccaccactgacaggcacttaggttgatcccatgactttgctattgtgaatgatgctgcaataaacatacaactgcaggtgtctttttgatagaattatttcttttcctttgggtagatacccagtagtgggattactggatgaaatggtaattctattttagttctttgagaagtttttatactgctttctattttggctgacctaatttacattcccaccacagtgtaaaagcattcccttttttccacatcctcaccagcatcttttattttttgactttttaataatagccattctgattggtgcgagatgatacttcattgtgatggtaattttgcatttctctgatgattagtgatgttgagcattttttcatatttttgttggccacttgtatgtcttcttttgagaggtgtccgttcatgtttttgcccactttttaatgggcttatttggtttttgcttgttgatttgtttaagttctagattctggatattagacctttgtcggatgcataatttgataatatttttctcccattatctttactctgttgatagtttcttttgctgtgcagaagctcttacacatgtattttgaatcgtatcaggaaagttaaaaatgtagaaactatatttctgggagaaacctctctctctctcctgcccctcccctttctctcttaatagcttgatgctgtagtgtgatcagcacatgggagctaggaaatattgaaaaaaacatgtattcttaggaaccactgtgtgttctaaattccatagagcacatatggaattctttgactgcattccattctgctttggcctaagtgactgtgagaccccgtatgaaatgatttgggaattgaaccaatctgctgcaatggttactcatttatcctggtgagaggtttctttggatcagtatagaacagtgattttcaaacatgatatgtcatagttgtaacatttcacattagatggttaataataacactgtactgaagtttgttagtgatttttgtttcttataaattaaaagggattcagggttagccctgtagtaacactgtgtgccttagctcacatttccttctaatctcttgagtaggcaaaaaaagggaatgttggagccaccaccaaggactgctcataatccacagcctctcttattgtgcatcagacataaattaggcaaaacagagcacgtgtctacccttactgaccacatcccttgaatgtcagagctttttaaaagcttgagaatgtaatataaaggcgaagagcagcacagtatgattaagacctaggtacaaagtatggctctccttatttgtgtggctgtgggcacattatttaacctgtttaaaccagtttccttatccattttgatgataaagtgtatttgtgaggcaatatctgtaaaataggatttagcacagtacgtggcaaataataattgttaaataacattatttgttcatactgataataaaagtcaacagctccacatcagaaaggcttgaacctttccatgagctagagaggagaactctgataagagttttattttttatcaacacagatctcctagaatgcctgagcagtagggactgtccgagtttaagcttctagcaactgctaaagaaggccttccaggaatttcatactgtgatttggggctctgaaggccactaagactttctctactagttctctagaattgaaggttttgggctccagatagaaatatatcaaaagttccctttatttttttaaaaaatttatttccaacttttattttaggttcaggagtacatgtacaagatgtacaggtttgtgacataggtaaacgtgtgccatggtgttttgctgcacagatcattccatcacccaggtattaagcccagtatctattagttattcttcctgattctctccctcctcccaccctccaccctctgacaggccccagtgtgtgttgttcccatccatctgtccatgtgttgtcatcatttagctcccacttataagtgagaacatgcgttatttggttttctgttcttggattagccttttcgctaactatacaattagtgattcttcaggttctctgtggttcaggccctcctgggttgtgggggccattgtgagggtctttcttcctctctctcactcctaccttgttgcctttccccacagagggccataagttgaatggctggctgtcacagctgcttcaaatacaaatagcttgtcgttttctgatcatagttgttacttattcctccttgaaataaaggagcctttatcttgcatccacacggtgcttctggggtcacttcctggaaacccttcagactctggggttggtagaatgccagccatatcttctgcaggaaactctcctgcaaaagggctacagccaatttgctcattgaccaaaagtttgctactcctctggttcagaaagggtgagctgagcagacatctttgatttgcaaagctggtgcagtagtttcagattccattgagtatgagtgaatttatgtataaaacagcctcttctgacggctgtaattggaccttaagggctgcatcatacattgttttcatgttcaaaatggaatcaagcatgtggagagcattgctttgtgattcaaagacattgagcttcttcccaagccagaaaaatctctcttatcccacctgccaaaggttctgtttcacccagacaaatcaaagcctctgcagttgagggagccacactggccctgattagatagtgagcataggtaagggattagagatcatcaagggcttgagttttgaagggtctacatacactgtgcatttccaactgcactgaaggatctaaatgcaaaacgaagctgctccatagagcacccggagctgatcgcagaaagctgcatgcaactaggcccccttacagcttctctaataaaaaaatttgaggccagggtatttcaggagccccctaactgacaagtagcaacctatcctagatgttgaacataaagacagatgtttctggagctttactagtccaaacactgggactctccaagccactctacagtgaggactgtctttctccattgctagacaaagatggaatcgagggattctaggcctctttcctgctagagctaagcaagggtggagctttcagggagactaaaaggtagtggtgtggcctctttagacaacgaagtgcacacaccaaaccagcccctttctaagcattagggccaagtctctgcctgcttcttgtgcatagggacagccaagtttgattgcagaagacaaaataggccttcggctgtcatggcttagacaatggaatttttcacagctatagctggttaattagagttctacattggggttttgggacaaagctcagctagtagtcaagtcttactatgccttgttttattttttttgcacgtatattttttaaatctagggacctagcaagaagaccgagcagttaaggcaggattcggatgttactggatatcctgggtcttcttgaccactcactatattaatcatacttcagtgtcccatatgtcttggtccattttgtgttgccataacagactactacagactgggtaatttataaagaaaagaaatttattgctcatagttatagaggctgggaagtccaatatcatcccatggcaggaaagaaggagccctagctcatccttttatcaggaacccactcccatgataactaactcacttccatgataacggcattagtctgttcatgagggcaaagccctcatcacctaatcacctctgaaaaggtcacacctctcaataatgttgcattgaagattaattttcaacacatgaacttgggggaccacattcaaaccatagcatcacaccatgattaggttcaaagagccccttgccagaaagtctccattcattctagaatcttacttattagaaattcaataatattacctcttataaatagtgattggcaaaatataatcaaaaaattagaagctaaactcctttgagtaacacgttattcattcactgtcatcttgctgaaagttgtctgttaataatctaacaagtttggcagagactcctaggaccctatttcattgtatatcctttaaatgaggttagcagtattcatatcagagttatctccagacctatcaggaagggttgagtctccaaccctcctcaaaaattttcaaggacctacccccttctctctgatccaactccagctggctgccctacccctgcaggcctgggcccagtgggaatgtctattttacaagtaatttttctttcttttttccatttcattttaacacacacttccttggataagaaaccatgttcttcctcaggcctcaagaaaccagggctcatggttcagctcatgccataactacttaattaagaaagttcctctgtgaaatctacatgcttgagccacattgtacactttatactttgataatattaattcatagtattaatttttcacatctgcctaatagaaccttaccttctatgtcagggaatggtcaaggattctcattttaagcatttcatatgttactttatcaggtcagttaaaatacttgcacatttttgccctcagtcaagaggcaaaaacttgtgagctggcttaatcagatgattctcttaatgctctaggggagattaactgaatggactgtattttgagaaatgagcagaggaagagctagagttaaagctttggacacctgcttagtcaaggaagggaagatgcttaaagtaaaaggcctactggaaaagggataggaaaccacaaaggccgttttagaacaactcacaatgttagcttcaattaggcaaaaaataaaatgaaatgaaacttcctaacactgaaagctgctatgtattatgaaccttatagccatatactatgttttctcagaaagtagttctcaaaagtttgtcatagtcaggtacatacttacttggaaatatttgtgcagtattgcatcttaaggatccggagttgtttgcagcctatctgaaggtcctcaaggatttggtcagtaagcaagacacaaccagagatatccaaaatgtgcaggtaatggcattttgccgataacatctccattgctgagtcagtaatctgaacacagagccaaagtaagtactggttattcaaacactatctcagggaagaacagtgccttagtcactttgggcaactataataaactaccacagactgtggcttaaacatcaaacatttatttctcacagttctagaggctgggaagtccaagactgagataaagatagaggtacctgcaattggtgtcttgggaagtccctccttatttgcagatgcctccattcttgctatcttctcacatggcagagagagagagagctctagtctttgtcttcttatatggtcataatcccatcatgggagctctacccttatgacctcttctaaatctgtttactcccaaaggccccactttctattactgtcacagtgggagttagggtttcaacataataatttttggaggacaaacattcaattcataacaaatagagtaacaaaatcagacacttgcatattctctttcacccagcttgtcacataatgggcctacaattcaagtgagttgtttaactgtttccaaataaggtcagaacagtaaaatatctgcctcaagtagcaccaatagaaattatgatcttagcaaggcacagtggctcatgcctatgatcccagcactttggtaggctgaggcaggcagattgcttgaacccagttcgagaccagcctgggccacatggtgaaactcccaaaaatacaaaaattagctgggcatggtggcacgtgcctgtagtcccagctacttgggaggctctggtgggaggattgcttgagcctgggaggtcagtgcttcagtgagccgagatcacgccactgcactgggtgacgtagcctcagtgacagagcaagaccctgtgccctgcccaccccccacacaaaaaaagttgtgattttgctgttattttcatttaagagtcctctggtttggatggaaaacttcatcaaaattttttagtaatacctgtcacaccaatatgagcaacttatgaaatgctatagagatgggatttggctttaaatttaaaatcctctctaaggcatcaccaatttaaaaacatatgtttaataacattacatgctacaaaactacaaaatatatatcccccaaagttaatctgcagacagcctcatattactatgagaagggacctggacatcactgatggtttagatgtaaaaaagatggagtaacctagttctggaaagggacaagtaggtgagacagatgtttggaagcaaggggagaaagaagcagaagccacagagactacacaaatcccgctctgaaatatcctgccaagggttccaacatatcacagttttgcccagatgtcctacagaggtaattcaagtatactacttagagtatttcacttactccaggataagctttcaaatttatagctaaactgagccttgctgcagaatcaactagattactctctccaaaggaatttttttccaactggattcaatttcttattttaaatgtttgaacattctgaaaaacataggccgtgaggcttggctcttgttttaacataaagttaaaagaaaaatcacttcagtttggaacatacactttttaagtttggaaaaagagacgttgccattgtctaaacacgctttgtttccggaacacgctcaggaccaaggttaaacattataactgactctcacaaaaatgcctcagacattcctgccatactaggttgatctctgaggatctgatgtcattgataaaagaaaaaaaaaggcccacagaattgtagaagaaaggaaggacaacaaggtgatggaaaagtccaggggaggtggagttcagagtagcaggtttggtttgatactaggagagctgaaaaggagcctgacagttcctgtagatcagtagctcatgttgttcaatgactgatgtgatgttgttgggatttatggattaagggctgggaactacagatggaaacaactttgctgcatttttaactcccagatataaggtcctgctcccagcctcattgggcagattatgttacttccaacacaactacttttgattccttgaaaaaatgttttggtttatttttaaatgaaattattttatattttagaaataatataagcacattgccaaaaaaatagcaataatagcaaaggaaagcaattacacatttatcacttaacataactacttttaatgttctggagtatttcttgctcgtttctcattcctatccccattaacagatttgtaaatacagtaattacatttattttgcatcctctttttttctttcttttttttattttgctctgttgcacaggctggagtgtagtggcacaatctcggctcactgcaacctctgcctcccaggttcaaacaattctcccacctcagcctcctgtgtagctgggattacaggtgcccgccaccacgcccaactaatttttgtatttttagtagagacagggttttaccatgttggtcaggctggtctcaaactgatgacctcaagtgatccgctcaccttggcctcctaaagtgctgggattacaggcgtgagccaccatgcccggcctttttttttttttttttttttccgagttgggtttcaccatgtttcccaggctggcctggaactcctgggctcaagctgtcttcttgccgtagcctcccaagtggctgggaccatagctgcacaccaccaaacctcgctttcatcttgcttttttgtttttcctagtgcattcttatactacttcacagtcttcatatttacaatctttaattattataaaatgttttatttagtagatgtagtttagtttatcatttacatatttctggtcatttccgttgttttcaagtttttactatttaaataacattttgatgactgttcataaatacagtcttttccaagttttggactgttacccttaggatagatttcagaaagtggatttgtatgctatggtttgaatgtttgttccctccaaaacacatattgaaacttaacccaagatgtggcagtattgagaggtggggcccttaagaggtaatcgggtcatgaaggctctgctctcatcagtggattaacctgttatcatgagagtgggactggtggctttataagaagaagaaaggtctgaactagcctgttaacatgctcatctcccttgccatgcgattccctgcgttgccttggaattctgcagagagtccttgccagcaagaaggttctccaccaaatgctccaccttgaccttggacttcccagcctccagaaatgtaatattactaaattttgttcttataaattacccagtttcaggtattctgttatacacaacagaaaacggactaagacagggtatgaccacttttgtggctcttgtttacgaattttcacattgcttcacaaaaggattatacccatctataatgctatctacaatataaggaccagtttcactgaccccctgccaaccactgggcattaccataaaaaaatgtgcaatttggtaggtaataaatgatacctcaaataataatgttttaacttggatttctttcttatgttggatcttttcccacattgtttactagcagtattttctctgatttgaattccccagctctggcactatttaattgtgaccataggcaagttgcttaaattctccgagcctcagtttccccatttgtagaatggttacccgagattgccacagaactaaaggagaacatgtatgtgaccagtgactagcataaagtaagcactcaataaatggtagctataattatgattattcatctcctttgccattaatatatgtgatttttttttagtaggacctctttatacaaaagagaacttgactgttggctttcagtttgctgaattatacttttgtttcttctcccctttgccccctccccaccaattcctgttttgattgtgtgagaagtcaggtaattttactagcacttctggtgacgatcccaagaaaaaacccgccttgaagatggacagcaagaaaggggctgaatagtccacaaaatgaacttttaggttaataacaggtggtttcatgagatattaactaatgaaaatctaatgcagtaagaaataatgtgctttaaaggtcaggccaaaaagagagtccaagtttttgccctagctttttttaaacccctgaactgtgggagggcttttaaatataataaacatattttgaatataagctgagcgtggtggctcatgcctataatcctagcattttgggaggctgaggcaggtggatcacttgagcccaggagtttgaaatcagcctgggcaacatggtgaaaccccatatctacaaaaaatacaaaaattagctgggtatgctagtagtccagctactcaggaggctgaggtgggaggatcacttgagcctgggaggttgaggctgcagtgagctgtgactgcaccactatactacagcctgggagacagagtgagaccctgtctcatatatatatatatatatatatatatatatatatatatatatatatatgtatatatatctctaatatattaatatatatctaataaatgtatcttatatataataaatatatctaatatataatatatatatttccaagagagggagaggctcttaggaaattatcttcttgcatattatgttatattatgctatatttggctatttcctaagagctctatcgtattattttcatttatttgtgagaatgtagctgtggtagattaaaaatggccacaaatgctttgcagctactgtcagcaagaagtagagtctgtttcctcacctcttgaatctaaactaaccttgtgacttgctttgaccaaaggaatggagcagaagtcatattcttctgagccaggcctcaagatgccttgcagcttctacctttagcccttagcctcttggaatgtgttactgcccttgaagcagctcagctagcttgctggaggatgagaccgcatgaagcaggaggaagctgtcccagctgggtcccctaggccaaccagctctaaggggagtcaagagatgactgcaaagagatgactgcagctccttgggcaaccctggggccaaccactgtcagaagaaccacacagccaaaaccagcccaaattcctggcccacaggtttgtgagaaaataaaatggtagttgtcttaagccactgagtttgagagtgactggttacacagcaaaagatcagccaatactatgtgccaggaatctcatcctttgtaatatatggtaaaatatgacccattgatcattttttttttatactttaagttttagggtacatgtgcacaatgtgcatgtttgttacatatgtatacatgtgccatgttggtgtgctgcacccattaactcatcatttaacattaggtatatctcgtaatgctattcctcccccctcccgccaccccacaacaggccatggtgtgtgatgttccccttcctgtgtccatgtgttctcattgttcaattcccacctatgagtgagaacatgcagtgtttggttttttgtccttgcgatagtttgctgagaacaatggtttccagcttcatccatggggaatcctttccccatttcttgtttttgtcaggtttgtcaaagatcagatggttgtagatatgcagcattatttctgagggctctgttctgttccattggtctatatctctgttttggtaccagtaccatgctgttttggttaccgtagccttgtagtatagtttgaagtcaggtagcgtgatgcctccagctttgttcttttggcttaggatcgacttggcaatgcgggctcttttttggttccatatgaactttaaagtagttatttccaattctgtgaagaaagtaattggtagcttgatggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgatcatttcttttccttatgaccatttcgaaacctctaattgattttccttatggtcattttaaaacctctaagctgaaagaatttccaaacatgttagccagctgcactaagaaaataaaggttgaaaagggtaggattgtcatggggaatcccagaattagcaaatctcttactcctctccctttacattataagtctgtagaattgggatgaagttacctcactaaatcctatttgctcaatacttcatgcctttccactcctaatttccccatctgtaaaatgagggtaatttaaaacagacaaaaaatagtgtttactctcatctcccagtgtttcagtggtctagagacatttctccaaataatgaactttttgggtaaaatgttttaccatattagtataagagaaattctgtgcatgccctggggatttcgcccagctcacaagtttgtgtagctttagctgagcctggggccttaggggagagcagccaggctttgtgacctggctcaatcaccttctcagatgtacttcacctgcaggacagttcaagtagccttgggcacacccagttctctcccttttgtagattgtcattctcaagaataactatagaatgtgctggggatgtaacatcctgagactgaggatagggggtactgactggaacagccaggctctgttccagttccccctagaaacaggacatctttccgtgcttcagcccagtgggtcaagtgaacccaaggttataaaacccaagatggtccaccttccagataccctcagctgcggtgcaagtggaacatttacagttgagatttcatccaccttgagcagctttcctgagccttgggaaacaggccctccaggaatcctcggcttctgttgtcacttgctgcctatctgtaagtaatctgcttcatgaagctttttgcatatgaatgtgtcctgtctcaccagactcagacaagttggtaatcagtgcacagtggacctgcttcacatcacctacacttgtaggacagaaatgcagttctaaagcactggcctgctttcgcttaccttatccctctcagaggtgcattgcagagacattttgtcattgttcagggctttgctttaatttttctcatttcccacccccttttctttctaatcattactaactcccacttcacgtcggtcatgagggtcaaaagtgacagtgttaaccacagggcctagtgcactgctgagtgctttgaactggccccagagcaaccagcttttcctctgatttgtagctatatttgttttccttggcattttagtgtcgagtaggatgaggtcacagtactactaactgaccttcgaggtgaggtggttgcaaggaaaagccggcctttctggggatagataaggtgaccattcaaaattcacctgtggacttttgggaaacctggcacagaatgatgagccagacaccaatgtgttttacggctcatcaaaatcaacataagtggaatatgttaggttggaccacagccttatgaattcagggtgagttgaggagtattcagattggtccagatgatggtccccacatcttctcaatcaggatactcatctgacccacagtctgaccagaacaattcagatggtaaagctaaatctttctactcctttgtatcagcgttctaaaataattgactcttccttcttcctctttctccctctaaacctttgatacagagtgatgcatttcttgcatatttgtttaacatcccccttagcttctgggctgcaagacaatagccatgcacagtttacagaaggaattccctcagccttcataacaaaaaacaaaaaaccaaagcaaacaaacaaacaaacaaaatcctctgccctattttctgtttgcactggagccttttcttttctcattctcctactttctgctttagagccactaagaaacccagtctccatctgtgcctgctttatagccagggcagttctcacttctcactaagccatgtgttgcccatatgtctgtgtgctatgaacgcaagaatctctgtgaactatcactgtttaagttgcagagagtcagttggtcagcgcttctagtgttctgggtcccttgacccagctcactaatagaaccagatgatgctgaccagaaagacatctggttcccctagttctaaacaagtatattattaaacaaaaataattttgctgtgaactttttggcttagttttgtcacggtttaccacatctttttccctgctgcctcctcctttttattgcagcacaattagctaaccatacaaaccaaacaacatagaagctgaacttctagattaaataaagcgtagggcatcttgagagttggtgtgatgctgtagtaaacaaaagccttcagtgtgtacaatagaagagaacacgattgttaataaccttgtaatttctgaggattttcaaaaaaatttcttagttttcttccttcttcatattttgctaactccaagtttttcctgttaatttgtgttgatcaatatcttccactttagagactttcctcttatgtctggtaatccttttgttcacgattaagagtggaggactaaaaactaatcggaaggtcagagtacacgcatctctattgtaagcttcaatgaaggatgatctacgtgtgttatttgttgggaaccacccctgtcagtcattttaggtctttcatcttgggctagtcagggttcccagagaagaggctaccaatctcccacctggagaagaagatctggcagccaagttcttgatgctcagttggaaaaagtgcttgaatatctctgcactcagcattgagtcacttagttagcctagcaaccctctgttttagtatctctagagtagtgggtaattcaagaacaattttggccctcacctccaccagagaacatgtggtaaggtctggagggatgggatcttatgtgctactgacatatagtgagtagagggcaggcatgctgttaaacatctacagtgcccgggacacacacacacacacacacacacacacacacacacaccccactacagagagttatcttgtccaaaatatgaatagtgtcagggatgaagaaccagaatttaggaaataaatctccaggcttctgtttggggtggggagagacagttgcccagatttatggagtaggggctggaatctagagatctatctacttcttaagaatctctaactcagtctcccttattttcatccccactcttaacccagttccaaaggtacacggtgctcccaagcttgaagattgtggtgtaaatcagatttttttttccagctttctctactgttggcttaggattcaaagcagtctctggtctgctaaattagtccatctattttcaagcttccaaatttttgttgctcttatctcctctcctgttttccttatccatatgggccctcactcttcatctctagttctggtagcgtttcaagaggaacaaaattatatgtgtatattcagtctactattattaatccagaacctgagatctctagttctttacatggagatatgtccatagtatattaaaaagtaggttacaatgtattttggaaagtatgattctattattttaaaaaacaaggcaaaacacaaactttctgtaactatttctaatctttttgtgcatagaaaaaaatctagaagaataaaataccagcgatggttatgtccaggtggtgacaggacaatggatatttactttctcccttaagcttttatatgtagtccaaatttttcataatgagtacttacttcatttatatacagaggtcccagaaaaattataaaacacttgaaaataacacaaaagatgatggtatgtccttggagtgtcaaactggaacactgtttaacaggcctacctggagaattctataggaaatcatgcctttgtttgacataccatttactgtccactaaggccctagctcaatgaagttatatgttgttatatttttgtccaggaaagatgcaaattatttgtatctggtataaactgtaaccccaaggttatggatttaataacttgtaaaacacttttagatctaacctaacactcttaatgcaacattctttcatcagttcctacaaatactaagttcattcaaatgctctacgcactggctttgtcattttgttggttctctcattagtgaattaaagaaatctttgacacatgtttatatttgtatgagaattatgtttttaacttttggaaaattctactttgacaccagtggaatcataagctatttccaatttgaggatagaagaaaaaaatccaatgaatacctcaaccatggcaaagagaacatattctgagtccagccctgatcgctgtcctgccttgtcccttggcagtgcttaaattggatgtgtttgagccctgactcctgcacatacctttggacagccagcaatgctgagagatgtgaggttaatgcagtaaatggccagtgctttgataatcatatctgacagctgggagcaataagagacatccaaatgttccaagatcagtgagcttttgcagaatgcctgcaaaaaattccaaggtcaaattttttcttttctttagtcatctagaactgtcttacttatagtagcttattaaatgtacatttcagtccctgaaatacagatgttagatcttgatgcccccaaaaaataatttaaaaaacccatgttacatccaacatctgtttatagcaaaagatattcacaaagcagcttaacagcttagtgatattcaaatgcctgctaacaaaatttggttttcttgaagttaggtctaatgaagtttgactcatatggtcagtaatgagtagaagaaaagaaatctgagggtaagattatatggcagacactccaagattgacagtggaatgtaatggaaagaacagattctttggaatcagacagacccgagttttgctttcgtttccaccatttattacctcttaaatcttagcaagttactatctttctgagcctgtttcctttttttttttttttttgagagtcttcctctgttgcccaggcttggagtgcaatggtgcaatctgagctcactgcaacctctgtctgccaggttcaagtgatcttgtgcctcttgtgcctattgggactacaggcgtgcaccaccacgcccggctaattctttttttttttttttagtagagatggggtttctctaggttgcccaggctggtcttgaactcctgacctcaagtgatccaccctcccaaagtgctgggattataggcatgagccactgtgcccagctcctcttttttaacttagggaaaataacatctactctctagcattgttttgaaatgctgaaatgttcacctgaaatatctaggactagaaaaaggcctggaaatcattccctttatatcaatacttcttaattttcattcctacttttcagttaaaaaataactcagtgataagaatccatgaggaaataacacttaaaagtttacaactcagcagttatacaagaacaaaacaatccacaaaagtaaacctaaccgtaattgtaaaaatatatttaaaaagcaataggagtagaaattggaaaccatgatgaaggaaggaaggaaggaaggaaggaaggaaggaaggaaggaaggaaggaaagaaaagaaagaaagaaagaaagaaagaaagaaagaaagaaagaaagaaagaaagaaaagagaagacaagagaaaagaaaaaggaggaaatttcctcccccaaaatgtgagaattattataattatctacatgtgctcaatcattctaagaattctgcctcattatgaagcagctcctcttagaatacaaagttagagacctcagtaaatggtagtttaccattaattttagttgtaagtactagattttagtaaccctaatgggttactaaagatacttcttatttatatataaattatatatatatatattatatgcgattatatatatattatatatatgtgtgattatatatattatatatatgtgattatatatatatatatatatgtgatgtggctcttagcacaaaatagattctctagctatctctaagattttatatactgtgttagttgagaggcagtatgcacactggctagtgcttggcacatagtaagcaccccataaaagttaactagtgcttacttcagcagcacagatactaaaattggaaaaatacagggattagcctggcccctgaacaaggatgacacagatttgtgaaacattcaattgttttttcagttaggaggagaaagttcaagagatctattgtatatgatgactatagttagtaacgatgtattgtatacttgaaatttgctaatggattttaaatgttctcaccataaaaagtatcataagtatgtaaggtgatgaatgttaattagcttgatttaaccattccacaatgtgtgtgtgtgtgtgtgtgtgtgtgtgtgtgtgtgtgtatcaaaacagcatgttgtacttcataaatatatacaatttttatttgtcagttaaaaattttaagccattaaaaagaataaatgttaactactatcaggatttgcacatgacaccaataataataaagatgcacaaatgtattgtactttgagaaaaactgaaagatattggttatttaaccctaagtcatcatcttttcctgaccacaacagccaacagtgattcattctttgatctcatgcagaacttgtctttttcaactgattcagcacttagggtatttgactcattcctgtactgcatgaaagtctgtcttgtctggcaactacgtgatggcaaaaattagaaggggcagcttgtcaggagatagcttgggacctgtcactggagataatcaagcatagtggggcacacccaaggaggtacagaaaggaatctacctttgaattattggaatcagtggcctggaatctcagtttggagattcaataaaaatgcaataagccccttgtactgcctggaaatctgctagctttcatatccctttcccaaacatcatattagaacacagtaagtgctcagtacatactagttggttcactgatcctttatgtcttcaagaaaattaagaagtctcttttaataatacaagaatttttatgttgcaagaagtaaggtgacattgttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccgacattgtttttcccttgttagagacattaacattgttagagagaatggacagagttagaggaaccagagaaaaattaaagcaagaaagaatatttaaactataagaataatttattgaaggatgaaacaagctttagagggagattcaaggctcttcgtgtctgaaaaccctcttcagtagcatctgccaatgtcttggactgctcgaatcaaatctgccttatgcctttttaaaagctctaatattctttaaagacaaatgttctcagaggttttaaatttaaaactaacttaaaaatgattacaaggtctatgatacattcatggtaccattctcatccatggaaaatctgaggcacaaaaattggtctaaggctttatgctaaatcagtggcagattggcgaactaaagtcagaacttttcctctcttagaattcgtgttttcctttaaacacatataagtcatattaagtacttaaatctgcaagcatgtttcaacataatcactcatgaaattccatttcccccctacagataagattacaatatacacttctggctccaatgctgcagaatcatacttctatcgatgctgctgattttctttccttggaaaatgcaacactaaatttcttccaagtcaaaatcttttacagtaaagacagagataaaaatgcaaacattatcaagtttggctcctttcccatgtatcagccaattttgctgtgtgttggcaatctggaagaaaacttccatatctcttagcgagttagatcattccttcttgtgtcttctgagctgagtcacagtgtaggcacttaatgactacattcctaaatagggtacgtagaggagactgaatttcactcacatttattgactgtcacaataatgtgcttctgccaaaatcctgaattaaaccactttgacaggtggcagcttctagccttagaaaagctcacttcgtgttgcatactcataacaccatctcttgactatttgcctcattaggtcccaattaattctactgcaaagttggggagtttttccctgttggtaattctggaaaatatgtgctgtcaagaaccattttctataatgaagacatttttggctgccccaaaggctaaaatgcaacttccacaattttaagatatcaactaaatacaaaaacttcagtttcttgggcatatcccaagatatctacttcgcatatcccatgagatggagagctacactccaccaacaatggccttgttcccactgggcatcagagcaagtgggactggtcatggcctggcaccacaactaaactctgcagagcctgaaggtgcccctcctggagatgccactcttgcattcccaccttccctgccagggaaaccaggctgagcaaggcttagcaaaggcccagcctcagagaagctccctgttttaaaacatggagagaactctgaaagggaaagggggataaggccaaggaccaaaacaaatatttccaaagacactttcatgatgaaatttgttataaaattagatggtgatgtgagggataaactttggcttcaaaccagctcaaatgtggtttattctacagtcttccccaattcttctctgtggaagagatgcgctttcaaattcttataagcttttctttctttttgacagggtcctgctctgttgcccaggctggagcatagcagcatgatcatagctcactgtagcctcaaattcctgggcttgaatgatccttctacctcagccttccacatatgtgcatgctaccatgcctggctcattttttaatttttatagagacagggtctcactatgttgcccaggctgatctcgaactcctggcatcaagtgatccttcctccttggcttcccaaaacgttgggattataggcatgagccactacgcccaggcaactttctcactttctacttgtattatagttattcatgtaagtgtcttatcttctgcattgactgtaacttcttgagggtagaatccatgtctaatttatctttgccaacatctggcatacagaattagttcaagatgagagagtatccaaaatgaatgaagaatgcttctcagcacaggagtgaggagaatgagcttccatatatggccctcagaatactaagcccagtccttcttctcactcggttcagtaactgccagaggcagcatacagggttggttaagagcacagtctgggggcccactggcttgagttcaaatccttccatgagatgttttgtgtctctggataagttactcaacctctcttacccctcaatattctcatcagtggtgtgggaataacacaggagtagcttaatatgaggagtagcacctacttcatagagttgttggggagattaaatgagttaatatgaataaagcagttgaacagtaccttgcacatagttagcagtcagtagatagtagctagtattattatttgtatgcactgcttctctgtggctctgattgccaaactttttaaatcatgaacaccatagtaaaaaaaaaattttttttttgagacagagtgtcactctgtcacccaggctggagtgcagtggtgtagggaaaagagagatcagactgttactgtgtctatgtagaaagggaagacataagaaacttcattttgacctgtaccctgaacaattgctttgccctgagatgctattaatctgtaactttagccccaaccttgagctcacagaaacatgtgttgtatgggatcaaggtttaacggatctagggttgtgcaggatgtgccttgttaacaaaatgtttacaggcagtatgctgggtaaaagtcatcgccattctgcagtctcgataaaccaggggcacaatgcactgcagaaagccatagggacctctgccctggaaagctgggtattgtccaaggtttctccccatgtgatagtctgaaatatggcctcgtgggatggcaaagacctcgtgggatggtcccccagcccgacacccgtgaagggtctgtgctgaggaggatagtaaaagaggaaggcctcttgcagttgagataagaggaaggcctctgtctcctgcctgcccctggaaacggcatgtcttggtataaaacctgattgtatatttgttcaattctgagataggagaaaaaccgccctatggcgggagacgagacatgttggcagcaatgctgctttgttattctttactccactgagatgtatgggtggagagaagcaaaaatctggcttacgtgcacatccaggcatagtacctacccttgaacttaattgtgacacagattcctttgctcacattttcttgctgaccttctccccaccatcaccctgctctcctaccgcattcctcttgctgagatagtgaaaatggtaatcaataaataatgagggaactcagagaccggtgctggtgcaggtccttggtatgctgagcgccagtcccctgggcccactgttctttctctatactttgtctctgtgtcttatttcttttctcagtctctcgtcccacctgacgagaaatacccacaggtgtggaggggctggcccccttcacagtggcatgatcttggctcattgcaacctccacctcctgggttcaagagattctcgttcctcagcctctagctgggattacaggtgtctgccaccacgcccagctaatttttgtatttttaagtagagacagggtttcaccatgttggcagctggtcttgaactcctgacctcagggatccgcctgcctcagcctcccaaagtgctgggattacacatgtgagccactgtgcctggcatagtaaaaatattttgagcatacactttcagtaaatgtatattaatgtactttgtaaattatataggcataaactattcaaatatatattatatatttaaacatataaaatagaatgtatgagataaaaaataaatctgacatttctagaactttcaatattttcttgtcacaccaaaaaaattgtgttgttcatttgctggagtacatgctttctctagagacacctacccaacagcacacctttggttgccagtaaatcttgatggcttactggctgcacagatccagaacattttgtaaaaataaaggaattatctttaacatataaaatttgacagatgcataaaaagaaggaaaattggaagaaattaaagaacagaaagggtaagcagtgaaagagaatgtatattgggaaaaccaaaaggaaagatgaccaggaaaagaccaaaacaaaatgtctttgaattgtacttggtaactagaatttattgagaaaaattttagaacagcttcaggttttagattttctctccaaaataaaaatgaaccaggattgaattacccaaatggcaatcagatatttttcttgttgcctgtggcataacccacactttttacatttctctaagtttatttcaaaaagtggtgcctagtggcccaattacctggcactagtccagggtcctctgtggggcaagaaaggcgggggaattccttaagctaaaataatcagccagaaagagttgatgggtgtctatttgcacagccagccacctcactttttgttcttagtctttcccaagaaaatgacaactcataatgtttactgtaaggacagtcacagcatcctatgacctcttccatttaaggatctctaagaaataaagagttcacgaactattatcagtactgctttcacctcccatttgcggacataatagaataagaggtgatctaatcaagggaggctaccagtctagtggaaaaaaagagagcctggaatctgaaattgtatctatgtgaccaggaacaagtcatgttacctcaagtttcttcatatataagaggagaaagaaaataactgtctacctatctcataggcctattagaagattaaaagaaaatgtgtattccaaaagcacttggaagacatggaccctggcttttgtctgtgaaccagagagatcctggaacgatcctatctatgatgtatgtgatgagggctttaggatgaggaaatataatgaacaaaatttaactggaattgatagggagggttattacaaattataacatggagaaatcatagctcctgtgagacatgccacaggcccttggtttatgtcaggcaaggcacaatgagcaaagcctaggtgtgtcacatagaagagggatcaaaaacatatcaaaaacctaaacataggtttaaaaaacaaaagaagcaaacattctgatgtttattttccctttttttaaatttttgccttcagacaatctgacagtttttttttttttaacttttggcaagtttcatcttacaaaggataaactaatgttccaggggcagcttaaagagtgggagagggctcctacggattatcttccttttaacacattctcttttagttctgttctgtggatgctcaatatgaaaagaacagatgtgcacattcatttagcaagttcagcagtgcttcagttgtctgagagtggttcttccccaatgggagtgggcaagaagccaggactggtgtggggtgttctcagcttcagctgtttttcggccaagaaaacacagtacccatgactccagtatcccttggaaccttacagacaatgggaaactgacaaactgtcaaatcccacatcctttgaagtctagcaaatttctaattcttttgaactgcctccacaattagaaacacactagtgtcaggagccacagagaatactgtttatttcttttgctcacaggctttgaagaaagaataatgcctgggtatcttggcaagagtttatctgtgactcccagttgattccaggtgtcttgggtctccaggagtatgttgttctattataaagtttaggaaactatccttggcatggatagccaagcagcacagatttccatagtaaaactcttaattattccaggttttgtagggggttgctttctccacaagctaccagatatccccactacccttcattctaccagaggaattccttagtttcctctcccaataccctgtaaaacacttctaaaccagagaccctctggaatctccatcatagacagtttagtcaattatttcctaatcataacctggagtattggatgagaagagagactttgccaagcaatatggtcaagagacaaaagatccaaatgtccggacgttccacctccccatacaagagatttcagagcttctgctgcaacaaaggccaatgattaaagtcattttggaaaggagtcctccgttgcttctgttgcgaaccataaacacaacttgtaaccctagagaagaggtggagttactgaaatctcatgctttgataattactgaatgacttaatcttggaaaacaaatagaaatcaatgttgagttctttaaaaaaaaatgttgctacatggagccaacacatctaatccatctttggcattacaagtcagtatgtgtcaaaggctaccaaaatcaactttggttgagcaccagggggtggagtctatcaactgatgagaatgattgatgagaatcttgcacaaacaacatttataactagttagaaagtttagtgattcaaactaagtatttaagatcagaagagagtcactggagaataatccagttcttgctgttagagcacatgaactcaacccttcttacactccagagaggaatgtgtagaacaggctggtcataggccattgtcggggaggaagattttgactggactgttgctgaatgaggtaggtactcctgggcctttctgacctgagtatccttgtagatgttccttacaaattctaggggtttcagttccatagcacagatagtccagagtacaagactcagaactctgaaccctcagtttctacttagactatgcctggagccactcaacttactgaacattcctgggtcagaccaaaagtcaaatgaacagcaatgactgttgctctgttgttctcccaactatgaagtagcttatgattgtgccacatggctgccgcccttcccagtcccttatgccgaatccctcctcctctacctccttttctatttgtaaatcaagataaatgttaccaaagggcaaatttttaaaatcgaaagtttataatctaagagaatgtatcataaaaggttatgaagattaagggagagaaggagtatgttatttcaagtggtaggccgggcatggtggctcacacctgtaaccccaacactttgggaggctgagacaggcggatcacctgaggtcaggagttcaagaccagtctgaccaacatgctgaaaccccgtctctactaaaaatacaaaattacctgggcgtggtggcgcatgcctgtaatcccagttacttgagaagctgaagcaggagaatcacttgaacccaggaggcagaggttgcagtgagccaacatcgcaccactccagactgggcaaaaagagcaaaactccatctcaaaaacaaaaacaaaaacaaaaaacaaaaaaacctgccacagcttttaaagaaaggctgggtacggtggctcacgtctgtaatcctagcacttcaggaggccaaggtgagtggatcacttgaggtcaggagtttgagaccagcctggccaacgtggcgaaaccccgtctctacgaaaaatacaaaaaattagccagacatggtcgtgggcacctgtaatcccagctactccagaggttgagacaggagaatcgcttgaacccaggcggcggaggttgcaatgagccaagatcgcgccactgcactccagcctgggcgacagagcgagactccgtcttaataaaaaaaataaaataataaaaatttaaaaatccaatgtgaagcagctagagcaagattgagggtctcaaaaaagacggggcctgaagaggacaatgagagaagtggaggttctaatatctctactgccgtttatactccataagccgaagtcagatacctaagtgatcatcagacaacagggtgctgacctaggttacacccttaaaattcatcagtggtgtcatctgcaagatattagtaaaccagcttgtgaagaatataagccacaaaccaggcagaaaacacaagagagcagatgaggctgaaccactaccacagacttccttcttttgtgtaattataaatactacccactgcattctggtttcagggctttaaaaagcagatgaactgtctctgttagagatacttttttataattaacttcagagtcatttattaattatcttttatagttaataaaaataagagggagctatgtttgggtttggagaacaatgacgattatcgaagtctgaatcttcgcctcccctccaaaccagaaaatataaagagaaaagaaataaaactgcacaggacccatacattcatcattactagaactaagagaacaatacatccttcaaattacttgtaggtagagtaaaaacaaattcaaacagagctcccttagcctgcctgcggctgccacaaacctaaagatagagtgggagagagaatgcctaaaagactgtcgtaagagtggagaggtgaagagagcttagaggaaacacagacaaaatcatgccatattaaaaaaactgtttttttctctatagtcacaccactctcaatacttccagaacacttcacttctgataccagatgtgtgggtttttctatacactgaccaattctgtgacaccaactggatgttctacaatttaattcaactctgacattaactggagttagcacagaccccacaggttaagagcccaatcccagtagatttcagatgccaatcgcaagtcccaggttgtcacttggacttctgatgaaccagctatatattagtgttcccataactacctccttgggcttgataatttgctaggacaactcaaataattcagggaaacatgtttaccagcttattatataataaaggataccaatgaacagccagatgaaaaggtacatagggctaggtgtagaggtcctgagtgcaggaacttctgtccccacagagttggagtgcacccctctcctgacatatggatgtgttcgccaacctggaagtactctaaaccctgtagttcagggatttttatgggggcttcgtcatatagacaccatcaattattagctcaatctccagcccctctccccttcccaaaggatggggaatggagcagaaagttccaagattctaatcgtggcctggcctttctcatgaccagcccccaaccaagaactcaccaagagtcacctcattagaacagaagatacacccaggaaactccaaggaattaggagttctgcatcaggaaccatggtcaaagaccaaatattagaacaaaagatacctattacccctattgctcagaaagttacaagccctttaaggagctctgtgccaggactgtggataaagaccaagatatatatatttcctataaatcacatactcacaagaagagaaattttgacaacagtaagtgccaaaatactgaatagatcttggtagttcatagggcttgaaagcggggacaccaccaacattcctggcagccaagtcagatgcatggacatcgtctttaaccacatcttcacactcatccctcatctgaactatcaacaatttcatggattttgctatctaaatgttcatgttctctaatccatttccttctccccagcctccctgttacttcccttgttcaggttgctatcctgtcacccctggactataacaaaaacctcttagattcctaccttcactctccttttccccttctgctcttcaatgtaacttccactttccttgttaaagtgatttttctgacagataaacttccctggcattcccatgctggattaggtacctcgcctgaatcctcccatagcctcctacatacctttatcacagcattatgactaaaagcatccttttggaattagacattttatacactagctcatgtacttacctgtttcatgacttgggagaagtttttaacctcttggaacctccagtttgtaaaatggaattaaaagtattgcctacctcataaagtaggaaattaatacatggaaaatacaacagtgcctgacatgtagtaagggctaaattgatattagctgacaaccaccacatagtattgaatttttctgcttatatatctgcctaacccactaaacctagcctcatcatttaaaaaaaaattataatgatttctgttttcaaaaaacaaacagattatccatgtcctctacatggaaagtctaatccaaaatgttttgtgttcaatcactgagcaagatggtcacattttcacaaaattaattaatctgaggctgggcatggtggctgatgcctataatactggcactttggaggctgaggcaggcagatcacctgaggtcaggggttcaagaccagcctcagccaacatggtgaaacaccatctctactaaaaatacaaaaatgagctgaggatgatggcacatgcctgtaatcccagctacttggaaggctgaggtgggagaattgtctgagcccggaaggaggttgcagtgagccaagatcgtgccactgcatacaagcctgggcaacagagcaagactcagtctcaaaaaaaaaaaaaaaaatctgaaatgagatggtttgagcatgatcttacttgaaggtatggagtagcctaattaatcatctaagctctttccaacttgctaattgcaaataataccccagtgttgtactaaggaagcttaatggacatgaccaaagtgcctgaactttgggacagccacaggccacctatgcaagcacagccagcccaccaggctgcagggtagagagcacaaacagcatttgcttatgacagccacaggctcaatgctcactgacggtggctgtctgcctgcccagctaacctgtagttcttctgtatggcctacactctaagaatggtgtttatatattttgaatggttgaaaaaaaagcaacagaagaataatatttcatgattatgtgaaaatgatatgaaattcaaattttcagtgtccataaataaagttttattggaatacagcaactctcatttatttacatattgtctatggctgtttctatgctcaatggcaaagttgggaagttgcgacagagactgtatggcctgcaaagcctaaaacagaaactacctgacccttcaaaactttacaggaaaaaaaaaaaagcctacccctgctctagggtgcaagctcctgtctgcttcacaattgtagtcactgtaggggaatgaattgttgtgggccaagtgaattgcttaagaaaatgtggccatgtaagaggcagaattggaataaaaattaggactcttgacagctagtcccacattccctaaattatattattacttttgctatcagagagctaatccacacacttccacaggaaaaagagctttgtcatttaaatggatgattaatttttaaaataaaacatagacaaaaaggtaattctttaacactcaatttttttttctttcttttcttttttttgacatggagtctctttctgtcgcccaggctggagtgcagtggtgtgatctcggctcactgcaacctctgcctcctgggttccagtgattctcctgtctcagcctccggagtagctgggactagaggtgtgcgccactatgcctggctaatttttttgtatttttagtagagacagggtttcaccatgttgggcaggctggtctcaaactcctggcctcaggtaacccacccacctcggcctcccaaagtgctaagattataggtgtgaactactgcacccaaccaacaaaccaatttttattatctgctttaaatactgaccatcatctattggttttagcctagaaatgtataatcacatagcatctctctatacacaatttgggtgtaataaatacatatacacattgacatatgtatatgatctaatatataccaaggtgtatacatatatttaatttacctacatatactagacatagatgtacctttacatatatttgcatgtaaacacacatatatgcacactttcactgcatacacacctgccagtccttctggtgcatcctaatgaaacctgattttctcctgctaatgacattagcacctggctgctaatgacatttcttaatcaactacctcaacctgctaacactgaaataattagaaatttttgtctagctgcaagattttcatttagagataatctgcataaaaaatacacattcgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtagtggcgggcgcctgtagtcccagctactcgggaggctgaggcaggagaatggcgtgaacccaagaggcggagcttgcagtgagccgagattgcgccactgcactccagcctgggcgacagagcgagactccgtctcaaaaaaaaaaaaaaaaaaaaaaaaaaaaaaaaaaaaaaaaaaaaaaatacacattcgtgtgtacggatattatataaatgtatttatattatgcttcattctaggaaagaggaatcagaaatgcaaaccagattaagagtataaaaagcaaccagaggccaggcacggcgcctcacacccataattccagcagtttgggaggccaaggcaggtgcatcacctgaggtgaggtcaggagttcgagaccagtctggccaacatggtgaagtcgcatttctactaaaaatacaaaaaattagccaggcatgatggtgcatgcctgtaatcccagctactcgggaggctgaggcaggggaatcacttgaacccaggatgcggaggttgcagtgagtcgagatcgtgccattgcactccagcttgggcaacaagagcgaaactccatctcaaaaaaaaacaaccagagtaaataattggatttattccattggttctatcaaaacaacttattaagatggaacttctaatacgtctgaactgtaacactgcatttaagcccatttctttgccatactttgccgtctgttatttaactgacctcataaaatcctcaagaaaacgatttcttaagaaatgctcagttacagctgcatcaaacatcttctccaaaatgcctttcaagagcaccaaataattttagtgtaacataatcattgaatgtctgttgttctcagaaaagaactaacgttggagaaagtaattaaagccagatcctaaaagtcaatacatctgaggctccagacactgactctgcgtgtgctgtggtttccactaaacactaaaatgaggtaattttttattcttattatgttcacaactcttgcaaaacctaaccagggtaaaaaatttattcatttttctcattaagcgaattatgtagtgtgtaagttttcaatgtcttgtgctaaaaacagaatctctcctatagttaccttatctaagtaacgagagagcattctttataaagtgcagataatctaaacatctcaatttactcactttattttattctctttccttctctttttaaatccaggtaaggaattgtgaaattagtttgtaagtcactttctcctcccccggctttgtctgttcccttttgggacttaataattgggctggaggaggcaaggggaaagattaccacatgcccagaagtatgaatcttggaagaggtaaaactggttaaaagccacaacacagacacacacgtaccaaaagcagggaggagaaaaagaaggatgagaaatgatgaaaaagaaaaatttcagggttgagggtgaggggagggaactcagagtacaggtcaataggtgcagcaaaccaccatgacacacgcatacctatgaaacaaacctgcatgttctgcacatgtatcctgttttgttttgtttttttagaaaaaaaaaagaaaaatttattgttcatgaatttgagtagaacaactaatcttttagattactgaaaataaatacatgtcagtttgtaaaagattaaattgttttaaagatatgccagaactcagctgtatggtcatatagttaccaaatgggtaaatgctttcatctacaatctcagagcacctaaaaatagtacaatttttaggctccaaagagtgaaaagaaaaatgtctggaccccacagaatcaaaaaagaatgacagaaaacactggtctcctgatacttaacatcaaactttggccaatactccttcatcccaaggatgagaggagcatctaaaaattaatcaataatgtacattaagaggctatgtcatcaccatggtaggtttcaatacttctaaatgatttctagttattgttcaaatataactgatcaccatatgagaaatataacccagtattaaaaatgttaatattttaaactgttttgtctagtctatcaccttgtcaaagatcttttgaaagcctgactatatcatattcatagataaaactttgtataaatgcatgtttaacccttaagttaattgcagcaggtaaatcatggcttaactttagaggaatctttcaactttttgtcttagtaggttacatacatctaaatgatttgtaaccctttttgttattaaagagttacaatatttccaatatggaagtttctagtcctctctgggatatttgttttgtgttcatttatttaactctacactattaaatatactaccaggcagatttcttagggacttcttagaacattagtatccctggtctaaaattgggggaaattgacattatgtgacactaatgctccttaaagcagattcccttaagtatgattacattgttcccagtgagcaacagcagacccagtgagaaacagcaaaaataatttgaaaacgtttttctctcactaagctgtcaaacaaccattcagaacagcagttctccgtttctacctttcattttcataaaactgttactgaattagtttgctgagaaggtataagactttgggccagtcatttaagcgctcttggcctttgaggtaattttttattcttactaccttaacattagggagttgctttagatgtttctaagattctttcagctccagaagtttagaattcaatgctagaggtctagagaatcttttgacctggaatcctctacagcccacactagttgggatggtattttaacagtctcctgttagtcatgttaaaacttctgggaaagtctacttcaaattgacagagataatttaaggtttgccatgctctgtggacttctcagctattattgcattatcttcctacttgtgggacaaacccttttataggtttttctttctctctttcttccctccttccttccttccctccctccctcccttcctttcttccctttccttcttctccttctccttcttcttttcttcttcctcctcctctcctcctcttccttttccttcttcttctctctctctctctctctttctctttctttctctctctctttctattcctactttagcttcaggtttttatgagtgattggggttttaaactctcaaggcacatttatctagagcttccaatgtgtttcagtgcttgtattcctaggttactgcttcccttcttgttcaatacatgtatgacacatgactttggggttttttctaacagcatattgatatgcttgaagtgatgaaaaaattacactgtggcttgctcacaatatgtactttatgacttcctacacatcacttaagattaggtctaggaattttacttttctcacacgctcttgaagaatcaattgagcacgtaatcatttatcctagccaattacttatctcatgctttccattcccataaaggatgttaggaagtatgtttgagtaacttaagttcctaattgttgagtatctggcataatttttcaaactcccccaactttcatgattagatcatataacatttctatccacagaatactttgtttatatgagaagacttttaccacactgcagttcatcgctctccatgtaaaatatccctgtttattttgaatctgacatgaggaagggagagagtagacagggaaaaatgggaaaataaatctcaatcactttggctgtggagacctaactaagagcctggaggtgaacttggttcaactaagatcacatatgtgttgttacatttccaatccatttctgttttttctactgtgacccacaaaatttattcaatttgtacttaattaaactaaaaagtttcagcacagcaaaagaaacaatcagcagagtaaacagacaatgcacagagtgggagaaaatcttcacaatctatacatctgacaaaggactaagatccaaaatctacaacgaactcaaacaaattagcaagaaaaaaacaaacagtcccatcaaaaagtgggctaaggacatgaacagacaattctcaaaagaagctatacaaatgtctaacaaacatatgaaaaaaaatgctcaacatcacaaatgatcagggaaatgtaaaccaaaaccacaatgcaaaaccatcttactcctgcaagactggccataatcaaaaagtcaaaaaataatagatgttggcagggatgcagtgaaaagggaacacttctgcactactggtgggaatgtaaactagtacagccactatgaaaaacagtgtggacactccttaaagagctaaaagtagaactatcatttgatccagcaatcccactgctgggtatctacccggaggaaaagaagtcattgtacgaaaaagatacttgcacagacatgcttatggaagcacaattcgcaattgcaaaatcggggaactaacccaaatgtccatcaatcaatgagtagataaagaaattgtggtatggaatactattcagccataaaaatgaaacaatggcatttgcagtaacctgggtggaattggagaccattattctaagtggagtaactcagtaatggaaaaccaaacattgtatgttctcactcataattgggagctaagctatgagaatgcaaaggtatatgaacgatgcaatggattttggggacttgggggaaagggtgggaagtgagtgaggaataaaagactacaaattgagtacagtacagtgtacactgcttaggtgatgggtgcaccaaaatctcacaaattaccactaaaaaacatactcatgtaaccaaacaccacccattccccaaaaacctatggaaataagaaataaagtgaattaatcagttttcaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgatgaatgggatctaattaaactaaagagcttctgcacagcaaaagaaactaccatcagagtgaagaggcaacccacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttctgcagccaaaaaacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacactgtcggtgggactgtaaactagttcaaccattgtggaagccagtgcagcgattccttagggatctagaactagaaataccatttgacccagccatcccattactgggtatatacccaaaggactataaatcatgccgctataaagacacatgcacatgtatgtttattgtggcgctattcacaatagcaaagacttagaaccaacccaaatgtccaacaatgatagactggattaagaaaatgtggcacatatacaccatggaatactatgcagccataaaaaatgatgagttcatgtcctttgtggtgacatggatgaaattggaaatcatcattctcagtaaactatcacaaaaacaaaaaaccaaacaccgcatattctcactcataggtgggaattgaacaatgagaacacatggacacaggaaggggaacatcacattctggggactgttgtggggtggggggagaggggagggatagcattgggagatatacctaatgctagatgacgagttagtgggtgcagcgcaccagcatgtcacatgtatacatatgtaactaacctgcacattgtccacatgtaccctaaaacttaaagtataattaaaaaatagtaaatatttagctacattttaatactttacatgttataacaatatcattaattttgttgtttttaagctttatttgtacttgtaaatttttattttgtagttacttaagaactaaaggcaaaagtgatttatattttgcaattctgttatttcaataaaaatagtcctttttattcattggaaaaaaaagaaaaaaagaaaaatttcaatcttaattctttaacagatgatcttaatgatcttacctgaattccatcatcagtgattctataacattcagatacagaaagttccttcaattttttatgtctggaaagcacattcaaaccctaaaaatatttaatataaagatcattttgtgattatcatttagtatggaatatatagttccaataaccatttatacaaactgacaacataaaaaaccatttatgaaaactaataaattttagttgctgtcatatttctttacacttaacaaatcgtaagaccacttagattaggcaatgccattaagtaaaattttcaggttgtctctaatgttttacaaaagcttttatggaatcccagagtcagaaaactccttaggaggttattatcttgccacttgtttccagataaatgttatctgaatcaatataaacaaatccaacttactaatttattttgaagatacttcatgtggataaagaacctatttgttaatatatttttatttatgcctaaccaaaacatctaaaaatctttagctcattttataatgattaatcccttgaagaggaagagaatagatctttatataaaggcctagagacagataatcattcagtcatagatcatttctttttcaggttaaaggccttggatttttttaatttaaaaaaagagattgcactttcagccataattttttttatgtgtgcttgtgttgtcccatttctcagtactttttccccaaatttactggcacaacactcagataaggaactgactaatgtggcttattgatgccatccttctgtttttcaatcaggatcacattacttttatgtaatcccatacaatgtacttcttaaactaggtggacaagagcagggttgttccccccaccaccccccaacccacccctcacctgccgccattctatgattccagggctggctggcagggaaaataccagaaatgacacatagatttgtcctttttatattttatttgcaggattggtttatattttatcgatcttaaatacaacatttggaccacaatttaaaatgggctatgcaaatattatatcttgttttttttgtttgtttgttttgttttgctttgctttaattcccaatgcacagattgggccttctcataaaaaaaaaaaagcctgtattaataaaaatgttttatttaagcctctgcttaaactatgatttctaatttcttttaatggtattgcataccactccaaaataaaatctgtgaattcttttaactttttaaaaacttttatttgcatttattttatgctgaatttattcctgtgccataagtttttatttgtttcttcagtttcttcaggaatatctttttcttctatgcaacctcattctttcaatttgattgttgactgtggattcttttgctaggaacacattatgttttctgcctccctgtttcaaaacaaagtctgaccaaatcctgtggagccatcacatgtggtctgggttccagatgtggatgctattttattcatgttaaaagaattggaagagtttagatattccccaatagaatccaaattgtttgaacacaaatatcaagtaacagatgcaaagtttgtctctttaccctatacttgataatagctaagtatgttttagtatgctatagaaaatttgtcctatgaaactatctctgaagttttcacttagatttcacttttatgtagtcaagttagaattttttaagataagctgtaaatgaagtgcatttgctaaatatgacatataacaacatatatgcttactactttattcaaaatcattaaaaattaaaatattaaaacagaatgtcatgtctcatcactgtaattgttcattaaaacatatggcctaaaaattgaattgatcaacattattagccattagataaatgcataatgacataccacaacgtacctactaggatggctataatttaaaatacagataataaaatgcattggtgaggatgtggacaaactggaactctcatatactgctagtggaaatgtaaaatgagccagccactttggaaaacagtctgcatttcctcaaaaattaaacatagagttataatatgacccagcaattctactcctaggtttatacccaaaaacagtgaaaacatatgtttacaaagacttgtacatgaatgtttataccagcactatttataataaaatccatgcattcttcaacaaatggtgctcttcaataagtggtgctgggagaacttgatatctgtatctagaagaatgaaactagactcctgtatctccatatacaaaagtaaactcaaaatagactaaagaattaaacataagacctgaaacgatagagctattagaagaaaacagggggaatgcttcagggcattgatcttggcaaagattttatatagctaagacttcaaaaccacaggcaacaaaaacagacaaatgggatgatatcaaactaaaaagattatacacaacaaaggaaacaataaacaaagtgaagagacaacctatagaatgggagaagacatgtgtgaactagtcatacaacaaaggactaacatccagaatatacaaggaactcaaacaactcaatagcaaataaacaaatgatctgattaaaaagtgaacaaaggaaccaagcagacatttctcaaaagaagacatatgtgagggcgatgtggctgtgatatctgtcaccccattgatcaccagggttgattcggctgatctggctggctaggcaggtgtccccttcttccctcaccgttccatgtgtgtccctccccaaagctgcgtgctgggtcaaagaggatagccaaccctgatagaggaggatgggttattggtctaggatacaagtagctgcactcccctgcttgaacctccaaacctctcaggaagacatacaaatagtcaacaaatatatgaaaaatcatcatcagggaaacgtacatcaaagccacaatgagatgtcatctcaccccagttagaatggctattatcaaaaagacaaaaaataacaatgctggtgaggatgcagagaaaagagaactcctatacactgttggtgaaaatataaattaatacagcgattatggaaaacagcatagaaatttctctaaaaacagaactatcatatgatccagcaatctcactagtgggtatttacccaaaggaaaggaactcagtatatcaaagggatacctacactcccatgtttactacagcactactcacaatagctaagatatagaatcaacccaaatgttcatcaacagacaattgaataaagaaaatgtagtatatatacacaatggcatactattcagccacaaaaaagaatgaaatcctgtcatttgcagcaacatggatgagcctggaggacatgatgttaagcaaaataagataagcacagaaagataaataccacatgtcctcactcatgggagctacgaaaaagtagagtacaattgtgggaattagaggatgggaagagtggcagggagggaggatggggattggttggttaacaattacaaaattatagtttaataggaggaatgagttcaggtattctgcagcactgtggggtgaatatggttaaccataatttattgtatattttcaagaaactagaagagaggatctttagtgctcacaacacaaagaaaatgataaatatttgaggtgatggatactaactaccatgattagatcattacacataaggaaataacactctgcattccacaaatatgtacaattattatgtgtcaactaaaaataaaagaaaaaagtggaaacccaaatgcctatcagttgatgaaaggataaataaaatgttaggtccatacaatggaatattatttggtaataaaagtagtactgatgcatgctactatatgaacgaaacttgaaaatatcatcctaagtaaaagaagacagacccaaaaggccacatattgtttgattccatttgtatgaagagtccagaataggcaaatatataaaaacagaaagtagattagcagttgcctaaagcaggctcagggtgggacaggcataaggagtgactgctaatgggaagggcttttcttttgggagtgaagaaaatgttctggaattagattctagtggtagttccaccacaaacaaacatactaaaaaccactgaattgtatactttaaattggtgagttttatggtacatgaattatgtctcaataaaaaatgtttaaaaaaagattgatgtaataattgtataagtacataaaactcagaaaatattcctacagcatccttaagtccaagatgaatacagatgttacccacttttaatatatttttgttagcaacttcagaccctgatgacaaaaatagtagcaaaacggggagcaagagatgtcaccctgctcatgtgttagacaagtaactagaagccctttctgctgtaagtaaacacatctttgtaactgagcagcaacaaatcgagccggcagagatgaggcctccactaaaaattgcctcatgctggttacaggaggccagtgaatttcactgcctaataagtgaaacacactatttcaggcaacaggattcacttttaatgtgggttttttttttctcagaaactttttagattagtgacctaaagaatgtcagagccagcaaggtaaatattctgtttggcactgtgaggttcataaatgctccaaattaggaggtgttctctgaaacaagtgacatttacattttacagatttctgatgccaaggttttagccctgggagggacaggaagagtggagtgggaagagtggagtgggaagacaggccaaaaatgaggaggcaagaggtaacagcaagatagagtgactcggtctcagtggggcaaagggcagattgatgcttacctttcaggaaagctgtggcatcactgcaatggaaatcatccttggtctccctcataagtcagccaaactcatgaatgcttttgctggagagaggttttgcttttattttcccaaagcataaaaagggactacattttatggtcagctgaagtgcagaggaaagcagctggagtggtggcctggggaagtcaccagcattgcaagttgcatgagaatgtgaggcaccagaaattcacaggaatcctggggagcactttgctcctccattgctaatggaattaaggggcctgaatcttaggggcccaggagtcctgagtggaaaagtggcttcgttatagctccagtatcacgttcattgaggggcatatcaggacataaggctcaaaaggaagcaagcaccaagtcacaagaacctcgtacattattctaaggaatctggacttcatcctatgcaacagaattaaatagaactttctctctctggggaatatgagtgggtacataagtcactataatgaggttccttatgtaccaactcattctctacagaaagaatgaagtatgtgtttcaagagagctatagggaccacacagcagggaatgaatgcttccagttggaagaaagagatggcagtctagaaaagagtttcacagaggaaggagattttgaatcaagccttaaagattaagtatcattttgacaagtgaaacaatgggaacagtgtttcaggccgaagaaatagcatggacagagacttcatgtgcaaagtgtgagttgttgggaagtagttcagtttggggtcactgggagtagtgggagggaagatggaacactgccaggaacagacacatgcacacagacatttgagagcagacaaatccttgaacactacactttccccacactttttcatctggaattgtttagctgatgtacatagacaatgtcaatgaactagttaccaaatgttggaatgctctgtgtgtgtgtgtgtgtggtgtgtacttactatacggctgagtcatactacatctggcttagactatcaccaacataaacagaaaacatgcttccccaactctctattttgaaaatattcaaatgtacggaaaggtttaaagaatggttataaagaatactgacatacacttcatataaattcaccaattataaacatttgccacatttatttagttgagtgtgtatatgaacatacatattttattcatatatatgtatgaataaaattttatatacatatgcatagtttatatatagttatatatatatacacacacatatatatatacacacaaatatacataaatttccctgaactacttgaaaataagtttcagatatcatgatgctttatccctaaatatttcatgtgcatctccttaggaataacgacattttcctatgtaactatgtagtattatgcatatatagtatagacatatatagtattatgacacccaagaaaatgaacagtaatactgtaatatctagtacaaagtcaacattcaaatttttttgtatccaagacccaatttgtgcattggatttggttatcatgtctttttagtctttttttctttaaatttttcttttaagacattgactttttttaagggtctaggccagttattatgcagaatgtctcacattctggatttttctaattgttccttatgattagattcaaggtaaactttttttgcaaaaatactcctgaattattatagcatcccattgggaggcacatatgtccagttgttccacaactggtgatgctgttgggccacttggttcagaagatgactaccatagatctctttattagaagaggtatatttacccctttttatttaaaaagtaatttgttgagatgttatagtacacccagaatattctgcaaacatgagaagtgtttgttataaagaatatatagtaacatacttaggttcaaaaagcagtacacaaaattatatctgcaggccgggcgcggtggctcatgcctgtaatcccagcactttgggaggccaaggcaggtggatcacctgaggtcaggagttcacgaccagcctggccagcatggcaaaaccccatctctactaaaaatacaaaaattatccgggcatggtggcaggtgcttgtaatcccggctactcgggaggatgaggcaggagaatcgctttaacccaggaggcagaagctgtagtgagccaagatcgtgccactgcactccagcctggatgacagagtgagactgtgtctccaaaaaaaaaaaaaaaattcacatctgcatatgtgtgtgtatagtgtatgtatatgtgtattaaaagaaacagacgttttgggcagggcgcagtggctcacgcctgtaatcccagcacttttggaggccaaggcgggtggatcatgaggtcaggagttcgagaccagcctggtcaatgtggtgaaaccccgtctctactaagaatacaaaaattagccaggcgtgtagtccccgctactcggtaggctgaggcagaagaattgcttgaacccaggaggcggaggttgcagtgagctgagattgcactactgtactccagtctgggcgacagagggagaatctgtctcaaaaaaaaaaaaaaaaagaaaagaaatggacgttttggagggtgcgcaatgatatgaatatgttttttcattattcatatttctttttgtattactagtgtttgtgaaaatagcataatttggaggaaaaacccaatatgtgtctgttattgaatatttttgtgtatcaacaaagaattatataaaatatttacactaggctttatttctttatacaaagcaacacagttctggttagtttactttctattctaaacaaaccatcagcacaaatgtgctaatattcaagcaaagtactcagctatgaatgttaacatgtacaagtattatatacatagatgaacagttttactttacaaaaattgatggatactgctctatcttcatattacttgacccagctttgaagcctgactctgctgaccatcccctgctttttgaaatagcatcttccttgtttctcatgatattactctgacctctgtctccacctacttctctggatgttcgttttcagtttcctttgtaggttcatcttccaaatctattcaatacatactgatgttccctggagcttggaacttgaccttctcttctctttgtgactctcatccatggctttgaccacttcagccatctctagatctagcccagatctccctcctgagatacagatcttgttctctaactgataactagacatctgaatgtgtcataggcacctctaactcagcactgttactttcagagaactagaattcaaactggaagccatgagatttcattgagctcttcctattctttttgctagcttcagtcaggagtctgtgaaagatgaatgctcatgatggactttcctttgatttaaatacaatggctccttcctctgcattttgtacctttatgaccctctttatagggctccaatttctctatatgggaaatctatataacctagggtatttgatatttgaattcaggatattggaaaatgcactctatgaaataagatggaatggggcacccaggactccaggatgtagttactgggggtatagatcatgggaaatctaaaaagtcccccgacagtcagtaaacataagaaggcttctttcatgcctttttaatttgtttttaaggataaaacagagtataagtttttgctgtgatagaggggataaaattggggggggggatggtactgaaaatccttgtgtgagttttctttcagaaatgcttgaatttgaacacactgaattcctatgattccagatatcctgaggaaaacaaagcaaagtaaaacaaaacaaaaacaaagattccaaaagtcagatggatgtttgtcttctctgtcacccagaatcaaaggggcccatagtttagagagatgtgctagtactagtattaaacatgtccaaaatggaattcagtatcttgtctccaagccctaattgctctcctaggttcttttcctggtttgtggcaccaccatgttcacaactgaccaaataaaaaacctgagcatcgtctatgtctcctctctgcctccctgttccccatattcagccaatgaataagccctaccaatgccaccccctaaatatctctcaaatctgccccctctgccgccactatcaaaacctcattatttctagctatcattgcaattgctcatcctttcttcaatagatcatccacactgccaccagagttatgtttcttgtgcacaaatctgtcctgctctcctactcagagttcttcaatggctcctactgcatactgcatgtagcctgaattgctgtgcagggcactcaaggccacccacattctgccctccatctctttctccagcctcatctccctccacatcccctctcttctctggccatgctctgacagcactgagttatctgtgaatcccaacacataaccctccttatgcctccaggccttatcatctgcttcttcctccagctttcagctgcatcccaaaagctaaaaagcttcccttgactcctccacagagacaacagagacaagtgttcatttttttttttaagatggagtcttcctcttgtcgcccaggctggagtgcaatggtgcaatttcggctcactgcaacctctgcctcctgggttcaagcgattttcctgcctcagcctcccaaatagctgtgattacaggcgcccgccaccatgcccagctaatttttgtatttttagtagagatgggctttcaccatgctggctaggctggtctcgaactcctgacctcaggtaatccaccctccttgacctcccaaagtgctgggattacaggtgtgagccaccgcacccagccaagtgttcattttctaactcatctgtgctgttgtggtgcaatgcctccatctccttttcagcaaacaaatcttatgtcagaattcaaataaataatcactaagatgcatatagtgcttgccatgtgccagcttacatgcattgccttacttaatccttataacaacactgtgaggtaggtaatattataatcaccattttaaagagaaggaaatggaggcacagagaaattgagtaacttgcctgcggtctcaaagtgccatggcaccagctgagatatgaacccatactctgaattcatgcttttagtaacttttaactatacagtgatgttgcttttcttgttgttattttgccattagactgtaccttgagaccagtactctttcagtttggtactcccagaacttaacaatgtgtatgatatatagttgacaatgagtaaatatttgttgagtgaatcagtctacctataaaattatctatttatacggactcaattttctcttatcttgctggcatactctcagaatttttggatgaaatgcatttccgtttggaattctttgaatcagggtttacatttcacatgcttctttctgaaagatttgctctgtttggtattgcatactgcattctttcagaaataaagaacaaaagttatacttggaaatatttattatctcaattagcacatcctctttctaaattcactgataatactgtcatgtacaatgttctcgaaaatttctcttcatctcccaagcgatcttcccttttctactctagttagtaattatgcttttataaatataatgtaccttttcttctcaatattttatttacttatttttgtgttttttttgtttgattgtttgtttttgtttttgtttgagacggagtcttgctctgtcaccaggctggagtgcaatggcgtgatctcagttcactgcaacctctccctcccagattcaagcaatcctcctgcatcagcctcccaagtagctgggactacaggcacgcgccaccatacctggctaatttttgtttttttttttagtagagacggggtttcaccatgttgggcaggatggtctcgatctcttgacctcgtgatccgcctgccttggcctcccaaagtgctgggattacaggggtgtgccactgtgcccagcctattttattttactttttaagagacagtgtctcgctgtatcacccaggctgatctcaaactgctgggctcaagggatcctccagcatcagcttcctcggtagctggaactactagtcttctcaattatttttgtttatttctacttaatcaattgttagtatgaattttgtaatcatatttctttttaaaatgtatcaacctctctgacctaatttattgacctacaagtctaaaggaaagcaagctttgatcaccacacagacatagattctgtattgtgatgcttatagaaggaaggaaaattggcatctctgttacctgaaagtagaccaacttgccttgagactgtttgcctcctacttgatggaggtagagaggagagtcatgctgccaaagatccatcttgagggaagtgacaggctcaagttggtcgcttctgtttgcagtgtttttagtaggcactttgctagaaacaggagacaatggaccataacctctgtgagaaggaaccactatcactagcttgatgggaccaacatagtcatgtaaggccactggctggagagaagggcctgaggaggactaggagaggtccagctccatatgaaaaaaaaccaaaagcccataactgggcagacttcttgttatgtgctttttgaaaatccacggcaaatccatttgtctctgaactaccgtgcttcctttcaactctcattcttcctatttcttgaatcccaagtgatttcatgtgtttcctgctttagaggttttgcttcactggactcaggctttatttttgtgtgtgttccatgcagatgggtggtctcttgcaattgtatcatcagattaagacacgcagctgtaagtgcttccactccagcccagagcatagctgagacaatgtggaatttaaagaagacttaagtgtttggttaagaggaaggaaatggtgccagattcattcattcactcactgatcaaacattttatgtgcctcctatgaacatcttgctaggcatcccaaagatgggatggtcctgtctctgctcttgggaagcttacagtgctatagggagacaggcatggaacagacactagaatataacaagctgattgcttcagtagagacatatacaaagtgcagtggaaatacaaagaaggagatcctaagcctgcccagaaattctaggaaagcttccccacagctgaaacttaagagataagcaaggccaggcatgacagctgacgcctaacatctcaacactttggaaggccaaggcaagaggatcacttgagcccaggagtttcagcccagcccagggaacatagcaagaccccatctctacaaaagaaaatttgaaaaatcagccagtcatgatggtatgtgcctgtagtcccagctacttgggaggctgaggcaggaggatcacttgagcccagaaagttgaggctgcagtgagctatgatgatgccactgcactctggactaagtgacacagaaagactctgtatccaaaaaaacccaaacaaacaaacaaaaaaaaagaagaatttactaggtggacaagtagtggagaaggtgtttcagacagagggaataacttgtagagatggggaaacaagaacacagcatgtttgaggagctgtaggagagtcagttctgtgtgtctggagctgaggatgagaggcgggagtcagctggaagcagggctgcaggggtggccaagggccgcctcaggaagagcttggtccaccagcccattgatactgtaagcagtgtggagtccccaaggaactctgagccagggagtgatagacttagacatatatatatatatatatatatatatatttttttttttttttttttttttttgagacagagtcttgctgtgtcgcccaggctggagtgcagtggcgcaatcttggctcactgcaagctccgcctcccgggttcatgccattctcctgcctcagcctcctgtagctgggactacaggtgcctgccaccatgcctggctaattttttttgtatttttggtagagacggggtttcaccgtgttagccaggatggtctcgatctcctgatctcatgatctgcccacctcggcctcccaaagtgctgggattacaggcgtgagccaccgtgcccggccagatattttttaagttttgttttttactgacacaaagtaattgtgcttatttatgggatacagtgtgatgtttcaacacatgtagacattgtgtaatgatcaaatcagagtaattagcatatctatcacctcattgatcatttctttgtggtgagcacatttagaatcctttcttctagctactttgaaatatacaataatacattattgttaactatagtcaccctgctgtgcaatagaacactagaacttattcctcctatctcactgtaactttgtacctattgaccaacctctcctcatctcccctcaccactccctccccagcctctggtagccattattctcctctctacttctatgagatccccttttttcagattccgcatatgagtgagatcatgagatatttgtctttctgtgcttggattatttgacttaacacaatgtcctttaggttcatccatgttgtcacaaatgaaaagatttcactcttttttgggctgaatagtattctattgtgcatatatatatatcacatttttaaatccattcatccattgatggacacttaggttgattgtatatattggctgcagtgcacacgggagtacagatatctctttgacatactgatttcatttcctttgtggtttttttgttttgttttgttttgttttgtttttgagatagtctcactctgtcactcaggttggagtgcagtggcactatctgggctcactgcaacctctgcctcctgggttcaggcagttctcatgcttcagcctcccaagtagctgggatcacaggtgtgcaccaccatgtccagctaatttttgtatttttagtagagacgaggtttcgccatgttggccaggctggccttgaactcctggcctcaagtgatccgcctgccttggcctcccaaagtgctgggattgcaggcatgaacctctgtgcctggcttgatttcatttcctttggatatataccaagtagtgggattgccagaacatatgatagttctattattaattttttgaggaacctcgctaatgttttccataatggctgtactaattgtaatttccatcaacagtctataagagttcccctttctgcacatcctcgcctgcatttgttactttttgctttttgataatagccattctaactggcgtgaggcaatagctcattgcagttttgatttgcagttccctggtgttaatgatgttgagtatttcttcatgtacttgttggccgtatacatgtatgtcttcttttgagaaatatctattcaggtcttttgcccatctgattatttgtttttctgctattgagttgtttgagttccttgtatactctggatattgaacccttgtcacgtaagcatagtttgtaaatattttctcccattccataggtggtctcttcactctgctgtttcctttgctgtacagaagctttttaggttgatgtaataccattcgtgcattttttttcttttgttgcctgtgttttcgaggtaccatccaaaaaaatctttgcccaaaccaatgtcctaaagtgtttcgtctattctttattcaaatagtttcatatttctggctcttacatttaagtccttaatccattttgagttgatttttgtatatggtgagagataggaatctagttccattcttctgcatgtagctatccaggtttcccagcaccatttattgaagagaatgttctttccccaatgtgtgttcttggtgcctttttcaaaaatcagctcgctataaatgtgtgggcttatttctggtttctctattctgttccactggtctgtgtgtctgttttttatagacagactcagaacactgcagcaaaggtgagtacgagaaacagtgcttgaactaagccaggggcagtggggatggagaggaggcagatgggcagttataagagatgattagactctatcaatgactattaaagttctcacattggcttctttctattctagtatagtatttagtagtagattttttggctagaaatacctgaaactagatagccttataacacatacaattaaaactaacatggaaacggcatgccaatattcaattagagttcttctttttgcaattcaatttgaaaataatctgtatgctatcagtaatttaagacccattattactgtgataatagtaataggtaacactgctctagggaactatgctgtaatgtggcagagataatatacagcacattaggaactcaacaacacttattttttaaaaatctagagacattaaccatcaccatatgatttatgttttcttaaagaaagaatgaatccataatacaaacccattgatattgccttgaaatgatctagattgagaagtgtgattttctgataattatggacaacatgatcaatatttataatagaaaaaataatgtcataaatataaaaattggcactattaacttatgtcaagatgcttttttgtcattatcatcagtgattacttgctcagcatctgcccctacccaggcacatgaagaacggaaggagtcgcagacccaggcaggaggtgtaacatacagaaaggtcctgaggtaggaagggatttggcttgtttgcagagctaagtgaaagcagtgtggctgagggaaaggaaatgagcagagcaggggcatgaggtggtcctggagtggtagacaggggtttctttaattaacagtaaatgttctttcaaattttggtcatagctgggtgtagtggcacttgcctatagtcccagctactcaggaggctgaagcaggagtattgcttcagcccaggaggtcgaggctgcagtaagttttgatggtgccactgcattctagcttgggggacagagtgagaccctttctctaaaaaaatttttctttctttaattctcatctttctgtgatttaatttctcagttttattagacactgttgttattcccattacactccacacttgactacatcacctggttctcttacaatctttttgaccttctttctttagtctccttcatggattcatcttcttctttccactccttaaacactgatgttctgctatgttcttcctgggagtacatttctcctcatgcccctatgccctccttgaggatcttggccacattcacacctccatgagaatgactcccccatctgcaggtccggtaatcatttctctcccaatcctttggcctgaatatcccacagattctaactcaatctgataaaacgaaaaccatctttctctcaaaacctgttatttctcctatattacctatctttttagaggtgggacctccatcctcccaaagccagattttaaaaaaaaaattttaattttttttttttaagacagggtctcactttgtcacccaggctggagtgcagtggtacaatctcggctcactgcaggcttgacctcccgggctcaagtgatcctcccacctcagccccccaggtagctgggactacatgcgcatgccaccatgcctggctaaattttttttttctgtatttttgtagagatggggttgtgtcacgttggccaagctgctcttgaactcctgagctcaagtgatctgcccacctcagcctcccaaaatgctaggattacaggcgtaagccaccacacctggccaatttttaatttttttattccaaagccagaacttttaagtcaattcttatcctcccatccctccaccgaggtccccattttccacaataatcaatcaccaagttctttcggttttagctactaaacattctttaatatgtcctttccatgcttgttctagcctctgacctagttcaagaactcctcatctcttcctttaactactaaaatacctcctatttccctccctgcccccagtccttctccttttcagtctgtcccccagagaacaactcaaataatctacctaaaatggaaggctgactatgactatgactcccctacacatcacccattggttcaagtccaatctccttgacacagtatgacattccctccatgatatcttttttatatagtgtattctagcaggactaagctacatcaagttccttgaacaaggatacattcacatgcttctgtgttgggcaggctgaattaagagatcctttcctctcctcacctctatcactatgcctgccccatcacatctaaattccccacacccacccttccaaattgggctgcagaaaataggtcttactcacatttgttaatcctagagcctagcatttttttccttcattcaatgagcaattaatctagtgcctactacttcccagggttctgggaaaacaacgtttcagtcttcatggatctgatattctagtgaggggactccaggacctacataacaggcgctcaagatcttgtactcataataaaaaattctgaaaatcaagcaaatgaaagagtctttttaaaccactgtctaagcacactgtctgggacactgccgtgactcacttttcctttaaacaacaaatatggcggtgactaaggcaacttaagtaacagactgaactgccctcaccatggatcctgtggtctttagcaaatgataatccaattaactagcaggaaatattttcccacatacatggagatataacctcacattcaaataatcctctggagcaggaagggaatgaataatagcccatttaagtgaacattttgaaaagctgtagaagattaaagatttctaaagataccttaagatattatcacattagtaagctatttctcccacttagaaaccctatcctgtttatattagaagaggcaaattgacatatttcctctttccctaatatgtacttggtaggtaacttcctaaacaacttttattcatggatgatacaataaatgattcactattttccacaaaaggaataactgaggagagtaagattattataagaaacacaaatcttgaaataactgtgttctcctctttgcttcccccatttaagttagctctctccaataaacatctttctggatttctaaatgtctggatttttgcctttgctgatcaacttcttcatgagttttcatgatttttcagaacacagtgtccctttagcctctccaaccccaaagagctcttctacttttgaggtgtgaatttcaattagtttcctgagcaacatctctataaagctgtcttgcaagtgaatcaaactaaacatgttcgttttcccaacctgcagcaaacctgctccctgactgtgtaagggacacagctcaggaaggcacaccatcctttatgcagatgctcaagccaaaaatctggtgccatccttgattcactccctctcttccttatcctcacattcagttgagctctatctcattgtttcttcttcctcagtgtctcccaactgtgctgactttgctacatgcttactgccctctccctaacacaggcgttcataacttttcacctggatgactacttgataattggtcactatgcatctgtgattcccatatctgtctagcagatagaagtgagcttttcggaatataaatctgaccatgttactgttctaactgacaatactgaatgtccttccacggtccaaagagcagagttcaaattccttaatgtggcctctgggccctcagtgacctgacccctgtctacctctcaaacatcatctctcaccatacttctcgccaataagccatacccaaatgtgtaggtttcttgatatctcacacttttaaacctccatgcctttgtgcaggctgcttctttggctcacagaacacctttcttctctgggaaaagaatctctgagctaggttagctttcccctctctgtttttcacactcatcatactttgtaaccacttgccctactcctgtcttcccactagaatgtaagtactaggaagaggaatcatgtctgttttgttcattccagtattctcagcactgagcacaatgtagtcagagtaaatacttgttaactaaatgtgtagtgtgattctaactgaaaattcaccattaagaattgagaatgaacataattattagaaaacatgggaaattttctcccaaatggcacaactggtcacatttgatctttggtgggtatctgtaacattccagagtttaaatcctgaatgttacgtctgtagtcaaatttgcacttactcagacctataatcaatcaggctggtgtttagctgcccaagttgacatccgggctgactcattttaacttcactgtttgaggttagcttcctcagctgttgtagcactgtaattgtcaatcatttgccttttagttcagagtttaactgacttggaggaagaaaacaacagaagacttatttttttcaatcttttagcagaaaacaattagtatacttccccatagatatccatttacaattctcttaaattacatatatgcttcagaagaaaataaaaacagagactagaactcgaggccatactcctaagttttttgttttttgttttcttgagacaggatcttactctgttgcccaggtttcccaggctggagtacagtggtacaatcacagctcactgcagcctcaaccttctgggctcaagccatactcccacctgtcagcctcctgagtagctgggtctataggtgcacatcaccacacccggctaatttttgtatgttttgtagagatggggtttcatcatgttacccaggctggtctcaaattcttgggctcaagtgacccgcctgcctcagtctcccaaagtgctgggattacaggcatgagccatcgtgcctggcctatattcctaagtttttaacttgtcctctgtagataaaattttaatatacagtctttaaaaataaaacctgagctttcctcaaatgctaaaaactaaataaagcattttaacctttactccattcagtcaacaaatattcccccaggcacttcagccttgtggtaagtgctgtgggggaattatattttgatgtgttttataatgtgctttgattctctacttcttgtcactctgtgacccttcagacaacagctggcgattctgctcctatgtgtcaggaaaaggttcttacaaaagaacacaggataaaaatcctgggcctttaagcttcaaaagcccaagccctgaaagacttggggcataacatttttcaaaaccatgtaatcagttggaacattttttccacccccagattaggaaaagaatctatgtcaaaaggaaaggagcaaatatgagaaaaggggagagaagaggtggaggggaagaagatgagaagggagaggaggaaaggagaggacaggggaaaagaggaggggaggggagagccagagggaagcaaatgctgagaaattcatcatatggggggtctgttctagaccttctcactttctatccagctagagagaaagttggaacccccgggtaggcttgggggcctaagtagatgggaacccattccacctttcccagtagggttcataaaagcaataagacagagtgttcctgtgctcgtcattgtatcagttaagagtcaacgggaaaagcagaaacaaccctgagcatgcaaaactgaggagatttaattttaatgggggaatggctacataggtggtagagaaactgagaagccaaatgggacagtgacaaaatctagagcttagcagcagtaggaagccactactgtccctatgctggaaggacaatgggaagatatgatgttattgaagcccagaggccgacttcattcagggaagctggaaccacagcaggcctgtggttcagaggggagtagaacactaaggaaatgcagctgatgatgatgatgcaaagaaaggtagaggaaaaccctggaatgtcccttctactggccctgtaatcactcagaaatgtctcacaagcaccaaccctaacatggaatctagttgacttgtgtgagtcaccctgtagcagagcaaggggagggtgagtcatgagtttgagggcaaacacattcatgatgtgggagcaagaaaatgtctccagcaggtgtctaggactgtggacctaagacagcctcacaggatctccatgacccaggaagacccagaggagcccagagcaaggcagacacgacagggaaacctgaagacttgaaggggccttggagttggaacaaggaagagacatcagggatccacctggacgggaaactaaacaccaaatgggccctcgtacatctcagtgaattccagcttggacagaagacaacattgagaagaccagacactgaccctgccataatgagttgactccatggtactgcttcctacccacaatctcacatcactcatggacgatatggaagggaagaggaggtcatctagcagaaaggaggctgaatccaagttcattcatagataaagaaaggaaagaacctagaccaatgaacagatctagtccttcatttaaaagaccccaccgaatgttgacgaaggataaacacataacagatgtctgcaatgcagtgagaaatagaaacggttcatgttaaaggatacactggggctggagatgcaagcagagaaattccagtgcttgcctgcaaggtagggcttctcagagaaggccctcatagacagttgatatttcagggatgaatagggatttagcaagcagatggaggagggatccttacctccctatatcttcctatatccctcctatataggaaggatataggatataagatattgtcttcctatatccctccaaatgcatgattttcaagagaagtccatatattccttgtataactatagcccatagttctttcagaaacatggcaaatctctcagggttatcctccttttgattagtaaatggggcagtcccagagggataagatggatgtggcctgagtctcaaccctgatgaatacaatcagcagcttgcaggaaatgaattccatatccttttgtagatttgttgaggccatttctagagtttagtcttgaactaaagacttagatctcaaggcattcgggtagtctcataaaatgtgcaatccgtaagaaaaatatagttaagccatctaacatatattatctccatactgaccaaacttctgtaatgaaacaaatctcaaattatcatgacatactcttatctgtcatgactttccccaaaatactgtattttgctattttttaaacagagaaacatgactgttgattcaaagaaacttttctatcacccttctagaaacaatatccctaaacttaacttttataatagaataacaaataaaacatattattgttctctccattatttacaaaatagcaaataattgtattatagaaaacaataaaagtcattgtactgttttgaatttttttacctcattagagatgtctgttccagagagatctattgataccaaggaaaagatgtttacaatatatccaattccttgggcagtcaaatgttcacaatttcgtaaactcaagtagtttaaattagggcagctaaaagaaagtagcatggattaattttagctgtcaatcatattgtcagtaagcaatttcttcatataaaaactatcttgggaaaacaaatggtattgaagcaaagattttcctttactcaacataaaagtaagactaaaagtagaaagtaatttgacattacaaagttgcatgaaagggcagtagattattatatgactttctttctgtaatttagtttcgtattacaatttctaataaggaaaaaatatgtcacatatcaaaaactatcatgtaagtaccatagtgaatgaccactaaaagtgcaagttaagaaccctacttatcccttacaagtttgctacaggaattgtacaagacctctgacaagaggggagtcaagaataaaccagccagaacaccccttgggaaatgctggagtaaagataatctcctggaaaagggagattagagaaaatctccttgaaaaagtacagggaagccacccatatctagatattcatcatttcaggaacgactccctcagatgtaatttaaatataataatataatttaaaaattggtccaatctatgacttcaatgtctttcacatggtttcactgaacatttaaccagcttctgggcatctctgatgttcccccaaatgtcatgaaatctttgcttttaggtgtctcatgtctcctattatcaaatatacaatactaatgatatgatgtaaaagactgttttatcataccgctcagatagtttcataacagaggcatcacttagccgcacacagttgcttaaatttagctctcttatcctcatgcttgcaggaccatcaagaaattgctttagtcccatatcaccaattctgtaggaaagagagaaaaattttacatgtgattctatatataaacatatagaatagtattaaagtaatagctaccatacccaatatatttctaaaatagcaaggtaatatctatatactggtattttgtcaatattttaaaaccaaatttgattatatagattttaatgtaataaaatgtataaatgagaggaatgggagaagtattaattaaaatgttatttctgttcctttgttcataatttttaataagacagatggccctcaaggtctttttctcttgggttaaaaagtgatcaagttaagtagtccctgataccatttcctgcaaaagaaaaagatcaaaacttaggagagtgagaaccaagactaagagtcaaactactgccatgattttggaggaattttcactaaatacaaggtcaatttgctggataggaaacccaatatgagccctttggcttctttccttctgaatcagagaaaacctgatgctggaagaagaccttgacctcagccttcccaaactatcctaatcagaaacttcttctgtgtgtcagtgccataaccctaccatgttgatcttgctttataaatggctggatgtctgtttggcccatcagttccctgtcttccattgggatcttcatttctaattccaattgagaaccaccagatccttctaagaagcatttcagcaaataaagcaggacaggagtttccaccattgcaatcctaagaggcagtttcacaacagctctacaggtgggcgtacagatgggaagaacactgggagcaaaacatactgattgctgacatccgtttacaccctccgtttgttcagatttgcaaagaactgagcagttaaggcaaaagatatcctgtttcagctgaatgagccatagtaggtggatgcgatgcctgtgtgcccatcaaccttccacctataagagggggagtgtgccagcacctaggaaagcagttaaggatgtgtgtgtgtgtgtgtgtgtgtgtgtgtgtgtagaaattcatattatagtcaagaaaggattaaaagtgaatggaaaagattattgaggtaatgatccaaattaattggttaatacatttagggccaaacctggatatcaaaagtatccatgctgtttttttgtttgtttgtttgttttttaatacacaagctggggtttcatccctaaagattcagactcaatagctctgaagtggggcttgggcatctatagttttttttgtatgtttgtttgtttgtttttgagaccaagtctctctctgtcgcccaggctggagtgcagtggcacgatctcagctcactacaagctctgcctcctgggttcacaccattctcctgcctcagcctcccgagtagctaggactacaggcgactgccaccatgcctggctaattctgtgtatttttagtagagacggggtttcaccatgttagccaggatggtctcgatctcctgacctcgtgatccgcccacctgggcctcccaaagtgctgggattacaggcgtgagccaccacgcccgacgggcatctatagttttattcagctcctcaggtgattctgacaccttaggatttttacttttaaattcttttaaatatgtatttttaatttatctttttgttgctgattcccattgctttgtagagagagaataccatttgttgataaaaatagtttgaaagttgctggaacttgcttttaaattttgtccatgcatgattttttaaaggattgatgtgtgtttgagaaaaacaaaaattctttaactacccaacttactattttaggtttaactcttatatgtacatattaaaatcttaaaactctgaaattaagcttaatctttttaccctatatgttatactttttcatcctccctctgttgtcatttcttcagaatgatctcccagctctatacttctctcctctgtgagttctaatctgctgatcagcattccattgtttatttcaataactatattacatcatttgtttctaaaagttaggtttttttcccagataaatctaattgttttattatgtttggttgtctgctcatatttctgatcccattttttatttcttcaaacatttcatacatgtttacttaacaatccatgtctgacaattcctgtatctgaattacctgaaggtcaaatgtatcttgctgtttctgtgactctttctcatggtgacttatatctttgtgcattttgacaatctttgactttgagcacctatttatttgatcttaatctctagcctgagaagctttgtgctaacttcttccaggagctcaggaactacctacctgagaccactctgcccccttaaagaggtacaaaccctacagaagtctcaggttctgcctccctactttgagtcttgctcagagctgattctctcaaaggcaattgttgtcataaaatttgtgctcagagctgctcaaccttttgtgtttgctggctattcactattcatctcaaggaatttgttcattgagagagtagaaaagaatgaggggattcaaggctactggatatttctcttactctttgtgagctcagcagtatattgaaaatatatttaatcacggatctgaatatttttggcagagccctttgaagtgtcttgtcacctctacttctggaggcagaaaacttccatttaagattaattaggcaaggcgcagtggctcacgcctgtaatcccagcactttgggaggccgaggcaggtgggtcacctgaggtcaggagttcaagaccagcctggccaacatggtgagaccctatctctacaaaaatacaaaaattagccagggatgatggtgggtgcctgtctacttgggaggctggggcaggagaatcatttgaacccaacaggcagaggttgcagtgagccaagattgcaccactgcactccagcctgggtgacagagtgagactccatctcaaaaaaaaaaaaaaaaaaaaagaataattaacccgcagaagcctgcacgaaatgcaagaatgaaattcagttttatttcacatattcatacagatagaattagttgatacacacttgtgtatgtagtgtgtgtgtgtgtggggggggtgggtgtctcactgttatcattactatgtaacaaattgatccaaactttgtggcttaaatggcaaacatttattatctcccagtttctggacctcagggatttagaagtgaactagagtggttctagctcagggtctctcatgagtgtgtagtcaagatgccagctggagcttcagtcatctgaaggtttgactggggctgtagggtctgcttccaggctcactcacatggctgttggcgggaggctttaattcttcactggcccttggctggagccctcatttcctaatccaggtttttcccattccaaacccttatatctcctccagctcccaatgacccatgctgcctccccattttaataacaggcaacataggttgagattctgtgtagtgggccagtgcagtggctcatgcctataatcccagcattttgggaggccaaggtggaaggatcacctgaagccaggactttgagacctgcctgggcaatctagtgagaccccgactctagaaaaatttaaaaactagctggatatgatggagtgtgccttgtagttctagctacttgggaggctgaggcaggaggaccacttgagcccaggagttcaaggttacagtaactgtgcaactgtacttcagcctgggcaatagagcaagaccttgtctctaaaaaataaaaataaataaataaaagattttgtgtagcttagattattatgctgacttgtgctttcccaaatattagccaacttcaatgtggatcaagtactattttgtggatcaaatgctattttgttattatctggccctataagattataagaattctacataggtaagagtctgagctacccactggggaacaggtttcagcaagaaacctcttgatccttggccgggtgcagaggctcacacttgtattcccagcactttgggaggctgaggcaggtggatcacttgaggtcaggaattcaagaacagcctggccaaagtggtaaaaccctctctctactaaaaatacaaaaattagtcaggtgggctggcacacacctgtaatctcagctactcaggaggctgaggctagagaatcacttgagcatgggaggcagaggttgcagtgagctgagatcgtgccactgccctccagcctgggcaacagagcgagactctgtctcaaaaacaaaacaaaacaaaacaaaacaaaacaaaaaaacagaatttgctcctgagaataccaggagagtagtccaatagtggcccagctaaagaaaggatttcagtaagaacccaccctctgtccatttgtcagaaattcttcacagaggaaaaatctatccagtacccaagaggaaaaccttcaatgagattggttcttcataagcaagtcagaaagtccatgtgggaaaagatcatgttaactgaactagctatggaaaccctcaataggaaaggtagcctgtaagtattcctgtgagtttccttaattttacaagggtccataattcctcacatcctgagcttcccctacaccccatataatcaacctgggttgggagcccctctttcttataactacagaactctgcacttacctctactttaacacatgaactcttgactttcatgtttaccccacaaaccataagttccttaggagagaacctggcacatactagataatcaacgtttcttgaatatattactgaatgactcattaccttacacaatttgccaaattcaacacagtcagttgcttcaaaggtgaaagggatctgaggctgctgtctgttattcccttgcagtcagccatataaatgtgactgagatttggataattcttgtctataaatttgaaggatgcatcagtaacccttttatttcctgtttttaaaaaacagaagaaaagacaagtattgtatttagaatgccacaagagtaaaagtaaacaataatgctgaaccacatttttaatataacagaccttcaaatcggatctttctgagtttacaagcagaaagagctctgaaagtacaatcggagatatgcggtgcaccagtgaaaaccagcgatgtaatacgagagcatttttcaactaaagcctttagaagaaaaaaatgattaaattaatcaagtgtacagaacaggtttagcaaggtaatgaagtcactttttccttcaatatattagagacagacatgttaactgttaattttcctaatttcaaagacaactggatttttccatacattttaatacacctacatttgactaatgtggaggaatcagaattaaatcacgtactaagagtatgggaaaatatgagaaatggactactgaaaaaaattactacatttggcagcttagcatggagaactaaactcaaagtttgtgcttaggctgtaacatcactaaaaaaaatcctaactgtgaaacaaggtttcttaggatatttaaggattcacatgttttcaagggtatgtgcatgtgtggaaacttttcaatgattttattactattttaaaataactaaaatgaaaagtccattcatatttttcagtaattcaagccattagaacatatatctatcttatgggacagaaaagtaaaggtacttcccaactacctacttttacacagttgtccgtcagagttggcatgtcattaatggtaagatgcataattccagtgcagctgtttgcaatgtacctgaagccttggactgaaatctgaattgtacagagtagaaaataatgggagaatgcattagcatgataaaaatccaagggagtaataaccaaagatacaccataattttgttactatgttttaaaattaaccataaaatgtggcagacacaagagggaaagaatctagtcttgatttcttttttttatttaattttttatcgaggtaaaatttatataacataaaataagccatgtaagccagatgcagcagtgcatgcctgtagtctcagcaacttgggaggctgagataggaggatcacctcagccaggagttcaaggccagcctgggcaacacagcaagaccctgtctctttaaaaaaatttttttaattaaaaaaaattaaccacttacataagttatttaatcattcataatgttgtgcaaccagcacctaaatgtagttccaaaacattttcatcacccaaaaggaaatcctgtacccattaagcaattgctgcctatactcctttcctcctggcccctggcatcattaatcggtgtcctgtctccataaatttacctattctgaatatttcatataaatggaattatacaatatgtggccttttgttcctggcttctttcacttagtgtaatgtttttgaggttcatgcacattgtagcatgcatgaacacctcaatcgtttttatgactgaataatatcctattcaatggaaaaactacgttttaaaaatccattaatctgttaatgggtatgtggattgtttccatcttttggatattgaatatctacacgcatgtacatctatttgtttgaatatcaggtttcaattcttttgggtatatatttaggagaagaattgctggatcatatggcaattctatgcttaatttttaagaaccaccaaaatgttttcttcaggtgctgcaccattttacctacccaccagaaatctataagtgttccaatttctccacatcaccaacacttatttcccattaaaacaaatttccttgtgggcttgaagtggtactccattgtgattttcatttgcatccccttaatgaataatgatatgagtatcttttcatgtacttgctagccattggtatgtcttctttgggaaaatgtctagtcaagttatttgcctttttttttttagttgggttgtttgtctttttgttgttgaattgtaagaattcttcatatattctggataccaagtccttattagatgtacgactcaaaattattttccattctgtaggttgtcttctcattttttaaaatcatgtacttcgatgcataaacacttttaagtttgatgaagttcagtttatctattttttcttttgttgttcatgcttttggtgtcatatttaagaatgtattgccaaatccaaggtcatgaagatttacctcctattttttcttcaaaagggtttattattttggctcttatatttaggttattgaccattttgtgttaatttttatacatagtgtgaggtaggggtccaacttcacttttttttcatgtggatatacagttgccccagtgccagttgttgaagaaagtattcttttccccattgaatggtctcagcacccttttcaaaagacaattggccataaatgtatagatttatttctggactgtcaattctactccattgttctatatgtctatccttatgccagtgccatactgtttcaattactgtagctttgtagtaccgatttctttcttttcaactatcattatccacattaatggaaagaccagtggcagagagtgtccgaaataatgactgattcaaagatcaaaatatttgcctataatgaattaccttaagataatttgttatttagactgcatttcctgtaacaaatggacacagataggaaatcagattgtgttcagattcagtaaagggaaattgagatgctgcccagaagcagacagaaggggaactcccctgaagggtcatctccagaagagtatgacagggacaatgaggagcagcagctacaatggacctctagggagacctttggagacttcatttgcgccacctctcactaaaggtgacttccaaggttctgtcatcagagcctccacctattcagaaaagactagccaaaagttagggaactgagtgtcatagccccaggacaaccagagctcaactcaaatgtcacttccttaggaagtgttcctgacccttagattagaccagtttcttgttatatacttacatcaccatgtaattatcataactacaattatattcattttatgattgattagttattaaatgaatcccctgtatacagctcccagcatggtgcctataacaactgatgagataattgagtaatattattacatgaataaatggaggaatgtatgaatggcttctgagaaccatgtctattcagtaggttccccttctcagcagacactaataatatgagcacccagacaaaagccaaaggaatttttatagctattgaaataaaaagaaaagagaaaaaatgctaagggaagcccttgaaaccaggggctgagcatgcaggcctgatttgctacagaagccaggcctttgggttggattatatttggacaatttttctacatttctagtatttttctattgtgctacagaagccaggcctttgggtgggattatacttggataatttttctaaaaagactttgggaaatatgtttctaaagcctgaacaaatttatggcaattcgtatgatggggtgcaatacagttacaagttaatgttttaggagaataactgagctcatgatattatttcatgaagaaaaagttaattatataaggccttgctatacaaaatgtggtccatagaccagcagcataggcatcacctgggagcttgttcaaagtacagaatcttagcccaccactactgacttagaggctgcacttgaacaagacaggtgatttacacacagacatgacagtttgaaaagtgctaactgggaggaaatgaagaacaaaaacaaagtatatcagtcagggttctccagagaaacagaaccaataggatatacttacatccaagtatatatacatacatacacacacacacacacacacacacaaacatccaagtgtgtgtatgtgtgtgtatggagagagaaagagacagagtgagaaatgtattttaaggaattggtcatgtgattgtgggggctggcaaatctgaaattggtataccaggctggtagtctagaaactcagaatttctacattgcaagtcttgcagcagaattgtttcctcttcaggaaacctcagtcttggagacctgtctttattcttaacatcttcaactgaatgaagttcacccacattatagaggggagtccactttactcaaagtctactgatttaaatgtttatcacatctcaaaaataaaaacaaaacaaacctttgcaacaacatttacactggtgtttgaccaaacaactaggcactatagcctaaccaaagtgacataaaattaaccatcacagaaggaaatacaccaaatgctaatagtgattatctctgaagagtggatagttttcaaattttctacagtgaccatgtatagtcagaaaaaaagagaaacagaaaaaggcatctttggggaaaagatagcgtaaggaagcccttggacagtttttgaatcatctcctaccatagacctcttctttcagggaaacactaactaataaatggcccacgactctttataactcttcctgcaatccgtgtgtgccttactttccttcaaagagatgttcaggtactctttttttgaatttcctactgtgttggacaactatgaggggatgaatgaattaaatttaggagtaagataaagtctgggaaagagtgcagagtttggcaacagacaagactgaaaagaattccaggctgggtgcagtggctcacgcctgtaatcccagcactttgggaggccaaggtgggcagatcacgaggtcaggagattgagaccatcctggctaatacggtgaaaccccatctcaactaaaaatacaaaaaaattagccaggcatggtggcacacgcctatagtcccagctactcaggaggctgaggcaggagaatcgccgggaggcggaacttgcagtgagctgagattgctccactgcacttcttcagcctgggcaacagagcgagactctgtctcaaaataaaagaaaagaaaaagattccaggtggaaggtaagcacaagtggaggcaaagcagtgggagtgctggtcttggctgaagtggcaggatcactcttgggatgaataagaaaagttgagtaggtaaggaaggagggaaagctagtagaagactggtaaggcaagaatgaggtggtttttttgtttgtttttgtttttttttgtactgctatgaattcttgagtaaactttttataagtagcccagagcaaagtccaggggagaggaatgagcctttcaaaacatgaacagaggaggagagaagaatgctgggtttggagttagctgggctggttttgagtctggctctacctctttcttgcttataacaaaaagtagctcaacctctcgactcttagtttcctcatctggaaaatgagcataataatacccattttaggaaattcttgagaaaataaaatgaggcaatgtatataaaagtgattagctagcataatgtctggcatgtaatattgttatcacttttcctgttattgttcttctgggcacattttgctcccatgggaaagaatcaagaagcaggagtagggggtcttgagaactcattgtggtgcagccctcttactgcaaacaaagaaatgggattcagagaagttgtgtgatcggagaacaggttctttatctattcctcacaacgtggccccagtgctgaacatagtgtctgacacagagtgggtgctccagaaatgttgaatgaatgaatgaatggattatcttgagtcacatagcaatggcagagccagggctagaggccacctcttcctattatgacacacaaccccaggtttgagaactgttttttgtttgtttttaatttttattattattattatactttaagttctagggtacatgtgcacaacgtgcaggtttgttaaataggtatacatgtgccatgttggtttgctgcacccaacaactcgtcatttacattaggtatttctcctaatgctatccctcccccagtcccccaccctctgacaggcccccgtgtgtgatgttccctgccttgtgtccaggtgttctcattgttcaattcccacctatgagtgagaacatgcagtgtttggttttttgtccttgtgatagtttgctgagaatgatgatttccagcttcattcatgtccctgcaaaggacaagagctcatcctttgttgttttttatgacaattctaaattccccccattccagaccttagttcataaccctaacattaatatctctaataatggttttcataaaacatacaatcttttctctcttgctgtctttgtaacacgttcatgacaagatttcctgaacaagagggaaaacgatagcaaaaagcagccacagctgggtgatccttacaacacagcccaaaacttgatgctatcaaccaataagattagtatccagaaagtggggggtggggggtagggctctgagaaggactctttagctttgtcctggcatgaagtacttagtttcctacacagtttacattagaatatccaaaaagatatttggctaatattttatgactcacatattcctcccagaatcttttaggccaagcaaccattagttgtccttcctcttcctaaaataatagagatataagtctgaaattaaaaattcctctctaaaggaaaaagcaaaatatgttaccaagttaaaattccaggtctcatcacagctgatatctgtgcattttctgtgtaggatttttacacctgagatctgattcccgtttggttgtaaagtgattttggcttccattttgacaccaactggagccctgccaccctgtcctttgctggttaagcccccactgattgggaagttgaggaacttggcctcaccagtggtgttccaaccacaagtcccagcagacagctactgctgctgatgggggcagaaaagctttggtgatcacaggaaaattctctccagctgcctctgggtgggtctcaacccatcatcatgagaagacagacctgtctgtaaaggaattgagttgtcagtgagccacatacttactaaagaccaaagtgcaaagcacaaaggactagctcagatccctctgccgctctaaggtagtaaaaagaaggaagagacttagtgacagggatgataacatcatatgaagcttccacttcccactcctccaaaactgcctgtgagtcagctagctcagcagcacagaaaagacatatatgcagagccagaccctctaaggcagccagaaatatccatctgagatagacatggcccatgctgtgtttctgtaccacctccagctgtttctcacattctcacagcactgcatccaatgactaataggtagtgtgatgactttagtaatatccatatatttttatgtcctcttagtgaactcaaaggagcctgacttagcaagtagaatgaactgttggagagaaaaacaaagctttccttcaaaactattatggaacattgttttattgcattcaaatgcaccacaagcatctttaatagcaacacttcctagggactgtgctacgagggtttgacagactctcaaataccatgtcctctatagggacaggaagagaggtctggtaattgtctttctcgaggtcctgccaatccctctttagatgatcctgtattgtctaggtctatatattgttcacagccatccccatctctatggtctgaaatcctatccattcactacgcacttcttgctggtagtcctccctgatcacctcaggtagacatgtttctaactcttacatctgagcaccaaagcctgtggtctacactctccctgcattttatatcctctgccttatatgacagttacctgcacacatgtctagtttccctcccaagaagcatggacagcatcttagccataactgtatcgtttacagtacagcacagtgcctggtgcagagtgtttgttaatagaccaagtagttgttgaatgaattgtttgtagaatataaattagaattagtagtttcaacgggatggcagtcaatatggtcagttgttaaacattgccatatttatataaaaacactggacaaccaaacattaaaaaaaaattaattttccagtgtgagtgaggaaccaggacacaagctgagtgaagcctacagatgccaggaaggcttgcatgcttgccaactctgtgtgcatttactgcacaatgactcagagctgggatctgtcagaagcaggctgatccatcctaaactttgccattctagaatacactaattggttcttttcctcaaccagtggccaaattgttcatagtttcccttgtattactgagaaaatcacaaccataatacttttttcttacaacacaatgatccacagagctacttggtttgtctagatttattgaactagatggtggctttacagctacagttctaaccacatgctcacccaggtccaagaccaaaatagagttttgtaagcagttcatgaaattctgtgtcatttcacaagatagggagaagagaataagaaaccaaaataagtatgtttccagaaagaataaaattttttcaaacccttttttcaggaataggaaacacgatcttagtcccctgagactcatcactttgtcatctgattcttcaagatctaaaaatttttgccagatgtttcatttttaccacttaatataataaacatccttatacattttgcctacaaagagattatattaagctgtggatgttaaacaataggtgtttgttactttctttaatttttaattttcactatgaacataactgttatgttccaatgaataattttaacaaccatttaaatttatataagtccgatttacaagatatataaaaatgttttcataaattctacaattttttttcaacacaggttgaagtctggttcagaaaggacacaaaccattcctctaacagggaaactgaggcacaataactgacccagaaaagcaggaattgcactgtgatttttttgactcataactacttttccactagaactcctccttattaaatgatacttaaaaccacatattttttcaaatacaaaatgcaacaatttttttaaccatatgtagtatagcactttagtttcacaaatgatattcttatattaaaaaccaaggtagtacatactcaaaatgtgtcacttcctcatttttaccacattagcattatctatgttcttgaggatattaatgtctatcatttctctagaatattacacaataatgtgctactgcatatctcttcccaacttcctgttggtagcttaaaataggccatggtgagagtatttacaccatagaattcagccaacactaaaaagtcaggcttttcctgccctttattattccatacaataaaggaaaatggaatcagccaaatataagtgcatcacagttttgaatttaactgtttccaattcattttgatacataatctggtcattcacaactggtttagctggtcacaaaactcttgttgttccaattaacgtttattgacagacttccaaatctataccttcactcccagctctcttccaaggaccagacttctacttccaatttgttcttgtcatttgtacccagatgtatcacagcaacctgaaatttggcctttccaaaataagattcactattcttttttctccaatcttgctccttttttggttatcttgtctagttaccatttagaaacacaaaatcctaaagctgaaaaagaccttagaggttatttagcccagcctagccattctacaggtgaaggaatcgaggcagaaaaaccaagtaactccaaggttacacaactggttagtagcataacaagaaatagatcccaggtctcctaacttcaagaaaggagaggctgggcgcggtggctcgcgcctgtaatcccagcactttgggaggccgagacgggcggatcacaaggtcaggagattgagaccatcctggctaacacagtgaaaccccatctctactaaaaatacaaaaaaaattagccaggtgtggtggcggggacctgtagtcccagctgctggggaggctgaggcaggagaatggtgtgaacctgggaggtggagcttgcagtgagccgagatcacaccactgcactccagcctgggtgacagagcaagactctgtctcaaaaaaaaaaaaaaaaagaaagaaaggagaaggatgaggagggaatgggggagggggagaagaaggggaagggaaaggcgaagggagagaagagaggcggagaggaagaaagaaaaagaaagagaggaaggaagggagggaggggaaagaaagagagagagagacagagaaagagaaagaaagaaagaaagaaagagagaaagaaagaaagaaagaggaaagaaagaaagaggaaagaaaagaaagaggaaagaaaagaaaagaaagagacaaagaaattcctcccctgactcttgctttgcttatgcaatctccattcaatttggctagtacattcatccctggacatgcctgtgtggctttctccaacctccaacacaaatcccaggggtgaacaagtaagaccttccatgatctctgcttctctgaaaggagaaggttggaatttatgtaacctagagagaactgaaatgaccttggaatcttccagtttgcagtttgtacagcctacctttaagtttcgtgggctctagagagatttaacagtacaagaactgataagccattattactgcattgagtattataatcatttgaacattcctagaatactgtcccttttcattttttgttgatttgtgtatagtgattaaaatataattggtgaaaaaatagagtgcacatggtgactcatgcctgtaatcctggcactttgggaggctgaggtgggaggattgcttgagcccatgagttttagactggcctggacaacatattgagacccgtctctagaaaaaaaatttgaaaagaattaaccaggcttggtagcatgcgcctgtaatgccaactacttgggaggcttgaggcaggaggatcccttgagcccaggagtttgaggctacagtgagctatgatcacaccactgtactacagcctgggtcacagagaaagactttgtctcttaaaaaaaaaaaaaaagagagagagagagagaaaatactttcattttatatttcatagcttcctaggcacttttctttctgtaaatttaaagaaatatcagacttgaccttaccaagaaaagagatcatcaagccttgctctagcaagttaccaacttcccactacgtaacaggcatcctgagcttccacctgaagcacctggggaggcatgccctgaaattggccacagtctcattcattcatttgtcaagcttatcaaagtcctactatgagccaggtattgtattatttgctaaggatacagatacacaattatataaggcaccatccctgttttcaaagagcttaccttgggaaggagagcagacaagcaagcagataattgaatatgtagagaatgcttagtgaaaagtacaatgataaaagtatacacaagagggatactaacccagcttggaatagggcaaggaacggcttagtgaggcccttctagagaaggctgtgattgaacagaaccttgaaggataagtgcaagttaatgtggtgaatggaggaaagggacagtagcaggatgtccaggcagagggcaaaaggtgagcctagtgaaacaactgaggctggaaatgaagaacaggggaggcaccgaagcagaaacccctatggcaagctcccctactgtctggtttcactatcctaaatgtaaacatataaatctgaaacacggtccaaactcctcacttttcatccagcttcttctccaactccacattcagagttgttggtttctaggcatttgggcttgaacctgagcttgagtgggcctcagccttgcttcccagcatgtctggttgttccatgcctggcttcctgcagagggccataacccatcgttgcacacagttgaagatacatgaatctgtagggaaagtggctaccccatgataatgtcaatgggagaattgttggagttacacataaacagagcagaggataaagggaaagtaaaaccaggaatcatcaccctcccaattggcactttctcatgtacaagtaggatagctttgttctccccattaaaactctttctcctactcatattttccattctgagactccaagagaaacacggacatattttagagagctctgaaatgaactgggaactaatgtgaatctccttggagcattttagctagtacattttatccattcattcatgggaatatttaaggaaagacttagaggaagttaaccacgaagatatctgtagaaagattccagacaggggaacagccagtgtgaaaccctgcagcatgagcctgcttatgtttttgaagaatagaaaagaagccagagtggctggagtagagttggcaagaaggagaacaagaaatactgtcaaaggggcaactggaagatgagacagatttctcagggccttgtaggtccttccaaggcttttcttttattaaatgaataagaaggcttgccaggtacttaagcagaggaaggacattgacttgggtttttaaaggatgcctctagatattatgttgaaagtagacttgcaggaggcaggggtgaaagcagaaaggccagttaggaggctattggaataaccaggcaagagatcatggtaacttggactggggtggtggctgtggagatggtggttggatcctgattagattctgcaggaatagtcaactgcacttcctaacagagtggatgtggagtgagagaaaagagtcaagggtaatgtcttagtttgctagacatgctgtaataaagtaccacaaactggatggcttcaacaacagaaatgtattctctggttctggaggcacaaagtctgagatcaaggtgttggcaaagttggttccctctgagggctgtgaggaaggatttgtcccaggcccctctccttggcttacagttagccatttcaggttcacatagcattctccctgtatgcttgtgtctgtgtccaaatttccttcttgcaaaagaacagccatcatactggattaggttccaccctaaatgacctcatctgaattaattacatctgcaattaccctatttccaaataaggtcatattctgaggtactattgggtgttaggacttcaacatataaatgttgttcattccatcaatgaacaatggattccatcaatccataatagatggtgcctagatttttggcctaagcatctataaagatggagctgccattaactgagatggggagggctgtagtggagcaaggagcaggaattttttttttttaagatacaagagtctaaattttgagagaaatgtctgggttggagatatataaatcatatacatgagatacatatacttttaaatacatatattttatatatatgtatatgtgtgtatctatatgaggaaatatggtatatgtgtgtatatatatgattttatatatatatgagtgcttgttattgtaggtgatataaagccatgagacaagatgagatcatcaagggagtaggtatagctggagaagggaaatggatcaaggactgaaccctggggccctctgtgcttaagggattgagagatgaagaggtaacttaaagaggcactttaacaaatactattaaaagtaggaaaagagaaaaataaaatctatagcacgatataatttatgagaacacaagaatgcatagagatttaaggaaacataaattagaggggttgcttgtgtagggggaggggaatataaatgggaaatacgaacaaaaggaaataaaattaaacaagagaggggccctgcacagactgattatggaagtttgccatgaactgaggagtataattaaatctgctcttggtatctgagttccaaaataaacaaaataaatccaatgtgaaataaaatagaaatccctggttatgttttttcccttgagttctttttctttcctgcacaatattgcagaggaaacacagtatttttaaacttcttaacttcttttagtgagaatagtcaccataggaattccttattgagatctgacactttgatcaaagaatatttgaaaaaaggagaattgagtgaaacttagttactgtggaagtgaatataagatgactttaatacttattgctagtttctgagaaggaatgaatatttatcagcataaaaacccactccaagtttgaatgctgttctcccactccttttgtaatatacttataacattgctataaaaattaattacatgggtaaaaatagggagtaagtatggggcgccacagcatcagctttcctgcagaaaccacatctctaagttttctaaatcataaaagtgtcattaggattggcacaaccaatttgtaaaactaacaatatcaactaaagccaaacaaacacacctgacaacccagccactcgactcctatacacacacacacatacatatatatgtgtatatatacacccatgtatatattgtgtgtatacatatatatccatgtatatataaatacacaaacatatatatatcaaacaaaaatgtctgctgtgttcaccaaaagcaacgtacatgaatgttcatagaactttgtatacttttcttttcttctctctttttgagacaggatctcattctgtcacccaggctgcagtgcagtggcgcaatcatggctcaccgcagcctcagactacaggcatgtgccaccatgcccagctaactttttttattatttgtagagacagggtctcccctatgttgctcaggctggtcttggactcctgggtctcaatcctcccacctcagtctcccgaagtgtggggattacaagcatgagccaccgtgcctggccacttttctgtattatattttggccaaacttaccccaaaaaagtcattagggaagtttctttgttcactaggtcccaactgtcagtgccagcaaagtgggaagtagatttcatctggcatcctggatgttaaggattgctctgcggtcaatcacaagcatgttgaaagcaacaaattcagatacatcgtcaaacatgagcatgtgactaatggtgagaaaccttcacaactttctctcttgcacttcagtgattttctcgagtaaggctctccctaaagcacatctggaagtattcttttatttttatttatttaatttaatttaattaattatttatttattttgagacagagtctcactctgccgcccaggctgaagtgcagtggcacaatctcggcttactgcaacctccatcttcgggttcaagcgattctcctgcctcagcctcctgggtagctgggattacagacttgcgccgccatacttggctaactgttgaattttagtagagacagggtttcaccattttggccaggctggtctcaaactcctgacctcaagtgatctgtccactggcctcccaaagtgctggaattataggcgtgagccaccgtgcccagtctggaagtattcttttaaaccccaaatgaaagctaaatagaaattacagactcaacagagttgtatcagtttctttcaattgcaatgatggagacccaacataagctagcttagctagaatgggaatgaatggtgtcttcaatcgcaagtccagttaaacaacatatcatctctcttcaaacatatcatctctccctcttggtaggcttctttgtgaagatttcattctctctcccacagcaaacaaatttcttctgtgctgctggagaagagaaccacaaagtggcctagacctatacgctccaggccctgcaaactcagggagcacagaatctatatttcccaatgttaagtatccagaagattctgaatggttttgttagggttacatgcccttcctggacaaatcttaacccctgaagatggaatttatgattgaccaggcctggatcaaatgactagtagccatgggaaaatactaataccagtacaatgtaagtacatttgcaagttatgatattcattagaaaatcagtcatgttaattaaagaacctacagtgtgtatctaatccccaaagaggctgggcacggtggctcatgactgtaatcccagcactttgggaggacgaggtgggcaacctgaggttgggaattcgagactggcctggccaataaaatacaaaaattagctgggcgtggtggtgcatgcctgtaatcccagctactcaggaggctgaggcaggagaattgcctgaacccaggaggtggaggctgcagtgaaccgagatcacaccactgtactccagcctgggtgacagagtgagactccatctcaaaaaaataaaataaaataataaaataatcccaaaataattcagaatacttctaaaacatatgtaattgattttcactttttattgcagctcttcatcatcatttattttttctaagaaatatagttaaacttctttcataatatcatataaatacatttttcctgtttttggacaacagcagtgggcattaaagtttagtccatgacatattttgtttacgttaatccagagctcctaaaggacagggaggctgttttattcatcgcagtgcccagtatgcatcaggcactcaacaaatgccagcaaaaagcatttaggtgtaagctcctattctcaaggctttttgttttattgagaccttttttcttggtcacatatattaacatataacttcctaatacaacattccaaatttataaaaagaaaatagattctagtttccaagagagaacctcttcgaggtgaaaaccttaaacatctatgaattgtcaattttccttctatgaagctatttttgtactacacccagagctgaagaggtagatagagcctcctcaaaagacttaataagtcactcagaagcagtaacattcaaacttcaccggttcttcatgaagctacagcagcagcaattactaagatatctgtgcttcacgacgaacccatttcttactctcactgggcctaaaggggctcaatttcaaactccacaatttctagtgcctgaaacagtgcctgacacttagaggtaaatactactgaattattaaatgaacagatggaaatgaaaaagggatgaatgaaagaaactaacattgttttgcataatgatgtgaaatactaacttcattgtgttttgaggcttacaaattaagaagtgattaggaaaggaattcaattctttacacatttagaaactcaaatacttactgaggccaggcaggcaatgcgattaagtggtagcagtccaggtgtgaatgcttgtgctgaccttactgagtggaggagaggttggcaaacagtggtccatctcgagggagggaggctgacttagctccagcccattgtggccatatggaaatgcaggtccaattctgctagttcttcccatttttaaagagaagcttgaaatctagaatgttttgtgaaaactccaaaattttacatattggcttgaaatttaaagacagattatgtgtgttttgcagtatttattttatttttaatttttgtgggtacatagtaggtgtatatatttatgggttacatgaaatgttttgatacaggcatgcaatgtgaaataagcacactatggagactgtggtatccatccccttaagcatttatactttgagttacaaacaacccaattacactcaagttcttttaaaatgtacaattaagtattattgactatagttaccttgttatgctatcaaatagtatatcttattctttctattttttttataacccattaaccatttccacctcaacctcaaagccccattatccttcccagcctctggtaatcatccttctactctctatgcccatgagttcaattgttttgatttttattagatcccacaaataagtgagaatatgcaatttttttaaatacatctcacaaataagtgatgggggatgtttttctttctgtgcctgacataatgatctccagttccatccctgttgttgcaaatgactggatctcatgcttttttatggctgaatagtactgcattgtctatatgtaccacattttctttttccagtcatctgctgatagacacttaggttgcttgcaagtcttagctgttgtgaacagtgctgcaacagacataggagtgcagatttctctttgatatactgatttcctttcttttgggtatatacccagcagtggaattgctgtatcatatgatagctcaatttttagttttttgaggaacctccaaactgttctccatagtggttgtactaatttacattcccaccagcagtgtactatggttctcttttctccacatcctcaccagcatttgttattacttaacttttggagaaaagccattttaacgggggtaagatgatatctcattgtagttttgatttgcatttctctgatgatcaataatgttgagcaccttttcatatgcctgtttgccatttgtatgttttctttgagaaatgtctattgcatcatttgcccattttttgatagaactattagaatttttcctataaagttgtttgagctccttatatattttgttttttaattccttgtcagatgggtagtttgcaaatattttctcccattctgtgggttgtctcttcactttgttgattgtatcctttgctgtgcagaagcttttcgacttcatgtgatctcatttgtccatgtttgctttggttgcctgtacttgtggggtattgctcaagaaatctttgcccagatcaatgtcctggagattttctccaatgttctcttgtagtagtttcaaagtttgaggtcttagatttaaatatttaatccattttgatttgatttttgcatacattatgtatatagtgttattcttctccatatggatatccagttttcccagcaccacttattgaagagactgtcttttcctcagtgtgtgtccttggcacctttgctgaaaatgagtccactgtcggtgtatagatttgtttctgggttctctattctgttctattggtctatgtgtctgcttttatgtcagtgccatgttgttttggttactttacttctgctaatttgaagttaggtaatgtgattcttctagttttgttctttttgcttaggatagctttggctattctgggtctttagtcgttccatataaattttaggattttttttttctatttctgtgaagaatgtcactggtattttgatagggatttcattgaatctgtagattgctttgggtagtatggacattttaacaatatcaattcttccaatccatgaacacagaatgtttttccaatttttggtgtcctctttaatttattcatcagtgtttcatagttttcattatagacctcttttacttttttggttaattcctagttatttaacttaatgtatggttgttgtaagtgggtttacatttttatttctttttcatattgttcactgttggcatatagaaatgctactaattttcgtaggtcaattttttatcctgtgactttactgaatttatcagttctaatagttttcttgtgtagaccttaggtttttccaaatataagatcgtatcatctgcaaacaaggataatttgacttcttccttttcaatttggatgctctttatatctttctcttgtctgattgctctagctaggactttcagtactatgttgaataacagtagtgacagtggacatccttatcatgttccagatcttaagaagaaaggctttcagtttttccctattcagtatgatactagctgtgggcctgtcatacattgtttttattatgttgaggtatgtttcttctatccctagttttttgagggtttttcttatgaagggatattgaattttttttaattttttttctctcctgctccataatgctacgttgagatgttgaatttgatcaaatgctttccagcatcaactgaaatgattatatggtttttatccttcattctgttgatgctatgtgtcacattgatttatttgcatatgttgaaccatccttgcatcccagggataaatcccacttggtcatgttgaatgatctttctaatgtattgttgaattcagtttgctagtagttttttgaggatttttgcatcaatattcatcagagatattggcctgtagttttcttttcttttctttttttttttttttttttttttgctgtatctttgtctggttttggcatcagggtaatactggcctcatagaattagtttggaagtactctttcttcctctacttttcagaatagtttgagtaggattggtattagttcttctttaaatgtttggtagaattcagcagtgaaaccatcaggtcccaagcttttctttactgggagactttttattacagcttcaatatcattacttattattggtctgttcagattttggatttcttccctgtttaatcttggtagcttgtatgtgtctaggaatttgtccctttcttccagattttcaaatttgttagcatatagctgatcatagcagccactaatgatcctttgaattctgcagtaacagttgtaatgtctcagttttcattctgattttatttatttggatcttctctcttttattctttttctttttttttatactttaatttctagggtacatgtgcacaacgtgcaggtttgttacatatgtatgcatgtgccatgttggtgttattttttttcttaatcttgctaaacatttgtcaactttgtttaacttttcaaaaacccactttttgtttcattgatctttttttgttgtcatttcattgatctttttgtattggttttttcatttcagtttcatttacttctcctctgatctttatttcttttcttctaataattttgggtttggtttgctcttgcttctctagttctttaagatgcatcatcagattgtttatttatagtttttcctcttttttgatgtaggcacttatagctataaacttccctgagtattgcttttgctgtatcccataggttttggtatgttgtgtttccattatcatttgtttcaagaaatttttcaatttccttcttaatttcttcattggcccactggtcattcaggagcatattgtttaacttccacatatttgtatcgtttccaaaattctacttgctattaatttctagttttattccattgtagtcagagaggatgcttgatattatttcagtttttttgaatgttttaagatttgttttgtgaactaacatatgatctatccttgagaatgatccatgtcctgaggaaaagaatgtgtattctgcagctcttggatgaagtgttctgtaaatatctatcagatccattttgtctatagtgcagattaagtctgatgtgtctttgttgcttttctgtctggaagatctgtccaatgctgaaagtggggtgttgaagtttccagctactattgtattggggtccatctctctccagcactaataatatttgctttacatatctgggtgctccagtgttgggtgcatatatatttaaaattgttatatcttcttgctgaattggcttctttatcattacatagtgaccttctttgtctgttcttatagttttggtcttaaaacctattttgtctgatataagtatagtgactcccattcttttttggttttcattggcatggaatatctttctccattcttttattttcagtccatgtgtgtctttatagatgaagtctgtttcttgtaggcaagagatcaatgtatcttgttttttcatccattcagccattctatatcttttcattggagagtttagtccatttacattcaatattattattgataagtaaggacctacttattcctgctattttgttatctgtcttctggttgttttgtggtctttttcttctttctttccttcctgtcttcttcaactgaaggcaattttctctggtgatattatttaatttcttgctttttagttttttgtgtatctactgtatgatttttggcttgaagttaccataaggcttgcaaatactaacctataaacccattgttttaacctgataacaacactgtttgcataaacaaacaaataaacatacaaaaactaataaaaattctatgtgtattagtccgttttcatgctgctcataaagacgtacctgagactgggaagaaaaagaggtttaattggacttacagttccacatggctggggaggcctcagaatcatggcgggaggcaaaaggcacttcttatatggcggcagcaagaaaaaaacgagaaagatgcaaaagcggaagcccctgataaaaccatcagatcttgtgagacttattcactatcatgagaacagcatgggaaagacctgcccccatgattcaattacctcccacaacacatgggaattcaagatgagatttgggcagggacacagccaaaccatatcactatgctttaactttgtccccctgccccactttttaactttttgatgcttctatttatatctcattgtactgattatgtcttgaaaagttgttgtagttatttttaattggttcatcatttagtcttcctacttaggataagagtagtttacacaccacagttattgtgttataaaattctgtgcttttctgtgtacttactattactggtgagttttgcaacttcaggtgattatttattgcttgcttttctttccgattgaagtactccctttagcatttcttgtaggacaggacagttgatgaagtccctcagcttttgtctaggaaagtatttatttctccctcatgtttgaaggatatttttaccagacatactattctagggtaaaagtttttttccttcagcattttaaaaatggcatgtcattctcttctagcatgtaaggtttacactgaaaagtttgctgccaaatgtattggagctccattgtatgttatttgtttcttttctcttggtgcctttaggatcctctctttgtccttgacctttgggagcttgattattaaatgccttgaagtagtcttctttgggttagatctgcttgatgttctataaccttcttgtacttggatatttacatctttctctaggtttctggaggttctctggtattatccctttggtttttgtttgtttgtttgattgggttttttttgtttgtttgtttttgttttttttggttttttgagactgagtctcgctctgttgcccaggctggagtgcagtggcacaaacttggctcactgcaacctccacctcccgggttcaaacaattctcttgcctctgcttcctgagtagctgggattacaggcacccaccaccacgtctggctaatttttatatttttagtaaagacagggtttcaccatgttggccaggctgtgttatttccctttgaaaaaactttctacttctatctctttgtctacctcctccttaaggccaacaattcttagatttgcccttttgaaattattttctagatcccgtaggtgtgcttcattgtttttcattctttttttttattattatactttaagttctagggtacatgtgcaccatgtgcaggtttgttacatatgtatacatgtgccatgttggtgtgctgcacccattaactcatcatttacattaggtatatctcctaatgctatctctcccccattcccgcccccccacaacaggccccggtgtgtgatgttccccaccctgtgtccaagtgttcttactgttcaactcccacctatgagggagaacatgcgatgtttggttttctgtccttgcgatagtttgctgagaatgatggttcccagcttcatccatgtccctacaaaggacatgaactcatccctttttatggctgcatagtattccatggtgtatatgtgccacattttcttaatccagtctatcattgatggacatttgggttggttccaagtctttgctattgtgaagggtgccgcaataaacaagacatttatgcagccaacagacacataaaaaaatgctcatcatcactggccatcagagaaatacaaatcaaaaccacaatgtgataccgtctcacaccagttagaatgatgatcattaaaaagtcaggaaataataggtgctggagaggatgtggaggaataggaacacttttacattgtcggtgggactgtaaactagttcaaccattgtggaagacagtgtggcgattcctgaaggatctagaactagaaaaaccatttgacccagccatcccattactgggtatatacccaaatgattataaatcatgctgctataaagactcattcttttttattttgtctcctctgactgcatattttcaaacagtctttaagctcactaattcttctgtttgatcagttctgctattaaaggactctgatgcattcttcaatataccaattgcatttttcagctccagaatttgtttctttttaattatttcaatctctttgttaaatttatctgatagaattctgaatttcttctctgtgttatcttgaattaatttgaatttcctcaacatagctattttgaattctctgtctgaaagattacatatctctgtttctccaggattgccccttggtgccttatttagttcatttggtaaggtcatgttttcctggatggtattgatgccagtattcttcggtgtctgggcattgaagagttaggtatttattgtagtcttcactgcctgggcttatttgtagccatccttcttgggaaggccttccagatatttgaaaggacttgagtgttgtaatctaagctgtatctgctttagggggcaccccaagcccagtaatgctgtggttctcgcacacttgtcaaggtaccaccctgttggtctgggacaagatctggaagaattctttggattaccaggcagaggctcttgttctcttcccttctgtttcccaaacagagtctctctgttctgaaccacccaaaactggtggtagagtgaaacaagcacccctgtggcctccaccactatgattgcactgggtcagacctgtagctatcacagcactgggtcttgcccaaggcctgctgtaaccacttcctggctactgccattgttcactcaaggccctggggctctacaatcagcaggtggcaaggccagccaggcctgtgtcctcctcttcagggtggtgaggtcccccagaccccaggtgagtccttaggtgccctctgggaatcagggattagagtcaaaaaccttagaagtctacttggtgttctattgcactgcggctgagctggcatgcaaactataggatgcagtccttcccactcttctgcccctttccaaaggcagaggaaccttaccctgtagccaccgccaccccaggccatgagtagtattgccaggctaccaatgatgttctcttatggcccaagggcttttaagtcagcttgtggtgaatgctgcctcacctgggactcatccttcagggcagtgggttcccctctggcccaaggcaggtccagaattgccatacaagagtcaagtcctggaatcgcggaccccaagaacctgcctcggtgctctaccctcctgtggccgtgctggtatctaaggtgtaagactgtccccactgcttttccctcgcaagcaagagttttgccccatagctaccctagctggtaatatgctgagtctcacctgaagcctgcaagtcacagaggctcacccaaggccctcaatgtagtagctgggtattgctgctagttattcagggcccaagggctcttcagttaacaggtgatgaatgttgccaggactgggtcccttccttcaaggcagcaggttcccttctggcccagagtgtgtctagaaatgtaacttgggagctagaacctggaacgagggccttatgactctaactggtgccctatcctgccgtggctgagctggtatccaagatgcaagacaaagtcctccctactcgtccttctcctctcctcaagggaaaggaaggggtctcttttggatcgatgagctgtgaggcttggggctggttgaggggcaatgccagtactcccttggctgctccagctggtgtctcagtatgtcatgtacccctcagtccactgtctctgtgcctagttgagcactaggatttgcctaagggttacagtccttatggcctagactgcctttcaagtttacctggaggcacagcgcactgtagccctcagtggtgaggtttgtagaactcaagttctgactgctgggactggcaattcccctgtgtctaggcctgggttaaatgctccctccgtgggtgggcatcagctgagtttggtccagttttcctctctgatccaacaggacagcactaagttcaatgcctcacaattggtgtattttcccttccccagcacccagagaggctctctgcaccatgttggaggggtggcactggcgattcaggactattgtttctatctcttcaatgactctttcagtcatatgaagttaaaaccaggtacgatgactgctcatctgatttttggttcttatgaaggtgttttttctttttctttcttttttttttctttgtgtgttggggggagggggtctttattcacatggagtgctgtatgcgatgcctgggaaaagctctcagcctggtgtgtgcttcagcgtggctcgggctccaatctctgttttccagtttgtcacgggctctcaactgtaaatagcctatgccctgctggatgccaccttcttagacaccacgtgaatccccatgcactgctcctcttaccccttaccaccaccaagcagctattagacacctgaggtctctgtcctgttagtaccatggggcagaaaggtatgataccttttttcacccataagggtgacagccaacactcctaacaaaatacaggcgtgcaagagaaaagcattaacaaatttacttaattatttgaggcaaggtctcactctgtctcccaggctggaacgcagtggtgggatcacagctcgctgcagcctcaatctcccaaactcagtcaatcctcccacctcagcctcccaggcagctgggaccagaggcatgcaccaccatgcctggccaattttttgcatttctggtagagacgtgggtcccaccatgttgcctaggctggtcttgaactcctggcctcaagtaatccttctgcctcagcctcccaaaatgccaggactacaggcatgagccaccgcgcccagcctaaaagcatacaaaggtgttttttctctgtagatagttgttaacttggtgtccttgggtggggaacaatgggtggagccttctgttccaccatcttgcttcacctcctccaattatgtgtgttttgtatgcatatctgggcagtaggtcatagatttgaagcctctcatttcaactttactgtgtctgagaatatttatccttaggacacttgtgtatacatttgtgtgttgttgctacaataattgcctcatggtaactgagaaattgataagaagaaggaggtaagtcataccatgaggagggtttaagcacaacggcgagttagaaaagtactgaaggatttatagttaaggggcaggcttatcagtgggatatgtcaagcacattaagttgttcctgagtttgcaaatatttttctctgtgattgggccattggcatttgctaattggtgcccatcaaagttaggcttctacccacccacaggaactgagagatatcttctttgatgattatatatcaaagggatagatcccaggtccttgaggaagactttcctgagttgtaaaactgtcaagaagcttttgttaaaaagacatctcaaagtaggcagagaaagaacttataattccaagttttctaaaacaaatgctctaagaaacaagaaaacaagaagtcagggcctagagtcagtaagaagctggtctaaaattcagtcatgctgaggagaacgtcaatgccatctcagtcataaagttatggtagatgttgatgtttaaaaagctacacatcagcagatcagttttaaacaaatatgaatgttagatgtttacagccctaacttagaatcctcccctccttgccccaactccctccagaccacccagggcatcaggataccacaagatgtcagtggaggtgactaggtaagaattctatccattcaagaaccctgggggagaaacccatgctgcccctgtatttcccactatcccagggaactctgcctgccccagtatctagcaacagatgcttaaaactgtactagtaccatgtgctttcatcagctgtgcaaacttgggcaacttattcaaccaccctgagccttggtctcttcatttgtaaataagcatagtaaatacataccaccacagcactgtatcagaagtaaatctgatctgtgtatagcactcaacacaatgcttggcatatggtaatgactcaagaaatgataactatcaatatttcagccagttctcacctatgctattattctcatagaataatgaacatactatgacaccaaattaataaaatacacagagaggcagaagaaaataagttaaaagaattatggcttaaatcttttgaaattaaagcagaagaaactatcaatgaggcagtagctacatccaaagcgccatgccctatcctctgcaacttgatccaattttctgcccaactttccaagtcctgttccctcaaacttaaaatattttcccacgcagatctcaaatcttcatgttattcagcccaacggtgtaatgcaattttttaaattatgagtttttgttgtattttcttttcctatttatcacttatagcattttacccccccccccccaaaaaaaaacccatgtgggagttaattgacttttcaggaatcccatgcaaaattctccctcaaaacattctctttgtttgtgtcttggtagcaactccagagttttcaggacttggactctgctttagacttgtgctcagactgtctccacaaaagtggtccgtttcctcatccaatgagctctgcctgtttgtctgtgtgacactccagtggaaggaagccaagagcctataatagcgatcctggggaaaatttcagcagctggggccatgtaatttaaaacctctgaaaagtgtgctgcggtccgtgcacagcattagtataacgtgagggctgaatgcagcccattctctggagaacttcctcacacaccgcagcaaagagaagactgaaagacaaacctgggtgcagccagagaggtccagatagatgagcttgtggcatccattccccaagttcaggtactgtaagcctttgtctgtgaaccgtctgcaataagccaaactaagattctgtaagttgtggaagtgcctgaaaagacaaaagagaggaaggaaagtattatacttccgttgttctctcaaatctttcttaagccactatgacaaagaaaactgtaaattcaactcttcttcttgcagatgttcaacatttaactttactgttaactctctacctgttaattaaaggagactacagtgttatataaggtaacacacaatacatttaataccttgtaatacatttcaagtgaaagtattaatagttcaataatatttgcctagatatttaagaaagttgactgggataaagcttttttggtgtgtgtgaggtgggggaggcaatcatattgtttggaagtgaaaccaaatttgcagagtgtattgttgcttttaggttttatctctggagtaccaaaataatgtgcaaaatatataaaaggacaaatcctttgtaaacatttaaatggagactgttacaggagagtgaggatttgggacagaaggcaaaactgaatatgaccatgctcttaaaatagatctgataagcaaatgagtttaaaaaataggtttaaatatgcatgagtttgtgacagtttcattattatagttaaagaaagactaattgatatgcagagtttaagcatggattaagaagaccagtttgcaaataagcaggcaacacatgagaagaatcaaaagcaacatcagagactataaatctcgctggagttgaaacagattaaatatggtattaccacaatgaccaaaatgacagcttccagaaaaaagtagggtagttaggatgagcctgtactaccatacgagggctcgcagtttgaggacactccgtggacaatttcccaagccctccaaagcctggaacttttttttgagacgaagtttcgctcttgttgcccagctggagtacaatggtgagatcttggctcactgcaacctcctccccactcccccaacccctggttcaagcgattctcctgcctcagcctcccaagtggctgggattacaggcgcgtgccaacatgtccagctaatttttgtatttttagtagagacagggtttcaccatgttggccaggctggcctcgaactcctgacctcaggtgatccacccgccttggcctcccaaagtgctcggaacaggcatgagccaccgtgcccagaaagcctggcactttttaagaggtcaaggattcccactactatctgctcttctaatggaattagcaatcatgctcttagtttgtgatatgcaacagcttaatagcaaattagaaagcaaaaagaatgaaaagtgaggagaaaatgcttctctgcctctcaaaatcacacaggtgaataaagtttacctcccataaatgggaaataagatatacaagcactgaccattaatcagattttgaaaaacacatctatatgatataatgatttgcatgccatagcgaattacttgattcagaacacacatcccgatctgggaagggctgtgtacgtgagattcgacagagcgagggggaaggctttggactcaccagtgactaggtgggcagggcctgaaggagaaagcagtgctaatatcccaaagacacgccccctctcttggggctgtcgagtggactgagctgtgctaaagttttggaaatgcgttatcttcctctccctggggtacaccctgtgattcaactgagtacaattttcttggggtggggagaggcacaccagggtgtcatttctagcaatcctttagctttataatctgtagaaaggagttgtgaggcaggccgcgtgacacagtgcaaaatacacaaggtttttgaatccggccaaatgagatgtaaatccaagccctgacacttactgcaacctccctaatctctcagagattgttttctcatttgttaagtggagattaaaatattttttttttttttttttttacactgatcaactgtggggcctccagctttcctgaacctcagttttctcatctggaacatggatgtaatctggtctgcttgttccctttaaagatgtgacaattaaatgagaatacagaagtaacagtattatcttgagggtgattttaacaatcaaaatcggcagggacatagtagaagatttaaaactatatgtaatattattgctactactatgtgaaatgatagtaacacattaactatttttatggactttgtattattcttccatttaatgaaatggatacttatctccaagagtggtgcatacaataattccaagagtttgaaggatttcacattgaatgtatacctcgatctacacctagtattcaatttctttaaatccatgtgatcagttaacaaatatcaaaaatgagaactgagctaggagtgcttaactttttttaatgtcacagacacctttggcttttggcagtcagctgaggtctctggcccctttcttggcataaagtttttaaatgcataaaataaaatatataagattacaaaaacagccaattatattgaaatacataattaccaaataaaaaaacatttatgagtagaatagtaatatatgtgcttctttattaacatattaagtaagattttgtggcagttctaataactgctgtgattgtgaactatcagtgatattttgaaatacttataacaattgaaatgtgataagaatatatttgtgatttatatgagtaaaaatgtcccagagactgctaatacttctgtagtttttacctacatttcaattacagttaataaaagtagagatgagtttcttctttttttttttttgtttgagacggagtctcactctgttacccaggctggagtgcaatggcatgatctcggctcactgcaacctccacctcccaggctcaagtgattctcctgcctcagcttcccaagtagctgggattacaggcacccaccacgacgcctggctaattttttttgtatttttattagagacagggttttaccatgttggccagactggtctcaaactcttgacctcaggtgatccgcccacctcggcctcccaaagtgctgggattataggcattaaccagtgcaactagccgagatgagttttttatatcccccattaaaattcatggagctcctgaattctatccctgatcctcttgggggaatccactgctccccagctaagaacctctggtttagataaaagaggctgttcattagactaagtgactcctggattgaaaatctctggatagctcttttcacagtggaacctcatggaaccatcagtttgaaggcaaagctcaggaatcttgggtggccctgtaggcctttctagggatttacagttctgcagacttaaagctgctagggacgggaaaagtgtcagttgacagcaaaatcacaggtggcaaattttgtgcaatactcatactctttattctgaattttggcaaagacgcgtgtcccctacatgagtaagatctgattcatcattttcccagcccagagaacacttggtaattctaattctgctttgaggcaatgtttacagcttgtttttatctttttctaattatttgataactgtttcttatgggggggggtgtgagtcctctctttgtgatttatttatttatttttctgctaccactataatctttagagaaattacaattcttatagaaactacaaagatttttttttctcctttcttttgggtttttttccattaaagaattgaagtcatttgtgttaaatttctaacacctgaaggacttactactaagatgaatggaaaagtatgtatttaaataaaaaattctctgaaaaaaatcaccaagacaaggcctactctgtaaaagagggaatttgcatgtggattcttttgagttgagtgttgggctctctggtttcacagaggcatttcaagtaatagaattctgcagaaaacctaaatggagtgatctggccttctatttacagggtagaccttgaagttgtccagtcaagacaacagcttactttgtctgccccactttgataggcactggtgagactatagatcatgatagttcctgataataagaaatttccaagccaattgaaaggtcaattcatctatataaaaaacaattggatactactccactatagcatttaagactcaattaaagagcaaagatcataatagctttactcagcactgtatgcccagaacaccttgcacatactagttgatcaatacatggtgaacaagtgaaagaaggttgttattataattcaggaaaaggaaaaatcactgcagacttctggtagatggcgagacttaaggtgtgaaggctgtagattagccatgagaaggagaaaggcactgcagctatagagaatgtgaagcatgcagcaatcagatgactggagttaagggcttctcttgggaaacctaggcagagaagtttggttggagaatgtcaacgaagagtaagggaagaacctagaccttaagcatgtcaaagacatgataggaagattgttccaggatgacacttcttgtagcgtgagatagaacagattgaagggaggagagaccagaggcagcaccaccaggatactgtgccaaatgaggtgctgagagtgccacctaggttgtgacaataggaataaatagaaagtgtttagttccggaaacatttagaggcaacaaatttcctggaatgggcatgagctttaggcagccctcattttcaactttagaaaactgaacaagtccccaaagaagtgagaaaaaatattcaaataaaaagctggcaaatcattgttgccaaggacaaacaaattacatttttctcttggcaagtactttttttggaaagaaatactaaaagcaatgaagagagaatgacagcagaaacaaccaacatttctctgcttatttacagtttcgagaacatttttgcatacccaagcatatttgaaacaatggaaaatagagcaaaaacagagaatcattatgaaatgtatttttatcatagataacttagtatacttttttatatggcaaaaaaatcagtatcaagtagtatctattctgaatattctctcaatggcaagaactagaaggaagagccaaacaaaattcttattttgggtcctacttttctatctattgcctactaaaggtataacttcatttgtaaaataaatgtccctaagaagatatgcatagctgtcatattaccttcaatttctaaggagaaaaaaagccatttcaatgtatgattgaaaataaatatgttttaagttaaaaaataatttgtaatgtgatataaactacaccctgggtcacacagagtggatcatgcctataaccccagcactttgggaagctgaagcaagaggattgcctgaggccatgagtttgagaccagcctggggaacatagtgagatcttgtctctacaaaagatttttcaaatttagctggatgtgcccaggagtttgaggctgcagtgagctatcatcacactatgtagctgggtgtagcctgggtgaaagagcaaggccctgtctataaacaaaacaaaacaaaaaaatggctcccaaatcatctactttgtaagttcagattttcaccaatgatttatggattttataatactctttttctatgtttatgtacatacatacatgtacatatattcatatatatacacatacacacatatacacacacacttatatatcatagtacagaatgcctaaagaaagaactgagtggtattcaatattacaggactggaggatcttaagtaattcctgaaacagtgttagagaaacctcagggacctcccacagtggtcactggagccagcttgcacagctcatgggagttgattgttagcatctcttcccaactccacattcaatgacattgtgttgatagcttaaaatcggccacagtggaattatttacaccacagaaatcagtaaacactaggaattggtgcttctcctcacccttgccaccagccagttgttaagcatttaccagaacactgctgttcctaaaatatattccaagaattactgctacagagaaggcagtatgctaatgaaaaggcatatagaaataaaaatgatgaaagagacaactttgaaggacaggaataaaatcggatctaaaaataaaaggagattcttatgataaactctaaacaaatgcattgaagcattaagaataaaaatgccttccctagctgagaaaaaatatattttagtgttcaaaaggtttaaaatgtaccaggaaaaattaattgaaggaacacaattaagcttggaaatgtctttaatttctcagagaaaaggaaagtcttgcaagcatctcttagcaggaaaaaataggttaccaacaaaggaacaaaaaatcatgctagcttcagactttctataacctgaaatatcaaagtttatggaccaatatctaaaacattagggttttaaagataaaatacagaacatgattcaagaactatacatgaagagaagtttctgtttatcctccaagataatagtcattttcagagatcaatggctaaactatctgactctcatgcatctttactgaaaaaagatttttaaaattatatttccagttatcatcagatgaatcaaaaggctaaagaataagtaagctgtgagaaaaaaagaccatcaatgaatggcctagagttaagactacatactcattataaatataattacaatattgagtgcaaacactacaattcgatattaaaaagaaagttaaatgattagcaaaacccacaaataatatgtgtgttcatacaggggagtaggtgtgcaggggtgtcaagttcaagggagaagtagagggacaattgaagtgtattagatcactgtgtaccacaggagtagtcaaaagttattgtttcatcttgactttggtaattagataaatgcctgttaaagtatgtttttaaaaacatgccaatagccactaattagaatacacaacagaatgtgtatgtacctttcgaataccttcagattatacaagtaaacatagttcacagagcaaaagacagaaatactgagtacagtgcagtaacataaaaatcaaaacataaaacaagatgataaaaataaaaccatacactcagttttttttttcttgagacagggtcttactctgtcacagcacaatcatgactcactgcagcctcaacctctgtgctcaaatgatcctcccacctcagcctcctgagtagctgggactacaggtgcatgccaccacacccaactaatttttgtatttttttgtagagatggagttttaccatgttgcccaggctggtctcaaactcctgggctcaagtagtccgcccacttcagcctcccaaactgctgggttacagcaagccaccacgcatggcccatacactcaattttgacaataaatattgatcttttaaactgctctcttaaaaaggcaaagagaatgaatttaaaaatagaagttagctacatgctacatataaaagataaacctaaaatcccgcatcacaaaggttaaaaatacagagaaatgtagttattccacaaaaagaacaagcaaaagaaaacaaaggttaactatgttgataacagttaaaaacttcaggctgggcgtgttggctcatacctgtaatcccagcactttgggaggccgaggtgggcggatcacgaggtcaggagttcgagaccggcctggccaacatgatgaaaccctgtcgctactaaaaatacaaatattagcctggcgtggtggcgggcacctgtaatcccagctactcgggaggctgaggcaggagaatcctttcagcccaggaggcggaggttgcagtgagccgagatcacttcattgcactccagcctgggcaacagggcgagactccgtctcaaaacaaagcgaattcaaggcaaagaaacatcaaccagcataaagaatatcattttatgtgaataaatgctataatctgtaatgaaacatgatgcttactaacctttgttaataaggttgtaaaataacatcaaaataaagagaagcttgatcataataggcaactaatatatcactattataatgatgtatcaagaatttatatgtatatacacacagaaattttgttctctataagaaactctgggccgggcacagtggctcatgcctgtaatcccagcactttgggaggccgaagtgggtggatcacctgaggtcaggagtttgagaccagcctggccaatgtggtgaaaccctgtctctactaaaaatacaaaaattagctgggtgttgtggtaagtgcctgtagtcccagctacttgggaggctgaggcaggaaaattgcttgaacccaggaggcggaggctatggtgagccgagatcataccactgcactccagcctgggcgacagagcaagattccatctcaaaaaaaataaaaataaaaaataaaagaagctctgttttaagcatccacggatgatttttggaaattaattataaactagtctaccaagaaatctcaataaattccaaaaagtagaaataattcagtccacatttcttgactagagtgcctaattaaaagcagaagctcaactgaagaaacttcaactacttagaaccaaaaattttgctctaaatatcactgggtcaagtccaggcatggtggctcacgcctgtaatcccagcactttgggaggccaaggtgggtggatcacttgaggtcaagagtttgagaccagcctggctaacatgatgaaacctcgtctctattaaaattcaaaaatcagcagagtgtggtggcagacacctgtaatcctagttactcaggaggctgaggcaggagacttgcttgagcccgcgaggcggaggttgcagtgagctgaggtcgtgccactgcattccagcctgggcgacagaggaagactctgtctcaaaaaaaaaaaaaaattaaataaataaataaataaacattactgagtgaaagaggaaagcaaatatagaatagttggtttagaaagttaaaacaatacttatcaagttatacaaacttttcccaaattcttatttagaagtcatttcatgaccatattttttttattacttctaaaaggaaagaaatcaaatcatgcaaatgcaaaaatataaattagttcctagtttaattattggtttactgataagtatctaatgactggctttccaaaaaaagtatgcatataaatgtatgtgcatttactataaaattttatattttactattttgcggatataaaggatgtgtagcacgcaacttacaaatgataaaacataccatattctttactgttaattccatgtagccaatcaattctcacacaatgttttcattgacttttgtcaatgaaactcttataaatgtagccagccaaccaatggttgaaattaaagaatgatgactgggcgtggtggctcacgcctataatcccagcactttgggaggccgaggcgggcggatcacgaggtcaggagatcgagaccatcctggctaacacagtgaaaccccgtctctactaaaaatacaaaaaaaaaaaattaactgggtgtggtggtgggtgcctgtagtcccagctactcaggaggctgaggcaggagaatggcatgaacccgggaggcggagcttgcagtgagctgagatcgcgccactgcactccagcctgggcgacagagcgagactccgtctcaacaaaaaaaagaaaaagaaaattaaaaaaacaaaagaaattgaagaatgattacagttccaatatgaatttttttattaacattaataagacacaaggtgatatatgtcaaagaggtatgtccaaaatctgcttgtcaatgatgtgaatgccttctttcctaaatcaaagaatagttttcaagtattgagagaatatttcctcaatattttgtgctatttcacaatgtcgtggctacagacatgacctacttttaaatttaatttgcttcattcattgtgttctctatcactttaagtctaaacaatcaactgaacaataaatcaagccccgatttgtagtgtttgatgttttccgtggtatagaatacttccatattggccaattccaagctatcaatgagaggtcaccaaacacacagttgggaaaaaatgtgcagtagcattttcaccgtagagatacaatggacataaataactacaagaacacagataaagtaacatgcagaaaaatgttagaaagtaatgagtttttagtatttcttgcctgtataagaattttaaggccgggcgcggtggctcacgcttgtaatcccagcactttgggaggctgaggcaggcggatcacgaggtcaggagttcaagaccagcctgaccaatatggtgaaaccccatctctactaaaaatacaaaaaaacttagccaggcgtggtggcgggcgcctgtaatcccagctactcaggaggctgaggcaggagaattgctttgaacctgggaggcggaggttgtagtgagccaagattgcaccactgtactccagcctgggtgacagagcaagatgccatctcaaaataaataaataaataaaaagaattttagatatataagaaggaatcacacatgatttgataaaaattttattcaataaatgatgctgaaataattggttacctatttaacaacatttaaaatgtaaaactaggctgggcgcagtggctcacacttgtaatcccagcactttgggaggccaaggagggtggatcatctaaggtcaggagtttgaggccagcccgaccaacatagagaaacccctctctactaaaaatacaaaattagccgggtgtggtggcacatgcctctaatcccagctacttgggaggctgaggcaggagaattgcttgaacctgggaggcgaaggttgcggtgagctgagattgcgccattgcactccaccctgggcaacaagagcaaaactccgtctcaaaaaaaaaaaaaaaaaagtaaaactatgcttagcttaggtactgcaaaaaaacaggccttgggccacatggattgtagtttgctgacccctgatttagatcatcacttcattcatctatcaagattaattctagattgattatatatttaagtaaaaatacatgaacacactaaaataagcaaatgtatattaaatgcctggcaggaggaagactgtgtgtaagagcatcagaagaaatttcaaagggaaagctttatagatttgactaaaaatgtgacagcttaattagtgggataaatagaaaatatggtgccacttcttaggctggtacatttgcagaaaatggttagagtcagaagataaagaaaattatcaccgagaattttctgtgtaagcttttcttttttttttttttttttgagatggggtctcgctctgtcgcccaggctggagtgcagtggcgcaatcttggctcactgcaagctccgcctcctgggttcatgccattctcctgcctcagcctccgagtagctgggactacaggcacccaccaccgcacccggctaattttttctattttttagtagagacggggtttcaccatggtctcaatctcctgacctcatgatccacccgccccggcctcccaaagtgctgggattacaggcgtgagccaccgtgcccggcctgtgtaagcttttctaaatgtctcatcaccgttatttttcaaaggagcttaaaaaagctatattctcaaaaatagttcattctttcacaatagtttgagaaatgttttcccaaagtcaaatttgaatctctcctagtgtgatcatatacccttcctaactggcctttctgtaatgaaaataaagaataattgggccaggcatggtggctcatgccagcactttgggaggcccaagtgggcagatcatttgagcccaggagtttcagaccagcctgggcaacatggtgaaaccccatctctacagaaaaatacaaaaactagctgggcatggtggcatgctcctgtagtcccagctactcaggaggctgaggcgggaggattgtttgaagccaggagattgaggctgccgtaagccatgattgtaccattgcattgcagcctgggtgacagagtaagaccctgtttgaaaacaaactaaaaagaaaaatttttgataaatttgaatattctgtcaattcttttgttattctgtcccttctcctccaaaaaagagaagcaatattcacgtccaatgttgtcaacactccataaacggtcaaaaaacaagcagtgtcaagctccctagaggtggtgggagtctcaacaggtagccagagcatgggaacagggatctgggacaaaagtgctcaaagttggtaatcaggatgttggcattctattataaagaggtccgctgggtgtggtggctcacgcctgtaattccagcgctttgggaggcccaggcgggcagatcacctgaagtcaggagtttgagaccagcctgaccaacatggagaaaccccatctctactaaaaatacaaaaatagccaggcgtggtggtgggcacctgtaatcccaactactcaggaggctgacgcatgagaatcgcttggacccgggaggcgtaggttgccatgagctaagatcatgccactgcactgcagcctgggcgacagagcaagactctgtctcaaaaaaaaaaaaaaaaaaaggtcccagacaccagactggaatgtaagggccagaaagcttgaatgcccagaatgggggaccagaaagaagcaggcaaagtctaactcaagctactgggcacattgctgtaagagtcacaaaaatgctagccaaggcagaccagttcaggcaccagcttagggacttgaaagcagcagaccccttatcagaaaagcagtgccacagtggtggggtgttgataaagggagcactgcccttgcagaatgctagagcaagccagagactttgggagcataatttttttcagtgtcatacaaataacacaaacattacctcggcaggagtcgcatcgtcctgttggtgatagttgtgttagacagattgagacacaggacccccgggcagccctcagaaatgtgtctcattgattcatcctgcatgaaaaacagagggaagaggcttatcaaattatagcaggctttgcaatttccccattatctttctattatccctcttcctgttccagaaaaaaatacatgtaagagttggtttcttcatattctttatctactattaggttgaaatgaaattaaatagaagccaatgcttttgctcaaagcatcattactccctccttttccctttccttggaaatcaagtctcattccatcacaatgacacttcattaaaatgtgaacccatgcaagttcaactctgtcacacgaaatttgagctcacatgtcaaagtgccaaacacttctgactcttcatatgcaggaaagcaattaaaaactgatccattttaaacttattaaaattattctgaaaggcatactaaacactctcaacaatggaactttagtaacagtccatatttatacacatatacatttatacatagatgtgtgtgtataattaagcttctgtggttctgttaactaaatattttaaatagctgaacagattttcaccagatttatggtaagtttgagatggctaaaataaaatagaggctacataccagttgggcaggagattcaatgctgggagtagggtgggggaggatctcaaagattcaagcatccttcccccagaaagctgaaaactgaagtaagagagtagtgggaccatgaaataagagagacagaaaaacagaggtttcaagcacagattctaagttgaaatttacaagaccagatgaattgcaagctttgactgcaacaagctgctttttgtataggtaacactatataaaatacaacgagtagcagcaggtttttatttaatgattgatgaatctccccaggaacatcaacagggcagccagtttaagtattagtggtgcatgcaatgtttgacgctacatcagtcccagaaagaatagaccactgcaggtatctatctgtctggaagaggtaaatcattactaggctagaagatgtggttctgagaagaattctgcatcagaaatatgaccactcctaacaccactaaagatagtaaaggcttattttcaacaggatcattgaggtttaacattccattcattactatttccagtagtcatggatttttaaaacaataaaatcctgcaggtcagagcatctgtcacactcagataggaattggttgatttacaggggcagcaaaccacaccttaaagagaacacaagattctatttgaagctgtaaatctctgtgattctgctatagggaaggttctatgcacccatgctgcatgagaggccagtgcagagcttttgataaacactactcttaactacagtattcaagctgtcagcattttttctagatgccccatcaccaaaatgaaggatttgaataggtatggatagataaaatgtgtacaatttttccaaaaagaatctagagaataaccacgtgtggcactgtatttcaacacaatgaaaatctgtctttgaaaacgtttggcatgccaatcaagtatcaaagtgattatacacttgttgaaagaccttggcaaaatgcaaatgagatggggcaaggaaaggagaaagagctcacttaaacaccctcagagaggcagccacaaagatgaaaatgtggggaccaggaagaggaaggtggagtagctttatgtatcataaagaaatctgactttctgtttgagatgaggaggcaatccattctttgcattttcctgtctaaagaagcttggacatccaaacaaaattagaccactcccattctcagattgagatgaggaggtaatgcattctctacattttcctgtctaaagaagcttgaacatccaaacaaatttagaccactcccattcttagtacttaaaagaactcaagatttaatccccaaatgtttgaacacataaatgcaaaaactgagtacctacattgcagaatgacttatgaatttgtccacaatgtactcaaatctttctgaatgtaatatatttcataggataagcttagaaatcaaagctcttcgaatgagtgttacccaactccttaaatgtaagcctgtgtcccagtctacgtctcaaagggaaaaacaatagtaaaatgtagctggataaaattatcagccctgtatattattagactccaaaatcggacaagactttgatgttcacaaattcaatgcattgttttgacttccctattagagggccaaactcaaagaatatgatatcttactcaagtacacaactgaagctccctgaggacaagaactgaaaaatgattagttttttaattccctccaacacctagcagaacacatttaacatagtaggtgctaaaacatccacagaaagagtaaatccatttgacaaacaacttcattataatgacaggcagacatctggagaatgtagtagtcaagatttaaaatccttcttcatgaaggagcccacgttcactttgctagtggagaaagagtgcaaccagagaaagcagaacatttttttctctgatgtgatatttgacatgtctgtctatgcctccatttcttgcggatgaccctgaagggtacttttgaacataaaggaacagcttatttatgttaaagtacaagccactgagaagatgcttagtttacagtctatggtggttctttatgttctgctggacagggattaaacaactaatttaaatgctgactctgtgtgttgaggtaaggagtggaggagttctgagggtcttaacattcttctgtacacattctatttgtgtataatgccttccatgttttgaaaagatgttttactgtggaaatgggatggatttcatggggaaaaattactaaaggaggattttcaaagtgctcagttctaaaacgggagatacatatgtaaacataagtgtaatacagtgtgaagtatctgtgttgaagtactgagaccatatgtagctcagaagagggagaaattaattctgtcagctgggtgcggtgtctcacgcctgtaatcccagcactttgggaggccgaggcgggtggatcacttgagctcaggagttcgagaccagcctgtccaacatggtgaaaccccatctctacaaaaaaaattcaaaaattagccaggtgcagtggcacgtgcctataatcccagctaattgggtggctgaggcaggagaatcacttgaacctgggaggtggaggttgtagtgagccacgatggcaccactgcactccagcctgggcaacagagtgagactccatctcaaaaaaaaaaaaaaaaaaaaattaattaagttagaaattaactgtcaaaaagtgaacagaattgcatagggccgggggttgagagaaaatgaagggtgactgttgatgggcatgggttctgttaggggtgagggaaatgttctgaagttggttgtggtgatggtcaaacaactctgtaaaaataccaaaaccatgaaattgtacactttaagtgggtaaatttaatctcaatataaatataaatttattatatctcaataaagctgtttattaaaggtcaataaacaaagagaatggaaagacccgatagcattgaagagtgtgttaaagaatgaacaggtgttagccagtttgggctaggggtggtggggagggaagggtagtcatttaggcagatggaaaaacaagttcaaagacacaatgaaatagcatgacatgaacagggaacttcaagtggttcagtattgaaatagagtagaattttgaaagaaaaaactagaaagatgaggctgtaaaaatgaggctgagaggtagcagggaggggccaattcatgcagtcttttcaccagcgaggagggcttggccttcatggtggagctggtgcctcatgattggcattccacagccaggcttttcctcctattccctcctatctcgttagggacttactccatgagttgcttcagctgactctccatcatcctctataaacctgtttccatttccctgcccctgttttccttctaccactctctaagacacttttctggaaagatcagtttatgcctaatgcctcaccttctgacctcttctccacttcacaattcattgcaagtagatttctgctccaatatcccactgaaactgttgaagcaataattggcagtcccttctgattctcaaatctacaatgcattgttcagtccttttcttacctgttcactttggttctttctgaaactctttactcactttcattttgtgatacctcttcattgtcaacctacttctcttactattccttctgaatatcctctgttcctaaaagtcagcattccgtaaggctcaactttaagtctgctcctcttctcaaaccttctaagttgatcttattcacgcttatgatgttaattatgacttatacatagatgtcaacccaagatggaatctcaattctagtcaatgttgtccattgcctacttggtatctccagatagttgcattcactaaatattattgaatataatatgccaaagttcgtgctgttgtgctatgactaccacaaagaacaagacacatctcctgccctttgggtctcttaggctagtgaaggaagccaaaaccctatggttaaggatacttatcataggaacctagaggagcagcagtgaacccagccctgggagccagtgatgtcttggtagaagaggtgataataagacttaaagcttgataaagaggaaagcaccacttggggacaaagggaaagggcattttaagcaaagagcaaatgcacaactgcaaggagcaacttggagcatgcaggaaaaggaaactcagcagctgtaggcactgcaaattagtgtgtacacagaaactgaaacaagtgaggctggaaagggaggcagaggcaaaaccacagagggtcttcaaggtagagtaatattaaagagctttggctttatccaactgtgtagatgacggcagtgtgtgtagctggtggaagatgagagtgaagtagtcatatctgccttttacaaagagtataaagtgctcacagaatggaagacaggttggggacagagggaaagactggagacaggaaccaggaagaaagcaactagggaaacatattcatttccatcttctttggcacagctgttgatagccatgaagataaaatgagcctatcatgtctactggggcccaatttttttctgtctcatacacacataccattaaatataaatacagttcattttgggtagtcattgaagaatttctacttgccagaggctccaacactgagcatacatctacatgattaatattagcgttgtgcagatggagtaaaatttcttgtcaatgtttaacatagtttgctcttttccacattgaatcccaaataagcacacaagcatctattctgcatattggcaccccaatgtagcaagtcaatctatataaacagcagtaaaaatggttgcttatactcactgtgaatgttgggcagtcagagacattcaactcttgcaagttcctacagtggcctaaatcaaataagttacacgtcactaaactacatattgcaaatgtttaaacaaagtttttctatcttacattgaatgcaatgtattcattagaaaacaaacaaaaaccttggcaagtaacatgttctaagtatatggtttctttccccagaaaaatggcttttttgggcttcagaattaaaatacacagacatgtttattattgtttgaggattataggagtaaggggaaaagagaaaaatattactttgggaaaaacactatatacttagagcttttagcttgaaagcacttgaagaaaaccaacctggttttttgtgcctgcttttttatttttttgttttcatttaacattttattatgaacattttcaaacatacacaaaagtggaaagaattgtacaataaatatctatatagccactacttggattctaatttatcttttactgtatttgctttatcacatatccacccactcattcatctctatctatagccctcaatcatcttatttttgtatgcatttcaaagtaagttgcagacaccagtacacttccccccaaatacttcaacatgtatatcataaataattcagcatgtataataataaacagaatagttgacatacagaatacaatagttattctgtttgtttgtttcgtttttttgagacagttgagacaggatcttgctctgtcagccacgctagagtgcagtggcaccatgttggctcactgcagcctcaacctcccaggctcaggcgatcctttcacttcagcaacccctactgtcattcccaagtagctgacactacaggtgcataccaccatgcccggctaatttttgtattttttgtagagacggggtttccccatgctgctcagactggtctcaagagatctgactgcctcagcctcccaaagtgctgggattacaggcatgagccaccgcacctggccagaatagttatttgagagtaattcatcagttcaacaaatacttatcaaggagatatagcagttaacgaaatagacacaaatattttcccttaaggagtttactttctagcggggagacactaacagtaaacaaaagaagttaaataccatatctactttgacagatggtggtaagtgccatggagaagaaagaagaaaagggattgggagcacccaacaagtgggaagaagtgtgatttaaaatagggctgaacaggaagttttcactgaaaaggtaacatttgagccaagacatgcaggagatgacaaggacagtgccatttactccaagcatctctggagcccacacccaacatggttggtgactgggagacagaaaaggatagaaaaaaaaaaggctcaggaagacaacaattcaagtcctacccttgtgtgtgcatctcaaggctgtgttcttttaaagaaggagaattctttgaatttcttaaatccgatgtgatggtgaactgcaggcttcggttttcatcatgctgagtcctaacatttgtgactacttcccccggggtggccatgtgaagcatcttatgcgcatgagcctattttatcctcccaacaatattaggaggtatcctcggtccgttttacagatgctgaagatgacccaggttgatacagttaagcaggtaagagagccttgattcaaactcagggcacaaacatttggcctctaacccaggcaactaagaggggaaggagctttctacgtcactgttctgtggaactagaaggcctttgccttaaaaagtctgttcttatctgtcagtaatacagtgcttgcaatgggccttaatttttaatatatatttttttctcttccagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggggaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaaggtttgtacttttcttactttttcattttcatgaataacttgaaatgctctttgaatcttataatcctccctacatcccaccatgtcttggaattcgtgatgtcacttccaccagaaatccttccctattgacaatggaatttaccacaagtttttctggggtccagactcaaggcagttggtaattaaaggacaatgacaggagggaaggaggtatcctcaggagggcagccatttgggttctactcatttgcacatcgcaagctgtcactgtaaggaattcctttcatcttaactccaatttaatttaggtaggtaaaccaaggggtatgaaaataagtgcaaatgccatctatataacctgacttacaccgattaaagccaaaacatggtgtgcatctgtgagaagatcacctcaaagagaaaacatctgcaggacaggactgtgagagcactctgagacagagtgaaagtgatggcccttcggtatttcttatcatttagtcccaaggttttaataaatgctcctatgctcatgctcctttttttttttctttctttttttttttttttttttttttttttgagatggactctcgctctgatgcccaggctggagtgcagtggcgcaatcttggctcactgcaacctccacctcccgggttcgagcacttctcctgcctcagcctctcgagtagctgattttaataaatgcctcttaacatcctatatcttaattatttccaaattacccagaataaaacaataaaaatttaaagaactaaatttaaaatatttaacctgagaactatgagactaaggaaatctttctagaatattacctacttcctgcaaatcattactgggttttgcaaccgatgcaatcttgtgctagtattatgcaggatttgcacatgcaagataaagtcatgagctaagaaaacagacgggagattttagtaatgctcttgacatgttagtgaagattgatgttctcaaagagtggtctgggaactgctaatctaccctacaataacgaaccatgtaacaatgtctatatgtttcatttctggcatggtttaataatttatttgtaatattaaagccagatgtcattaagtgaggttcatatagagcacagtatcatttcttccacttattttgggaaattttgctatgttttgtttctttaagggcaagagaaaggggaagttcagagaggaggccgtggctcctctcgagagaatgttaggcaggaatttattaatgttgtcaggcatcctgaaccagaagtaaatttgctcatttaccagcaaagtcatgctcaagccttgccccactgccccgctcccctgccccccaccccagctgtaaagatggcacctggttagatcccacagcagcagccatgtggcacagggaggtttgcttaccaagacaccctgtgaactgtatataattcagtgccataggaaagcagttacatacagcttcataacctgggacatgccattctaggctccaggtacccacacacgcatgctgtctacaacttccaggaagatagtaacattcccatttacagatgaggaaaatgaggctcaaagaggttcagtcacttgaccatggatctcacaggtaagtagcaaagctaagaagtgaatcttggtctatctgagccagagcctatgagctctctacttcaccctgcaatcttccagaattaatctgagcatattcaaacaatcagctgtctcagcaatgcaaccattagagaatttcaaagagtaagtaaatgtagtttttctatagccagagtgggtagaatttcccggatattgttatggtgagtccttagtgcttcatgctgaagagcatgtttattagaatttcctttgtggtgcttagattgaaaactggaattatatatttttaatactaatacaaagctactctcctagattttagttagaatacttgatattgctgaggctctaacctcaagctacagtgaatttgcacttgctgtatcaggtgtaaatgagaaaagtaaatagtattaagtttattaattatctgagaaaaataccatctatacaagatttaaaacttctacaacgagactacactgtgttctaagaagagataacatgtgaggaaatgtctctttttcactgcttttatgctcttgggccattccctcccccaatgagcctatttctgcttttgtgtttttttccttttttcccatatttttctcttgaaaaacatcagcttataaaaataagtacatttttattgctttcttcaacttattgttgtgtaaacacaaccttccagaaatgccccataaattcataccccctgctttaaaaatacacattatttactgaaacacaatataaataaggtttcatgacatacacacttagtatatgtaacactgggtcatcaaagaacaacttaagttcctccaagtgttaatgactgtgtaattcagagcctattattttagattataagacgaagggtaggccaggtgcagtggctcacgcctataatcccagcactttgggaggccgaggcaggtgggacacttgaggtcaggagttcaaaaccagcctggccaaaaagttgaaaccccatctctactaaaaatacaaaaaaaaaaaaatagccaggcatggtggcaggcacctgtaatcccacctacttgggaggctgagccatgagaatcgcttgaactctggaggcagaggttgcagtgagctgagatcacgccactgcactccagcctgggcgacagagcaagactctgtctcaaaaaaaaaaaaaaaaaatgaagggtagctttgtcttttaatactatcagtacaaatggctttcactgtggtttatataaatctagtgattcatttcatcatttacttttcattttttgttatattgctgattcccataaattcaaagggaagagtcttgtttattaaattccctttggtagtgcctgccacagagccatgtgctttagattgatgatgataactggactactcttctttattctttcaaagcagtaatttaagcaaccattgaaagtgaaaatacacagaagttaaaaatcatggctagaattgaagtgtgacaacctgaggatcggtacaagtataccacatatacatggtcacacatagagaacttgcatacagattccccaactcggagttgagacttgcccagctgacttgcaatgagtcagatggtgtgtataggggacctaatatgtgcccattcaaccacacagacctcaatgatcactatgtatttttgccttaaatatctaatggcaagaaaaagaaataatagctttattcactgagaaacaggtactttgccaagaaatcctagtgtttcaaagggaataaatgtgagactaattgaaaggcatatttatgccatattgaggtaaacggatttgtcaagaatacatgaaagtcagagtttttaaactgctttagcttcacattgaccagaatagtttaccatttttaaggagttattttacttctaacatcagatgggggagaattacgcaggtaaattacccttagctgcctccaaagttaaggtcacaattttactacagcttgaacaatagttaagaattttgtatatgcaataaacagggccatttatgtctcttttcttactgctacaagctttcagagtagttctgaggttgctgacaaccaatatagcctgctaaatggggaaattacctggagaaatttcctaatttcctcctcaaaatcaacaagatttggctggagaaggagcaagcttgtaaggggtaataatcaagtaaatatggtatttgttgaggcatttaccaagaatttggggtagcagtatatatgaaatgtgcataccacatagtacctggactagaaataggggcattgatcaaattctccttctggtctggggaaatgtatatttatatactctttatcaaaagcaaacactttgcatcaatatttgcaatatttgcaattctcattgaagttctaaggtaaaagaactaaagaatttttctatttatcaacacagcaaatgagattttcctgtgtttttctaagccacactaggaaagcctttgttttgcatttcctggtattacttgtggatgctatttttacccaggactgctgctgacaatcccaaaatggattctgcagtttatattctttttccagcacccacagatctgccacattgcctaggcctagtgtcagggtgttctcataaacatttttttcgacccatttatttgtggttaacccactttagcttgccctaaaatggttgctctgtcatccaccttcatgtccagcccagcagatgtgggttcaataagcaagtcctgataaacaggctgctttctagaacctaggaggttctgactttggtgacaaggatgacctacaggtcttaatggctttatagggccttagtgaggactctggctttcatcacaattagatgggaagtcactgtaggctttgctgggctttgatggaatttagcgtatgctaaggcttgtttcatactaactttctttggctttagatatccctttaccccttctctttaagagctgattcttcaatcacacagatataacggtgaccgaggaaatgggggcaaaaagagcataataacgtaaatattattaaattttccagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctggtaagttcccctgtatagccccttcaatgggtggcaagtgttctgtgatttttttctatggcaacacttatatacagtaaattcagtttaaaagtaactgaactaaataataaagtacaagttttaattaaacatgacacttatactaggagttgtttgccactcagataaatacttgccaaaatgctgctttatgaagtatgtaataccacatattactaccatttaattcagttagcccaaatagtgtgttatagatttttaaagtaatatatggcaaatggtcaatagtatactaaaatgtagtggttttttttttgttttttgagatggagtctcactcttgttgcccagactggattgcaatggtgtgatctcggctcactgcaacctctgcctcttgggttcaagcaattctcctgcctcagcctcccaagcagctgggattatgggcatgtgccaccaggcctggctaattttgtatttttagtagagatggggtttcatcatgttggtcaggctggtctcaaactcctgacctcaggtgatccgcccaccttggcctcccaaagtgctgggattacaggcatgagccaccgcgcctggccaaatgtagtgactttttttgtttgtttttttttttgagatggagtctagctctgttgccaggctggagtgcaatggtgcaatctcggctcactgcaagctccgcctcccaggttcacgccattctcctgcctcagcctcccaagtagctggaactacaggcacccgccaccacgcccggctaatttttctgtatttttagcagagacagggtttcaccgtgttagccaggatggtctctatctcctgacctcatgatccgcccacctcagcctcccaaagtgctgggattacaggcgtgagccaccatgcctggcctaaatgtagtgatttttaaagggaaattcaaatttggaattttttttgctattcattaagccccatcttgtttagaataaattagaaacaaactgctaagcactaagctcaaattaggataaaatgtgctcaaaccagagccagacatattatatctagttctagatcaagaccaattctctttcccatccttcaaatctcttctccatttgctaagcaaagcctctggcgaaaatgagcttggtaaattaagtaaacacatcggatttggaaagaactgagaattactgcaatattgaccagatttataacatatataacacaagtgctttcactaggctacttcaatttgaaaagttttaactatgaaaatgattattaaaattattaataatgtaatgtaatgttataaacattttgagtacaactgtttcccctgcttttcttcatgataatctaataccattaatagaacattagaattttaacacaataaaagtgaaaaattagaatgaacattctggagccacaagggcatattttagagttaacctttttttaaaaattagaaaagcataattttttaaaatttcccaagggacagcagtatgctacacttataccttagcttgttacagatgatgctaacttgggagtatgtttgaactgtgaagtcaaaagcaattttcatttttcaataaataaggatactacagacacccttctcccaaatgaagttagcattacattagtgtgcaagtcagtcactggtagccagtgtcatgtccacaaagccagggtacagggtaaagaatctggaagtggagaccctttcttgcaagaaaaactcacttcgaccccctatgattccatctccaacctgaccaatcagcactccccacttcccaagcccctacctagcaaattatctttaaaaactctgatgcctgaatgctcagggagactgatttgagtaataataaaactctggtctcccgcacagccagctctgcatgaattactctttctccattgcaattcccctgtcttgataaatagactctgtctaggcagcgggcaaggtgaacccattggatggctacaaactaaagaatctcaggacaagcaaaagccattccaaaggtccttgggcaagtgtctaatttccttctgctgtcatccacaagcaaaactgtagtttaccaactatcaatgcaaacaagttttaaagctgtctcaaaaaaaaaaaaagattataatagttattatatgtcctaagttaaatgtattaaagtaatgagtaacagtgtggcaatgttttagttacaacaaaactagtatacaaagaaaacttgagaaaaatgagaagacaatgcaaagagatagataatagtgtaaaatggacttgccttgcttctactgatgtttttcacatgtttcccgtaactgatacttttcatcagttgtggaattcccataattgcagggattccttttctgtccttaggatcccctgaaggccttttaatcttgttcaccaaatgtgtgttccttgctgacacaaaatggtctctaccatcagtggtggtactcttttttccccctttgttcaattcaatctcaggaacgtatttcctacattaataaatatttactgagcacctaccaaatgccaagcactttcctagaacaaaagttcttttgaaacaaaaaagtatcttggcagttaaggcaaaatgacctaaagaagttttaaaatgaaaggtctcctatatttcagggtctttgagatgaaaccctgcaagtagacttacgtgaatgatttttgctgtggtaagtatacaaatgcagtgggagttgccagactttaaaagacgtgaataacaatcatataaaatgccagacattgttgtggaaaagagaaagaagataccctactagggggtttttacctcctttaagaaacagactaaaactagttttctcaagtgcctgaatatatatggtttaaataacaatatacaacactttcaaaataaaatctaggaatgtttacatatgcttttaatctcaaagtctaatgtcttgagaaaagtaaatctgtgagatcactgactcacagaattttagcaaatagaaaaaatccagtatcttcagaacacaagggctgatcttttgtcccctacccgcaagacattgcttggtaccaaaatagaaagttatttttttaagggggaattatgggttttttctgagaacagataatatgaaaatagttaatagtattggtatgaccacatattttcctaattcaaaataaggacgctatgctctacaagagtattttaaaacaataatgagataatgtttgaaatagaaacaaaatatttgtgagtatttctggagtatctggctggtccatatcaactggaatacagataacccaggtgtagatttctttgctcttagagggtgaaaaaagctttttgttgttttattttcagttatattggttttaattatccagcctccagcaaaattaaatacatatggattcaaagctgatagctaccatagtttgccaaaatacaaccagatgttttcaaaatgtggaaaaattgtttttggactctacaggaatagaacccttcccccaacactgggaaaaggttgttttctaggcattttcagtgttactgatatcccaggaactgtcagatcaccacccggcacatttttcatttttatctgcacttgtcttacatgcgaaatattttcttaattcatgtctcttttttgtagcatctttttttcccaagtaaataccaaaaaaaaaaaaagcccaaaatacattttttaaagctaacttaaaactgaatattgtattctagtaaaactaatcaagggaaaagctttgagtaacaatatatttcacaattttgcatttagacacatttacagtgaagaaatataattaaaaacaaaaccttctatcaatccagaaattctctccacaaaggtagtaacgaaagaaacactttcattattgactaagcattaaaccagaatgtgacgcatatcacaggcaatccactaagagactgcaaagactctcgccactatgtaaccaggcagataccacccattacaggaatctcatccctgtgtagccaagcagataccacccattacatatacgttttcaggacaagcaataacgaatccttaaggaagaagatttgacaacaccttttgtcacacataattcatcctaactttacctggtaaatggagtgaccatctgtgttagcttattggccttattcagagaaaaataaatttctgtcttcatgacaggaggtagttttgcaactggaagcaagatctcaccaaagttaggaccccaccttcccaccagagctgggagatgtccttggaaaatacattcttgcatcataaaggtgacaaaaagcctatctagtcttcaaaaggatttaaagacatttcaaagagaggagaaagtacttatagttaaaagttttctaaagtaaaagctctgagaaaaagaaaggaaaagaaatctctttattttcaaaggggaaaattaagcctctttttaaaatttgtatttgtcctttccatatgccatacactgtattaactcaattactcaggctcaataaatattttctgtttccagccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgtttacatgcctttcgatagctgtttgtgcatacttaaagatgatcaaaatgattttatacaaatgctgttataataaaatgtcattccctacccctctactttttttcagtaagtcatcttatacattaaataaatttccatttctgatttctgtgcattccaaaatgaggtcctgatacatccaaattctcaaccactcttcactgatccttgcaaagtactgtcaagctagacctgaaagggaattgtcacaaacaataagaagagaatgtgagaattacattggaagctggttagaagctaggaccctgaataacagctgtagatggtgtgaagcatgagccctgaagaggtataaacactcgtgaatatggagacaccatttttgtttgtttgtttttgtttttgttttgagcagggttcatactgggaatccacctgtccgtgagaaagggcccttcctgctaagctagtatgtcgaggagcataaaataaagaatgaaattaggatttgggggcagtatttgggatgaagccagaataaaatataggaaataatacgaggccactgagggaggaggtggtgcccaaaagaagccccgtgatttgggtttgcaggttaaaatgagctcacctagagaactagatcaccagcaaaagaggaaatcagtggaggattttagaccctgatcccatcagtttgcatttagatagtcatattctgcaaagagaaaaataaagtgaaaagaaatattcgcatgtccttagtgagatactactttttccttttaatatacattttcctttcatgctgagttgaatacattttcatttcttgtatcaaggtattcctacaaagtttagcaaataaccaccttatctgatacttgcacaaactcccaaagcatggaagatggtatataacaaatagtattaggcattttttttttctgagataagagtcttgctctgttgcccaggctggagtgcagtgctccaatctcagctcgctgcaacctacgccttccgggttcaagcgattctcctgtctcaacctcccgagtagctggtattacaggtgctcaccaccatgcctggctaatttttgtatttttagtagagacgaggtttcaccatgttggtcaggctggtcttgaactcctgacttcaagtgatccacccacctcaccctcccaaagtgctgggattacaggcgtgagccacactcagccatgcacttttaaagcacatgctacatgccagacaccatgctaagagcttcacatatgctacttctaattctcacaaaatccctctgaggtaggtgatactgtctgccttttataggtgaggaatcaaggtagagggtttaggtaacttggacaaagtcacacagctggcaagtggcagggccaggattcagatctgcctaagccctttctgctatgcagagctgcacagcattgtaaaagttatccttgtccatggctgtctggcaccagaacttccagaaccaaaccccaaagaggagcaggtaccaggaaagtgggggagcactcgtgagggcagttggcaggagaaagtcttttgtccgagacatttagatctgtatttatttacaggaaacagagaatgggaagccagaagaactgccagagctaacgcttcagtaaataactctggattgtgagtttctatttttattttatttatttatttatttatttatttatttatttatttattttgagacagtctcgctctgtcatacagtctggagtgcagtgttgcaatctcggctcactgtagccttcgcctcctgggttcaagcgattctcctgcctcagcctcccgagtagctgggattacaggcgcccaccaccacacccagctaatttttgtatttttagtagagacgggggttttgccatgttggtcaggctggtctcgaactcttgacctcgggtgatctgctcgcctcagcctcccaaagtgctgagattacaggcatgagccactgagcctggactggattgtgaggttctaaccactctgcccagtggtctgggtcagaggtggggacttagagacgttacttctccatgcaaatccctacattgttcactatgaggcatgaaagccagctactacatttcaaatgttaccagagagatgtaagaagttcatttatttacaaattcatttattattgttcatgagcctcagagtggaattttaaggacataggacctgaaagagccaagatttgatgatggaaaaagcctggtgtgacaacagaatcacactggaggcaagaggattctggaatgaaatgagatgaaacctgattcagagaaagagcccaagttgttctcagtataatttttagaggctagttagggattttattggttgattttcatattcaatttaatccccagggatgtatttggaaataaagctcctgaacacatcaaaacagaaattaatccaggccatccaaaagtaagtcagtaggtattgctaacatctctcagggtcaagactgaagtggactttcaaatcttaagatttgccccttttctacatcagagttaaactttttcagggaagtgtagttgattcatgatggaatgaacaattagacacttcctcttccaccaatttcttactttatagttactcttgtaacttgcctttggatgtctcttttttacgacagacaatacaagttcataaggttacaaaaatcagtatattttacagtagtaaaaaatactactatcctgagatatacctatttgaacgtatatatcacttggatatttggataaaataagttaaaaaaaaaaaccctttcctagtcgtaagattctctgatttttctgaagtaaacaagatttactataaacggagtcctcctgagtcctgagttggctgtgacctaatgcctagttacttgagaaagatatttaatgttaagcagcactgctttttcattcattcaccattccatcctctggagcctatgccctggatcaattcatgtctgtttctgagaaatctgagtctcctgctctggcaaattggcaaatcaaagggattcagtaatgaggatcttttttttttttttttgagttggagtctccctctgtcacccaggcaggagtgcaatggcaccatcttggctcaccacaacctctgcctcctgggttcaagtgattctcctgcctcagcctcccgggtagctgggattacaggcgcccgccaccatgcctggctaaattttatatttttagtagagacagagtttcaccatgttggccaagctggtctcaaactcctgacttcaaatgatccgcccacctcagcttcccaatgtgctgggattacaggaccactgcgcccggccagtaatgaggatctacttgtctgaattctgttaagtctgtgccctcatctgccttttaaggatttatttattttcttttttttgacacagagtctcgctctgtcgcccagggtggagtgcagtggcatgatctcggctcactgcaacttccaccttccgggttcaagcaattctcctgcctcagcttcctgagtagctaggactacaggtgcccgccaccacacccagctaatgttttgtatttttagtagagatggggtttcaccatgttagccaggatgatctcgatctcctgacctgtgatctgcctgccttggcctcccaaagtgctgggattacaggtgtgagccaccacgcccagccttttttttttgacacagtctcgctctgtcacccaagctgaagtgcagtggcatgatcttggcacactgtaacctccatctcatgggttcaagcaattctcgtgcctcagccacccaagtagctggaatcacagttgcacatcaccatacctggctaatttttgtatttttagtaaagacaaggtttcgccatgttggccaggctgggctcaaactcctggcctcaagtgatccgcgtgccttggcctctcaaagtactgggattacaggcatgagccactgtgcccagccttaaatattttaagataacattctacagttaattttctaaaattttactggtataaggattacaactgttgtgttcaatcagccaaacagcccaaaagagtagccaatatttatcttcaatctaacagtcagaaaaccaatcttcccagaaatgtgtgtaattcttgacacaccaatagaggaactgatcttagctggggtaggggttggtagtggggcaggagagacaatggaaaagctaaaacatctctgagaatttttttttaacttttattttaatttcaagggtacatgtataggtttgttatataggtaaacttgtgtcacaggggtttgttgtacagataatttagtcacccaggtattaagcctagtacatgttagttatttttgctgatcctctccatcctcccaccctccaccctctggtaagccctagtgtccatcattcctctctatgtgtccatgtgttaagaatggtttttatctttgacacactcaagttttctggaattaaaatgggtttgattaaataattttcagtaaattaaaaatattaccaagataagacagacattacatttgcttccttaaaaaaaatcaaggtctactcaggcttgaatgctcagttgtttctgtgatgaagacaattgtactaagaagtacacttccagaaaaatactgcgtgaaatatattttagttacaaaatattaaaaatttaaagaaagaaaatgtttacaggctatcttgacctcagatacatatacaaacatatacatcctatgtatagtggttaaaacctcacaatccaggctgggcatggtggctcacacctgtaatcccaacacttcaggaggctgaggcaggcagatcacttgacgtcgggagttcaagaccagcctggccaacatggcgaaatcccgtctctactaaaagtccaaaaattagccaggcatggtggtgcacacctgtaatcccacctactcaggagactgaggcatgagaattgtttgaactggggagatgtggttgcagtgagccaagattgtaccactatattccagtctgggcgaaccagcaagactctgtctcaaaaaaaaacaaaaacaaaaacagaaacacaacaataagaaaacaacctggttaaaaatgggccaaagaccttaacagacacctcaccagaaagatagaagcatatgagaagatgttccataacaaatgtcatcagggaaatgtaaattaaaacagcaatgagatacccccacacacctattaggatggccaaaatccataactgtgacagcaccaaatgctgatgacgatgtaaagcaacaggaattcccattcattgctgatgaggatgtggagcaacaggaactctcattcattgctgatgagaatgcagaatggtacagccaactttggaagacagtttggcactttcttacaaaacagcacatactcttaccatataatccagcaatcatgttccttggtatctacccaaaggagttgaaagcttatgtctacataaaaacctgcacataaatgtttataacaactttattcatatttgctcaaacttggaagcaaccaagatgtctttcaagaggtgaattaataaactgtggtatattcagacaatggaatattattcagcattaaaaaaatgatttatcaagccatgaaaagacataaaggaaatttaattgcacattaataagtgaaggaagcccatccaaaaaggctacatactgtatgattccaactatatgacattccagaaaaggcaaaactatatagacaataaaaagattggtggttgtcagaagctagcagggtgaggggggatgaccaagcagagcacagaggattcctaggggaatgaaactactcagcacaatattataatggtaaacacctatcattgtaaatttgtccaaactcatacaatattcaacactaagagtgaaccctatataaactatggactttgggtgataatgatgcgtaaatatagcttcaccaattgtaacaagtgtgtcattcttgtgggtgatgttgatagtggggaggctatgtatgtgtgggggaaggaggtatataggaaatctctataccttctgctcaattttgcgagaacctgaaatttctcttaagaataaagtttatggctgggcacagtggctcacacccgtaatcctagcagtttgagaggccaaggcgggtggatcacctgaggttaggagatcaagaccagcttggctaacatggtgaaaccccatctccactagcagaggttgcagtgagccaagatcatgtcactgcactccagcctgggcaacagagcgagactccatctctaaataaataaataaataaataaataaaagttaatttaaaaaaaaacgaaaagaaagctcttaaatcaataacctaacttttaacctgaagaaactagaaaagaagagcaaacaaaacccaagtcaaccagaataataaagactgaagtgggctaggtgcagtggctcacacctgtaatcctagcattttgggaggctgaggcaggaggatcacttgagttcaggagttcaagaccagcctgggtaacatagtcagagcccgtctctacaaatttttttttaaaaagattagccaggtgtggccacctgtagtcctagctacttaggtgggaggtgggaggatcacttaagcccaacaggttgaggctgcagtgagctgtgatcatgccagtgtactccagcctgggcaacaaagtgaaactctctctccaaaaaaaaaaaaaaaaaagattggagtggagataagcaaaatagaaaatagaaaatagagaattaataaaaataagggtttttttgaatatccatatttatagtagtattattcacaatacctaaaagactgaagcaactttactgtctattattggaagaatggataaacaaaatgtgttatatacatacaataaaatattatttacccttaaaaagaaatgctgacacatgctaaaataagtaaaccctgacgacattgtgctaagtgaagtaagccaggcacaaaagaacaattattgtttgattccacttatatgcggcacctagagtcatcaaattcatagagatggaaagaaagtagaatggtggttgccaggacctaggaggagggcaaaaagcggatttagtacttaatggtacaaactatcagttttgtgagatgaaaaagttctggagatgcatcagtgatgatggttgcataagaatgtgaatatacttaatgctacagaactgaacacataaaagtggttaaaatggtaatttttaggttacatattttttacaacaatgaaaaaagaaccaaatggttgtttgaaacaatcaacaaaatttgcaaacctttacctagactgaccaggaaaacaagaggaaagactaatattattaaaattagaaatgaaagtgggtacattagtactgactttacagaagtaaaaaggatcataacagaatattatgaactgttgtaccccaacaaattagataaactgcatggaattgacaaatgcctagaaacacatgaactaccaaaactgactcgagaagaaacagaagatctaaatagagctataataagtaaaaatactaaatcagcaatcaaaaaacctccaacaaggccaggcaccatggctcattcctgtaatctcagcactttgagaggctgaggcaggtggatcacttgaggtcaggagttctagaccaccctggccaacatggcaaaaccccgtctctactcaaaatacaaaaattagctgggtgtggtggcacgcacctgtaatcccagctactcaggaggctgaggcaggagaatcacttgaacccagaaggcagaggttccagtgagccaagattgcaccactgaactccagcctgggtgacagagtgagactccatctcaaaacaaacaaacaaacaaacaaacaaaaaaaccctccaacagagagcctaggaccagatggcttcatgggcaaattttaccaaacatttaatcctcaaactttaaaccaaacattaatcctcaaattcttcccaaaaaatagaaggaaaaaatacctcctacctcattcgatgaagccaatattatcctgacaaggaagccaaagacatcacaagaaggaaaaactacagagtaatattccttttaaatatagatgcaaatatcctcaaaaaatattagcaaagagaatccagcaccatattaaaaggattatacaccatgatgtacgaacaagcaagactgatctcaggcattcaagagtggttcaacagacgaaaaaaaaaatcaatcaatgtaatatacgcaataataatagaaggaaagaggggaaaaccatttcagttgacttagaaaaggcatttgacaaaatcccatcacccttttataataagaacactcagtgaagtaggaatatatgggagcttcctcaatgagcaattgtgtaagaaaagaaaaaaaagggagaatgggtatgagcttcctctttgggctgatgaaaatggtctagaattaaatagtgctggttgctcaacattgttaatataataaaaaacactgaattgtactctttaaaatggttaaaaaggtgaattttatgttacataaaatgtatctcaataaacaaaagcttccagataagcatgccttgctatttctcagaaactcattccactgttcaactaccattgctatcatgaaaatcttaggtcaaactgaaaccctgaatgttgcaacttgagtccatttccttccttcagaaaatgcagatgtatttaatagtatattttctatgtatatttcatatgtgtatatatgtgtgtatacacatatacctatagggaaagagggacagacaaaaacagagaaacaaggggtgttccaagatggccgaataggaacagctccggtctgcagctctcaacatgatcgacgcagaagacgggtgatttctgcatttccaactgaggtacctggttcatctcactgggactggttggacagtgggtgcagcccacacaggaaaagccaaagcagggcagagcatcgcctcacccaggaagcacaaggggtcgggggatttccctttcctagccaagggaagccatgacagactacctggaaaaatggggcactgctgcccaaatactgcactttaacattcttaaagaaaataattttcaacccagaatttcttatctagccaaactaagcttcataagtgaaggagaaataagatcctttacagacaagcaaatgctgagagattttgtcaccaccaggcctgccttacaagaactcctgaaggaagcactaaacatggaaagaaacaaccggtaccagccactgcaaaaacatgacaaattataaagaccatcactgctatgaagaaactgcatcaattaacaggcaaaacaaacagcaaacatcataacgacaggaaaacattcacacatcacaatattaactttaaatataaatgggctaaatgccccaattaaaagacacagactggcaaattggataaagagtcaagacccatcagtgtgctgtattcaggagacccatctcatgtgcaaagacacaggtaggctcaaaataaagggatgcgggaagatctaccaagcaaacggaaagcaaaaaaaggaggggttgccatcctactcactgataaaacagactttaaaccaacaaagatcaaaagagacaaagaaggccatgacataatggtaaaggaatcaattcaacaagaaaagataactatcctaaatatatatgcacccaatacaggagtttccagattcataaaacaagtctgtagagacctacaaagagacttagactcccacacaataataaggggagagtttaacaccccactgtcaatattagatagatcaacaagaaagaaggttaacaaggatatccaggacctgaactcagctctgcaacaagcagacctaatagacaactacagaactctccatcccaaatcaacagaatatacattcttctcagcaccacatcgcacttattctaaaattgaccacataattggaagtaaagcactcctcagcaaatgtaaaacaacagaaatcacaacaaactgtctctcagaccacagtgtaatcaaattagaactcaggattaacaaactcactcaaaactgcacaactacatggaaactgaacaacttgctcctgaatgactactgggtaaataatgaactgaaggcagaaataaacatgttctttgaagccaacgagaacaaagacacaacgcaccacaatctgggacacatttaaagcagggtgtagaaggaaacttatagcactaaatgccccaagagtaagcaggaaagatctaaaatcgacaccctaacatcacaattaaaagaactagagaagcaagagcaaattcaaaagctagcagaaggcaagaaataactaagatcagagcagaactgaaagagatagagacacaaaaaaccattcaaaaaaaaacaatgaatccaggagttttttttttaaaaagatcaacagaattgacagactgctagcaagactaataaagaagagagaagcatcaaatagactcaataaaaaatgataaaggggatatcaccaccaatcccacagaaatacaaactaccatcagagaacactataaacacctctatgcaaataaactagaaaatctagaagaaatggataaattcctggacacatacaccctcccaagactaaaccaggaagaagttgaatctctgaatagaccaataacaggatctgaaattgaggcaataattaatagtctaacaaccaaaaaaagaccaggaccagacggattcacagccgaattctaccagaagtacaaacaggaggtggcactattccttctgaaactattccaatcaacagaaaaagagggaatcctccctaactcattttatgaggccaacatcatcctgataccaaagcctggcagagacacaacaaaaaaagagaattttagaccaatatccctgatgaatatcgatgcaaaaatcctcaataaaatactggcaaaccgaatccagcagcacatcaaaaagcttatccaccacaatcaagttggcttcatccctggaatgcaaggctggttcaacatatgcaaatcaataaacgtaatctatcacataaacagaaccaacaacaaaaaccacacaattatctcaacagatacagaaaaggccttcgacaaaattcaacagcccttcatgctaaaaactctcaataaactaggtattgatggaacgtatctcaaaacaataagagctatttatgacaaacccacagccaatatcatactgaatgggcaaaatttggaagcattccctttgaaaaccagcacgaggcaaggatgtcctctctcaccactcctattgaacatagtattagaagttctggccagggcaatcaggcaagagaaagaaataaagggtattcagttaggaaaagaggaagtcaaattgtccctgtttgcagatgacatgattgtacatttagaaaaccccatcatctcagcccaaaatctccttaaggtgataagcaacttcagcaaagtctgaggacacaaaatcaatgtgcaaaaatcacaagaattcctatacaccattaacagacaaacagagagccagattatgagtgaattcccattcacaattgctgcaaagagaataaaatacctaggaatacaacttacaagggatgtgaaggacctcttcaaggagaactacaaaccactgctcaacacaataaaagaggacacaaacaaatggaagaacattccatgctcatcgataagaacaatcaatatcatgaaaatggccatactgcccagggtaatttatagattcagtgccatccccatcaagctaccaatgactttcttcacagaattggaaaacactactttaaagtttatatagaatgaaaaaagatcctgcattgccaagacaatcctaagcaaaaagaacaaagctggaggcatcgcactacctgacttcaaactatactacaaggccacagtaaccaaaacggcatggtactggtaccaaaacagatatatacaccaatggaacagaacagaggcctcagaaataacaccacatatctacaaccatctgatctttgacaaacgtgacgaaaacaagaaatggggaaaggattccctatttaataaataatgctgggaaaattggctagccatatgcagaaagctgaaactggatcccttccttacaccttatacaaaaattaattcaagatggattcaagacttaaatgttagacctaaaaccataaaaaccctagaagaaaacctagacaatatcattcaggacataggtattggcaaggacttcatgactaaaacaccaaaagcaatggcaacaaaagccaaaattgacaaatgggatctaatcaaactaaagagcttctgcacgggaaaaaaactgccatcagagtgaataggcaacctacagaatgggagaaaatttttgcaatctacccatctgacaaagggctaatatacagaatctacaaagaactcaaacaaatttacaagaaaaaaaacaaacaaacccatcaaaaagtgggcaaaggatatgaacagacacttcttaaaagaagatatctatgcagccaacagagacatgaaaaaaagctcatcatcactggtcatcagagaaatgcaaatcaaaaccacaatgagataccatctcacgccagttagaatggcagtcattaaaatgtcaggaaacaacagatgctggagaggatgtggagaaataggaatgcttttacatcgttggttggagtgtaaattagttcaaccattgtggaagacagtgtggtgattcctcaaggatccagaactagaattaccatttgacccagcaatcccattactgggtatatacccaaaggattataaatcatgctactataaagacacatgcacacatatgtttactgtggcactattcacaataccaaagacttggaaccaacccaaatgcccatcaatgatagactggattaagaaaaacgtggcacatatacaccatggaatactatgcagccataaaaaggatgagtgcatgtcctttgcagggacatggataaagctggaaaccatcattctcagcaaactatcacaaggacagaaaaccaaacaccgcatgttctcattcataggtgggaaatgaacaatgagatcacttgaacacagggcggggaacatcacacagtggggtctgttgggggtggtggactgggggagggatagcattaggagaaatacctaatataaatgatgagttgatgggtgcagcaaaccaacatgatacatgcatacctatgtaacaaacctgcatgttgtgcacatgtaccctagaacttaaagtataataataataataataataataataataataataataaaacagagacagagagagcaaatttgggtggctaacactttaaggtttataattattttattaactttttattactacaaacataataaattggttaaaaatggcagactaagcacatgttcagcttctctcacctgcccaaaatccaagaatgaattttttttcaaaaatgtataacatgcgtgaagacaaagcaagaatggccttggtggatcagaaacaaacagttcctaaaaatccaaaggcggatgtgaccagacagaatgaggaacatgcaggacacagctgctgtaaaggtgaaaacagcattatatccacatacaggatgtatcccagaaattaaaagacgtattaatattaacattattttcatgaaaaatatgaaaaaggagacatgaacaagactcctgcatatccctgctacttttcaacattgcaaaaaaggtcctaaacaatgtaataaaatgagaaaaagagaaaagatataggaataggcatgaatgaaaataaaactgtcaacattcccagatatgacagtctacctagaaaattcaagagaatcaattgacaagctattaaaaccaagaagagagcttaatacatggtcagatacaataacatcatataaaaaactactgctttgtgtagcaccagcaataatcaatcagaattattccattttgcataatttctttttttcactaaaaaatgtacagacacagttgaaactccttgtgcacttcttccccattccattaaattctatctatttgcacaaccactgtcttgcgtttggagtttttctttctcatgcatgctttttatatgtcactatatgtgtgtgtacttaaaaatctatagtaatatatattgtttgaaattatttcaaaataaaaggtaaaaatatatataattttgcaaattgaaaagttatatacaaatggtattagattttatatataatatatagctctctcatgcaacttcattttaccctttaatatctttagacttctccaactggtatttgtacatgtatatgacattctatctggagtcaatatgaatgtatacatttttgaaatatattgtttatttcatttccagaaatacttatatgatagatagaaaacgcatctcaaaggatatataggttaaaggatatataggttaaagacaaatatcacaatggaagtacaaagcagtcagtctggaaaaaattggaaataatctcaatgtccatcaaatagaagaaggttaaataaagtatgttacatctataacatagaaaataattttacagtatgtaaaaataatttagtggatctatatgcactgacatggaaagattttcaggacataaaagaaaatataaaacaatatgactcatgttgtaaagttgtgtatttttaatcacatatatagaaatgtattttagaaaaacagaaaactaataacattggatgcctttgagtaagtgaataggtttgagggaagtgaaaaaagatggttttactgtctattgttagttttttaaaaataagaatatgttttatattttttagtagaaaaaattgatgatccatagaaatacaaatactagaccccaaaagagtagtcaagaatagaccaagcacctctacgcaaataaactagaaaatctagaagaaatggataaattcccggacacatacactctcccaagactaaaccaggaagaagttgaatctctgaatagaccaataacaggagctgaaattgtggcaataatcaatagcttaccaatcaaaaagagtccaggaccagatggattcacagccgaattctaccagaggtacaaggagaaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccacaatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacctttcatgctaaaaactctcaataaattaggtattgatgggacgtatttcaaaataataagagctatctatgacaaacccacagccaatatcatactgaatgggcaaacactggaagcattccctttgaaaactggcacaagacagggatgccctctctcaccactcctattcaacgtagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgcacaaaaatcacaagcattcttatacaccaacaacagacaaacagagagccaaatcatgagtgaactcccattcacaattgcttcaaagagaataaaatacctaggaatccaacttacaagggacgtgaaggacctcttcaaggagaactacaaaccactgctcaaggaaataaaagaggatacaaacaaatggaagaacattccatgctcatgggtaggaagaatcaatatcgtgaaaacggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaacaaaacagcatggtactggtaccaaaacagagatatagaccaatggaacagaacagagccctcagaaataacgctgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatttctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaactactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagatatcatctcacactagttagaatggcaatcattaaaaagtcaggaaacaggtgctggagaggatgtggagaaataggaacacttttacactgtcggtgggactgtaaactagttcaaccattgtggaagtcagtgtggctattcctcagggatctagaactggaaataccatttgacccagccatcccattactgagtatatacccaaaggactagaaatcatgctgctataaagacacatgcacgcatatgtttattgcggcattattcacaaagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccacatattctcactcataggtgggaactgaacaatgagatcacatggacacaggaaggggaatatcacactctggggactgttgtggggtggggggaagggggagggatagcatcgggagacatacctaatgctagatgacgagttagtgggtgcagcacaccagcatggcacatgtatgcatatgtaactaacctgcacaatgtgcacatgtaccctaaaacttaaaggataataaaaatatatatatatatatatataaaaaaaaaaaaaagaatagaccaagaaccagccgggcacagtggcttatgcctgtaatcccagcactttgggaggccgaggcgggtggatcacttgaggtcaggagtttgagaccagcctggccaacatggtgaaaccctgtctctactaaaaataccaaaaaattagccaggcatggtggcgcatgcctgtagtcccagctactcggcaggctgaggcacgaaaatcatttgaacccaggagccggaggttacagtgagccaagatcgcaccactgcactccagcctgggagacagagtgagactccatctcaaaaaaaaaaaagaatagacaaagaaccaactcccagggcatgcaatacagtaagagctgcactatattatacacttattaaatggttataattggtatccttatgacctaaaactgtcactgaagtttcctttttaatctatgcttttctgtatatttgtttaattgtaatacaggaaagcaagacaaatagttgtaatgaacatacttactgacagatctgaaagttttgggtcggagaagacaaccacgaaaattcaaacgcagcacatttaaacgccacctttgcaaagtagacactatatatttatctggaatcacatttttcactgaggaaaaatcaatctaaaaagaataaacaaaatgcattaagaaatgagaaagtccccaaaaacaattgcaacaaaaacaataatagacaaatgtgacctaattaaactaaagagcttctgtacagcaaaagaaactatcaatagagaagacagacaacctatagaatgagagagatatttgcaaactatgcatccaacaaaagcctaatatccagaatctataggaaacttaaatcaacaagcaaaaacaaccccataaaaataggcgaagaacatgaacagatacttctcaaaagaagaaatacaagtggccaagaaatagatgagaaaatgatccacatcattatcagataaatgcaaattgaaaccacaatgaggtcgggcacggtggctcatgcctgtaatcccagcaccttgggaggccaaagcgggcggatcacttgaggctgcgagttcaagaccagcctagccaacatggcaaaaccccgtctctactagaaatacaaaaattagccaggcgtggtgacacacgcctgtagacccagctacttgggaggctgaggcatgagaattgcctgaacctgagaggtggaggttgcagtgagctgagattgtgccactgcactccagcctaggtgacagagcaaaactccaactcaaaaaaaaaataaataaatagatagagctaaggaaatttgggggcaaaaggtactccataactccacacaattttgtgactatatatatatatatttttttttttttttccagactgagtctctctctgttgtccaggctgcagtgcagtggcacgatcttggctcactgcaacctctgcctcctgggttcaagtgattctcctgcctcagcctcccaagtagctggaattataggcacctgccaccatgcccggctaatttttgtatttttagtagagacgaggtttcaccattttggccaggctggtctcaaactcctgacctcaaatgatccacctgcttcagcttcccaaagtgctgggattacaggcatgagccaccatgcctggccacttttgtgattataaatgtaatccaacctttgccttaacaattctacttctaagaatttattctgccgatgtaatcatacatgtatacaatgcaacactgagaaacaggatattcaccacaggattttattaacgaaagataggaaacaacctaaatgtctttcgataggagacagattaaataaattgagtgacttccatacaacagaccactggacaaaagctgaattcagggcaaaaaagcacaactcagaaagagaaaatctaaagcaatagagtccaagtatgctgctctctgattggctgattcaattcagggacaaaatgcacagtatctagaggacttactggacccgaacccttcatgaacattactcgttaatgccaagcattttatgagagttgggactcagggctcaaagttatatcattgtaaaagaaccttaagaggagaaattctatgctgctagttaggggaaaggcaaatggcagacctggcattctcttataaatagttgataattaagagcacacactttgtagtctgacaaatcagaatttgaatcccatcctagccatttaaccatgttggctatgacttaactaaggcttagttttttttcatctgtaaaatgggaaaaataacagtgcctaactcaggaggctgcagagacaaactgagaaaatgcaaataaagtacttagtgtagcatctggcatataagaaagcattcaataaatattagctactattattacttcaaaaatacatgacaaagcacacaaaatatggagtacataaattttaaaaagcatggaataggactaaaatacacaacacataagtcatatttgacagtgtgtctgcatgcatgcagaaacacatacactctggcaatttctaatatgaaatcctaggctggcgcttatgtactatttttgccacagtactattttttaacctgaaacatgtttgtgtttctcattccaaagagacattggggagaggactcagccaacaataaaaaataagcaaataagcatacgtcccccaacaacttctcttatctgtttcttgtaagatactttaatatcaacaaacgtggtcatttatgccatcaaccaatgttcagtggcaacattttccgtgttgtctaaagtccagtcaatagctgacttcacgacccctccttattgctaatgattgaaggactgatgatatcacgtgctcagactgacctatgaatagggggactggtgccattttgtagaagctctaaaacttaactcaaagaaattaaaaggagttgagaaggtttcaggggctctagcttcataagttaactcaacatctttacgtcgcatctggacaacatcccattcttggttgcactactctcactctgtgcaacaatggcaagaagagaactgatttcatcttaccaaacctatcttagctaacaaattaggtgttcctgtcttaattttatttttggtttaatgcagtgattctcgaactttagcctgcatcagaatcatctaggtgggttgttaaaacagattactgtttactaccctaagagtttctgactcagtaggtctgggatggggcctaagaatttgcatttccaacaaggtattgggtgatgctgatactactggttccaggaccacactttgagaaccactggcttaaagtaataaatctctaaattatgttacagatatttggggatgttgctttttcctttggaaaacctacaaagaagaaaaaaatgaatccaaatggtctggaggagaaagaatatatacaatatttagataatgaaatgtcttgcagaagctggcaggagttagaaaaagccaacacgtctgcccagagatctcactagataaagaccaagagcattacaagcacatggcagtgaggaacgaagccagggtaggaagttacactgctttatgttcagcaaatttctctttccacaattgtatgttgctccatcctcctatttctgcttttgtgagtgttcacatgtggcacaattataatcagcatttttagcacaaacaataactttattcagaaggcaatgagaaattgcctgttcacaggaaattgcatgttcacaaatgtaaacttttagctgacagtattagcaatattatttatcaatcagccctggccactccaaaaacctctgctcttgtcaattttgcataccatcacccaggtacactaaggtcatccttgtaatcctgttttggtttttttgttttttttttgagatggagtctcactctgtcaccaagctggagtgcggtggtgtgatcttggctcattgcaacctccacctcccgggttcaagcgattctcctgcctcagcctcccgagtagctgggactacaggcgcacgctaccatgcccagctaacttttgtatttttagtagagatggcgttggccaggatggtcttgatctcttgatcttgtgatctgcctgcctcggcctcccagagtgcttggattataggcgtgagctactgcacccagccaatcctctctttcttttttttttttttttgaatgatacagagtcttgctctgttgcctaggctggagtgcagtggcacggtctcagctcactgcaacctccacctcccaggctcaagcaattctcctgactcagcctcctgagtaactgggattacaggcacctgccaccatgcctagctaatttttgtatttttagtagagacagggtttcaccatgttggccaggctgttctcaaactcctgacctcaggtgatctgcccaccttgaccttccaaagtgctgggattacaggcatgagccactgtgcccagcataatcctctctttttagtggaattaactcttccaaaaattatgagttatgaaaaggccattgcacacctcacaccctaaacatctttcccatggtcatggacttaacatatagtctatgctcatgaaaaggaagtagggacactgtaataaaaccagaatggagtacaaactatccaataaaatggagctttgtttcaatccaaaaatgatattcatttatatctaccatttacatttaaaaatactaatgatgtatctcttaaaatagcattattatcttttttatctcttcccccaggcttgtgcctggacaaaagaaaaccaaattcacttgctgctggtgaccacagagcatggaagaaggtgtccccacaacagctggcttcacagcagtccattctcctttaagaactagtgtaaagacatagttcagttagtatctacttacagcattccacagtgagtttagttgtgtcatcaacatccaggcatgattaacttgaccacatattatcacatcttttaaactgaggtagaagaaaatctaaacacaaagaaaaatacacaactttgaaaaatgtgaactttgatgtaacttgtccacttaccttttgtctgtgtgtgtgcacacatgtgcgtgcacacacacacgcattagtaataataaggtaatccatactttgcaaatagcaagagtttaagtgctagaattttatctgaagataggagttttatctaaagtactggaacttacctgctgactccttttatataatgtaatccttttaattgatagtggcagaaggatggtgagaaagataagcatatttgctttattttttgaatgaagatagaattctgctagaaaactaatgatttccataaatagtcattggtacatagaaggcaatcaatactgtctgctgaactaaactacattccttctaaagatataggattcctcagagaagaaaaaaaaggatttctgggaaagagcaataaacacattttggcttctacttctggaaatgtggtagaccaaaaaatcaggaaatcctgctggtacaaaacatcagtaaatgctaaaagaaacattttttaaaaacataattcagttgtcaagaaagtaaaacaaatatgcaaggacccaatccttataaacccagactgataataaggtgcttcatgctatagttgcttgggagggaggaacaataaagatggttgctgcttttcataataaaatgggttcagattttactggccatgcagagacataagaaagtcaccaggcctgtacaaagctggtacagtcatgctctgcataatgatatttcagtcaatgatgggatgcatgtatgacagcagtcccataagattataatggagctgaaaaatttctattgtctagtgacatcatagccattgtaatatcatagcacaagtacttaatttttaaataaatttagtgtaacctaagtgtacactgtttatagtgtagtactctatctgtagttgtgtacagtaatatcctaggccttcacattcactcaacactcactcactgactcattcagagcaacttctagtcctccattgataagtgccctatataggtgtgccaattttaatttttttaccatatttttactgtacattttctatgtttaaatatatacttatcattgtgctacaattacctacaatatttagtacagtaacatgctgtacaggcctgtagtctaggagtaataggctataccatacaacccaagtgtgtactggattataccatctaggtttgtgtagcactctatgatgttcacacaatgacaaaaatcacctaatgacacacttctcaaaaggtatccccatcattaagcaatgcgtgactgtaattgaaactgagtcagaaaaaaaaaagaaaagagagagagagagaaatccaggattatgaaacagaaagaaatcacgcctgtaatcccagcactttggaaggtcgaggcaggtggattgcttgaggtcaggagttcaagaccagcctggccaacatggtgaaaccctgtctctactaaaaatacaaaaattattgcacacgtctgtaatcccagctactcgggaggctgaggcaggagaactgcttgaacccaggaggtggaggttgcagtgagctgagattggaccactgcactccagcctgggcaatagagcaagactctgtccaaaaaggggaagggaaaggaaagggaggagaggggaggggaggggaggggaggggagggaaaagaaaagaaaagaaaaggaaagaaaagaaaaaagaaaagaaaagaaaagaaatcaaccatactggcaaaagaaaaactaaggtatctagcctggtatcaaaaagatctctcgccaggcacagtggctcacacctataattccagcactttaggaggctgaggtgggaggcttgcttgagcccaggagttcaagactagcctgggcaacatagtgaaaccccatttcaactaaaaatttaaaaattagtcatatatggtggtgcacacctatagtcctagctactctagaggctgagacgggagaattgtttgagcctgggaggctgcggctgcagtaagccatggtcatgcgactgcactccagcctgggcaacagagcaagactctgtctcaaaaaataaaataaaataaaatctctcaaagaatttgtaaccatattgaccatttttggtttgggttaaacagaaataataataaattcattttttttaaaaaaatgaatgaaaagaaaaaaagagtttgtaaccaaaggccagcgattatgtgtgttgggatttaaatttcatcatgcctgggatccaatttgaatttgttacctttgtaaatggatttgatatattaatgtgcaaagaggttccactggtaataactctgggacatttggcagaaataaatatcattctctctaaagagacagacacagtcaagccaggccttacaggatacccatggattaagccctccaaaaacaagctcccaatcaaaaactgcaaaacacacgaggaaaaggaagtccaacaagattcaaaagaaacctttaaagtgatgaagacataaaaagaaaaataaaactcttgagacaaatgttgtcaaaacaggactgggaagatctgtaaaagaaccaaataaaatcatgaaaattaaaaatatagttattgaaatttaaaactcagtgggtgagttaaatagcagatgcgactcagctaagaagagaatcaacaaatgaatatgtacctgaagaaattacacaggataaaatgtagagaaataaagagatgaaaaatataaaggatgctaagagacacattacataacatgaaaaggtccaacacacatctttacagaatttccaggagggaataaagagaataaaatcaaagcaaaatttaaaaataccacagactaaaatgttttagaactgatgaaaggcaacacttttcagattcaaaaagcacaggaagttccaagcaggaaaatgaaaatatatcaatggcattataagtgaaactgcaaaaggccaaagcacaggaaaatttttcaggcaatttgacacagattacgtacaaaagactgtcacgtagacagaacaacataaggtggaagtcagcagaaactatcaatctgagataccatatgcaagtaaattacaactcaaaaatgagtattaagacatttttggctgagtgcagtggctcacacctgtaatcccagcactttgggaggctgaggcaggcagatcacctaaggttgggcgttcgagaccagcctgaccaagatgaagaaaccccctctctactaaaaacacaaaattagccaggcgtggtggcacatgcctgtaatcccagctacttgggaggctgaggcaggagaatcgcttgaacccgggcggaggtggcggtgagccaagattgtgccattgcactccagcctaggcaataagagcgaaactccgtctcaaaaaaaaaaaaaaaaagacattttttgccaggcatggtagtacacctgtagtcccagctacttgagaggctgaggcaagattacctgagcccaagaattgaaggccagcctgggtaacatagcaagactctgtctctaaaaaatttaaggccaggcacagtggctcatgcccgtaatcccagcactttggaaagccaaggtgggcggatcacctgaggtcagaagttcgagaccagcctggccaacatggcaaaaccccatctctactaaaaatacaaaaattagctgggtgtggtggcatgcacctgtaatcccagctacttgggaggctaaggcaggaaaatcgcttgaaccagggaggcagaggttgcagtgagccaagattgtgccactgcattccagcctgggagacagagtgagagtccatctcaaaaaaaaaaaaaaaaatttaaagacactttgagacatagactgagagtttgcttccaatggacccttcacaaaggaacttctaaagaacactgaaatcagaagaaaggcatgaaatgcaaataataacaatgggcaaaaaatctaataagtatatgggtaaagccattaactttataaaacagtatcatgatgaaaacgtgggggtagaacaataagatggaacaaaaacactagataataataacactctaacaccagagagagtaatcaagagttagtgttctaaatttcaattattcttcaagaagaaagtataaatattaatttactttaggccttattaataaatgtacacattaaaaatatttgagtaaccagtaaaatagtagaaatagaatggttatcttctacaacatgttaaaaatatttaagagtaaccagtaaaatcatagaaatagaatgtatatcatctaaaacatgaaagtagaaaaaagggggtagatttaaatactcaataaatagtacactacttggtaatgggtgcgctaaaatctgacttcaccactataccattcatcaatgtaaccaaaaaccacatctatcccagaagctattgaaattactttaaacgtttttattttttaaaaattcaataaagtcaggaaaggggaaaaataaaacatataaaaagataataaataataaataaaaagataataaatagtataaaatgaaattagaaaaatgaacccaagtatatcaataatcataataaatttaacaaaatgtattggttagaagacaaaaattttttattcctaaaaatgctttttgctttaatgtttttcccccaatattaatgtagctatctattttcttttcttagttttatttttaattgacaaataataattaaaatgcatttatggttaaaatgtgatgttttgatttatgtttataatgtggaatgattaaatcaggttaataattaagaaatcaccacctcacataattatcatttttgtgtgtgaagaaaacatttaaaatctacactttcaggcacggaaagacaaattctccatgatttcacttctatgtgaaattttaaaatgttggacttacggaagtaacgagtaaaatgatggttatcagccttcctttcatttgtgttcattttgtttttgaaagattctccccaacgcccgaaagcttgaaggaatgagtaactcctctcttctcaggcccagtcccaaggcacaaggccacttgtaccagcagcgtgagtcagcaagatagcagaagcaggaagagagccggccagaagacacctaccctggccggaagacacgtacccctgaagatcgagaaacaggccatctgggtaccacatagcagttacatcagactgggacaattcctgtttacggaagactataaaaccctgccccctactcatttggtgctgacgccattttaggccttagcctgcctgcacccaggcgctcattaaaacagcaggttgctccacactgcctcgtgttgtctgttggcacactctcaagagtttgaacggatacaagaatctttcatctggtgccgaaacccgggaggggctccggtcttcgtcccccgtggacctacccctccgccccagaaagcaggccacagcagccggacaaaggaagctcctcagcctccagttgcttctctgtgcatgcacatcagtcactgatctcacctactggtaagtttcccgggagcccggttaacaaggaaaaatccatacagcctctcttggtttctccagtctgaaaatccaacattggtccaagaaggctccgacgtgtgccaggtacttgctgatcatctggtcttagggggacgcctctaagccatttgatcccgttccgggaacgaaaaaggcagcggtgacgatcgctcctttcatcgtctccctccaccatccaggatggtctcctttttccctgttttcccgagcctaccctcagttatgggaaactccccatcctcaattccaaaaaacagccctctaggctgcctcataaaaaacctgtaaacctggccaggtgcggtggctcatgcctgtaatcctagcactttgcgagggtgaggtgggcggatcaccaggtcaggaggtcaagactatcctggctaacacggtgaaaccctggctctactaaaaatacaaaaaattagccgggcatggtggcaggcacctgtagtcccagctactcaggaggctgaagcaggagaatggtgtgaacccgggaggcagagcttgcagtgagccaagatcacaccactgcactccagcctgggcgacagagtgagagtccgtaaaacaaacaaacaaacaaaaacctgcaaaccttaggcctcaggcaagatatccatcctccttgtctttttttgcaattcagactggccacaatacgaattgaataatgggtcctaatggcccgcaaatagaacattcgactttacaattttaactgatttaagcaattattgctgacgactggagaaatggggaaaaactccttatgtccagccctgtttgcactcagatcacaacccgacctctgtaattcttgctcacctgttcaaatcctcctctattctcgccacccagatcacctttctcctcccaactcgacatattttcctcgttagatccagcagactgctgtccattcctctcagcccctgcctctccctctcagccgtcttctttaaccccctaagcctcctctttatcttctcagctgcgatcttctcagccttcatcttcccagtcgccatcttcccagcccccatcttcccaagcagcagtatccacttcttttcctacactgtcctctcctcaggacaattctagcattgtctgtactcattactcattctccttcctcactgccctctcctgaagcctgtaaacccatcccaccaccttacgcccctatctatcctccactgcctatcaacttaaccctccttcccccttcaaaccctcagcaggaaccactttcaggttcttccttctctcccacccatactcgctcaggcaccatctttggcccatgccccacccttagttcagcccctgtgctagagagcccccttcagaaagtagcaggaactggaggcattgttaaagtttatgttcccctctccctcagtgatctctctcaaattaacaaaagactcagttcatttccagaagaccctacctcttacattagagagtttcagtacctcacccagtcttatgaactaacttggcatgacctctacattatcctctcttccaccctcaccccagaagactggggctgtatctggaccctaactcaggtacatgctgatacaattcatcaccaagctcctgctcagcctactggtgcaaaggcagtccccaaccaggacccccactgggattatcaagatggggcctctggacgctgctgtcgagaccacatgattgtgtgcctccttgcaggactcaaaaaggctgcccataaagtggtaaactatgaaaaactttcagaaatcacccaaggtcctaacgaaaacccagccctttttatctctcgtttaactgaagccatgagaaaatataccaacctagacctagccagtccagaaggaaccgatattttaaaccttcagttcatctcccaatccacccccaatattcagcgccagcttcaaaaacttgacaacagccctcaaaccccacaacgagactttcttaatttagccttcaaagtctttaacaatcgtgatgaggaaagtaaaaggcaaaaacaggcagggtttcaaatgcttgcctcctccatcaggggccctgcaggccatggggccacagctccacacagaagcctcctagcaatccacctccacctggtgcctgcttcaagtgcggcaatgaaggccactggcccacacaatgcccaaacccaggtaaacccacgaggccatgccccctctgcggaggaccccactggaagttggactgtgagcggcccctgcaaggaccacccccatcccttcctgagccaatcaaaccctcctactcggatctcgtcagccttgccgctgaagactgatagtgccttggaacagacaccccagcaactaccatcgcttcatctgagccaagggtaaccctgatggtggcaggtaggccagtatgtttttaaaattaataccagggcaacctattctgctttccctaatttttcaggacccacccagtcctcccaagtctctattgtggaaattgatgaacaagcctccaaaccctgagccccccgctccacttttctgctccctgcacaccttttccttcactcactctttcttagtcctgccctcatgcccaactccgctccaaggcatcctttcaaaactccacactgctctccacttccacgttccccataatacccaacgcatcaacccaaacccctctggggcttctttcttctattccaacctcccaccttaaaacatgcaacctttccttatcccccatctgtagttagcccccctgtttggggtaattccacaccctcagtcgcaaaacaccacactcccgtccgtccacattacccttaaagagcccacccagttcctatcacagaagcagtatcccatcccccaagcagctctcacaggcctaacgcctatcatttctcacctcctcgccagtcacctactccgcccaacatactccccttttaacacaccaattctacctgttaaaaaaccagatggaacttatcgcttagtccaggacctcaggcttattaaccaagctgtactcccagtatgtccagtagctcctaacccatatactttactttctgcagttccctccaataccacccatttttctgttctagacctaaaggatgcttttttcacaattccattacaccctgattcccaaaacctctttgcctttacatgggaaaaccccaacacccatggagtccctgtgtatgatcacttaaacagagaaaaacgatccttaaaggtaggaggaagccaaagacggcaagaggacgagtggcccctgcaatggatcatcgaatattatggtcctgccacttgggcggaggatggttcatggggttatcgcactcccatatatatgctaaatagaataattaaggctacaggctgttctagagataatcactaaccaaaccgcctccgtcctggaaatgctcgcacaacgacaaaaacaaatgtgcgtggcaatttatcaaaacaggctagcactagactacttattagcagaagagggtggagtctgtggtaactttaatgtctccaattgttgtcttaacatagacaataatggaaaagcagttctagaaatcgcttcaaacatcagaaaagtagcccatgtaccagtccaaacctggaaaggatgggacctggcaaaccttctaggaggatgtttctctaatttagaaggatttaaaatgctgataaggacagtaatcttcatcattgggctcctcctttttctcccgtgttatcccactgataataaaagccattaaaactcttgttgaagctacagttaactatgtttattgtggcactattcacaatagcaaagacttggaaccaacccaaatgtccaacaatgatagactggattaagaaaatgtggcacatatgcaccatggaatactatgcagccataaaaaatgatgagttcatgtcctttgtagggacatggatgaagctggaaaccatcattctcagcaaactatcgcaaggacaaaaaccaaacactgcatattctcactcataggtgggaattgaacaatgagaacacatggacacaggaaggggaacatcacacaccggggcctgttgtggggtggggggagaggggacggatagcattaggagatatacctaatgttaaatgacgaattaatgggtgcggcacaccaacatggcacatgtggcacatgtatacatatgtaactaacctgcacgttgtgcacatgtaccctaaaacttaaagtataataataaaagaaaaagaaactacaattaactgccagacaatccagacaatgctcctgctacaatgacaagatggatactaacctgtctctcaagaataccaaaaaaattaaggttttctttttccaaggtgcccacgccaccccctatgtcatgcctaaagtagttattgagaaagtcaccctttttcccttttttctataaccaaatagaaaggaatgaaggattctccccagggcctgaaagcttgaaggaatgaataactcctcccttctcaggcccagtcccaaggcgcaaggccacttgtgccagcagtgtgagtcagcaagatagcagaagcaggaagagagccggccagaagacacctactctgactgggagacacgtacccctgaagattgagaaagaggccatccaggtaccacatagcagttacatcagactgggacatttcctgtttacaggagactataaaacccctgccccctactcatttggtgctgacgccattttaggcctcagcctgcctgcacccaggtactcattaaaacagcgtgttgctccacactgcctcgtgttgtctgttggcacactctcggggtttgaactgatacaagaatccttcagttttgtattgtattttagttggatttttaaagtttatctcacaaagagggtgactacataataattaaaggtagcaattcactagagattatagcaatcctaactatgcaagcatctaataacaaagccacaaagtgacaaggagaatctgacaaatccacaatcataatgaaagataatatcaaaacgatctcaatacttgatagatcaatgcaaggaaataagtcttcgatttctcagtgctcctgtaaaaagcactagcctccagaggcatggaaatctacatgatataaagataggtaattttacccttcacttactttacaaacattttactttccacctactattgaaattagatctgtagttattcgtagacaaatagttatttgtctgacaaacagttaattgctctgatccaaaagaataataaaacttctcttacctccccaagaaagtcaaatggtcacagcctggattagtcaagattccaaggtgtcaggaagatccctaatttacatttcaagaagaaatgggtcccaggaccttggagacatgtctaggtcataaaagctggagatgctagggcttacctggcccttggagagatgcattctaagaagtcttgcctctctcttttacttataaatacctttgtgattttattagatccacccagataatccaggataatctccccatttcaaaattcttgatttaatcaaatctgagaagactcttttgtcacgtaaggtaacatactcacaggttctgaggactgggatatggacatctttgtagggggtggggtaatgttctacctaccatactatatgagggaataataaacactaaatttaagacagcaaatacctctgagggagaaaagagaatgcagtcatggaggctttaattgtatgttatgttttatttcttaaactgggtggtgagtgtacagttgctcattaaatttctttgcatgcctgaaatattttattgaataatctcactttttaataaaaatacttaggaataaatttaactaatttaactaaaaaggtgaaagactagcatactgaaaattacaaaacattgctgtaaaaaaatgtaaaaaggcctaaacaaatggaaagacatcccatgttcatggattggaagacataacaatgataacagaaattgaatcagaatttaaaatctgcctctgaataaacaccaaacaaacatgggccaagagttttataagaccattctatcaaatatccaaagaacagaccctacaaacaataaaaatactaagatgtcaatactatctaaagtgatctatagattcaatgtaatccctataaaaatttcaaaggctttttttgcaaaaatgaaaaatctgaccctcaaatttgcagtaagtgcaaggagtcacaagtagccaaaacaattttgaaaaagaacaaagttggaggactcacatttcctgatttgaaaacttactacaaagatatagtaatcaaaatatcaaggtacaggatagacatatagaccaatggaatagagctgagagaccagaaataaatccatacatcatggccaagtgattttcaacaagtgtggcaaaacattcaatggggggaaaaaagtcttttaaataaatgggactgggacaactgggtatccaaatgtaaaagaatgagtttggaccctctaccttacaccatatagcaaaatgaagtcaaaatgagataaatgacctaaatataagagctaaaaccagccgggtgcggtggcttacgcctgtaatcccagcactttgcgaggctgaggcaggcgaatcacgaggtcaggagattgagaccatcttggctaacatggtgaaaccccaggtctactaaaaatacaaagaattagccgggtgtggtggtgggcacctgcagtcccagctactcaggaggctgagtcaggagaatggtgtgaacctgggagccagagcttgcagtgagctgagatcgtgccactgcactccagcctgggcgacagagcgagactccatctcaaaaaaaaaaagagctaaaaccataaactcttatcaaaaaaatagggataaataaatcttcatgaccctgcgtttaacaaagaatatgacaccaaaagcatgagaaacaaaggaaaaaataaataagagttcatcaaaatgaaaaccttgtgtgtcaaagaacatgataaagaaagtaaagacttcactttttgcctgtatgtactgggagggcaagaaaaatgccagcaattaaatgagttgttgaaatggccaacaagccttggaaaggtattatgttggatcaggtggcctgaaagctgtacttgtagttttgtacctactgtacttgtaggatatttttgaagacagaggaactattgtaattagtcctatgttcagagaggtaaaagcaactagaaaagaaaagtggcagcacagaaaagtagtagaaatatagaatcaattttctgagcatacagagaaagaacaaatgacttgtttaaaagggtccattttaatgttcttcctttttatactggtaaatactttctagtccaagaaatctggctccgaatttcctaaaatttttacttatttgatctattcccctgtatgtacccatctcccattgcctgcacacctttcccccccttacccacctctttttctgacattgcacacaggccagtctctcatcccacagacttgttctcaaagaagacatactttctctagaagatagtatcctaaagagcattctcctattgtcttagtccatttgagctgctaaaactgagtactatagactgagtaacttataaacaagaggattttatttctcacagtgctagtggctggaggcctaagataaagtctccagcagattcagtgtctggtgagagcccacttcctggtttatacacagtcatttcactgtgtccacacatggcagtaggaccaaggagaatctgggatcccttttataagggcactaatcccattcatgagggctttgccctcatggcttaatcatttccaaagacgtcacctgcaaataccatcatattggggattaggttcaacgtctgagttttgcgggacataaacattcagtctatagcaactatgtttcccaaattccattaaaagccaaaatattattttgactatacaggtccaaatgggtctgtaatcccagcactctgtgaggctgaggggggcagatcacgaggtcaatgctgggttacagcccagcattcaaacactggatcccgggcacatatagatacactcttctttttcctccactgtggagtagcagtcccacttctccttgatagttagggtcaattactccacccaacacagtaattcccttcttcgcttgttgattcaggggcatgaggagttcatagtggttgggtggcagtcttaacttttagttcgatagaactatcattgtgcgtcctggtgtaaacattcctcctttttgaaccaaaacctctaggttagcagcataagcttatggaaacagaaagcaaaatttttgctagtaggttactaggggtaatagtgagtgtgccactcccatttccaacccttgattcctggacccaagaatcttgactatggaaggaagagtatcatatattggactgtgattcagagtatatacagattcctagagaactttgccccagccttgcaaggtactctcccatcgttggcactggaattgagtcttccaaaggccacttcaccattctgtcaaaccagctacttcagagtagtggtaaaaactacagtgtaactgtgttcactgtaaaaaccagtgaattccaggagcatggacccattgaggcatttcttttgctgtgaagttttataaatggaagttcctctgcacaagctctcttgcctgccaccatgtaagatgtccctttgctattctttcatttgcaaccatgattgtgaggcctccccagccatgtgtaactgtgagtccattaaacttctttcctttataaattacccacccagtcttgggtatgtctttattagcagcatgagaacagactaatacaagctttagagccctttctaactccttgtgccaaaatataaatgcagaatctctatttagagaactcatgtgaataaactcagcgtcttccaactttatcttctttctaccattatcccataccctcattatccatttccacatatttttcagatttcagtctgtataagttagaaaactcaagtagttttttttggagtgtagtgcactttctcatgggtcacattttgtcccacaccttcaaaggcctgctgggacttgagtctaattatgagactagaagcaaagaggggtggtaggggtgagttctaagaaaaatcaatattgtcttgcttggcaactgcctcagtggaggccattacaatttcctcatgcagtgtagcattaaccaccttctgaggtggagaagccactagcactgggagtgcggaggccacttccactagcagtaggattgcctcttccactagcaaagaagactcaccagaagttagaggctcaatgtcctcagtttcatcaaggtcttcccacaagtccccattccaacttatagaaacccattctggttttcttttttccccttttttttttttttttgagtggggtctcgttctgtcacccaggctggagtgcagtggtgtgatatcagctcacagaaaaccccacttcccaggttcaagcaattctcttgcctcagcctctggagtagctggttttataagtgcctaccacaatgcccagttaatttttgtatttttagtagagacggggtttcaccatgtcggccggggctggtcttaaactcctgacctcaagtgatctgcctgctttggcctcccaaagtgctaggattacaggcatgagccaccgcacccagcaagaaacccattctttcccagtcaacgccttcactttaacagagtataaaagtgggtcaccggatgagataagataactgtaaaactgggtcacaggatgagattctgcatttgattttcaggaatctcagccctgtggctaaaggagataagactctccctcagggcacatgtggaagctttcagtcatttatgcagtacttgagctggaaatttgaattcctgagctccttcttttctttcaatactttgttcgtgacattaggagcaacaagccaacctaattatattcatgtgatttccagaaatgtttgagagtatcatatgcacaatgatcagctccttgcttcttataagtggttgattgggaacatccaatggagatatttggcatatctctattgccagataacaccgtgaaacatcagtgctctttttagcactgaaaaaagagtcatttgcatctttaaatctgatcacattaaaaagccaattctaggaacctaaaaaccaattctaaaaactcatccttaaaattctgttcctatagaaccacccttggtaccaaaatctgtattagtctgggttctccagagaaaaagaaccaagaagatatatataactatctacctatctatttatctacctatctatccatccatccatccattagatatatattgagagagaaagataattacttaaaggaattggcttatgcaataatgaaggccaagaagtccaagaccttctgttggcaaactggagaccccagagagctggtggtatagttccagtacaaatctgagtccaaaggcaagagaagattgatgtcccagatcaaaggcagttcattcattcttggggcttatatgatgttttatttattataactacttaattgatatttttttaatgccgtactttcaataagaagggaaagaagataacaattgtatggagatagaaaggagatttatatttgttgtgcacttctgtgtgctaggaattttattttaattattagaagaaccctgctatgtgccaattattatcttaaagatgcgggaatctaactgcataccattttctagttctatctgggttagggttgctgccttaaataaaggatgcccaattaaatttgtatttctgataaagaacaaataaattttttgtattattatatgccacatattgcacaggacatacttacaccaaaaaataacaactttatcttaaattcaaatttaactgggcatcctttatttttatttgctagttctggcaaccctacccttgattggggtcctgcattgcttgtgctggtctctctctcctttatccctgaagacagaccttcattcctgacacctgatcacccagtctctgatcacctgcctgtcactaagatcaccatgtgttgatggcttcatacccacaccactgtgttgtacctatctgcaggattcccaccagtttagaattctttcatgctcaccacctggccagcatgcatctggtggaacccctggactacagtcaaattctctgtagaccatgtcctagcacatccagctatgtgacagtctgcacttcacactatccagaacccacaccaccctggtggctatgctcctgagtgagcttccaaccagcaaacaaaccattccacattccacacaataaaagatattgtgggaaggtacaaactgtggatagataactaaccaacaacccacagaggcatgttacaactcaggggcagcaggaagatccccagaaagggggagtagatgggatttgtgttcaatactttttttctacatagataaggctatattcatgtttatgaaatcagtgaattccatagagctggaagacatagctgactcactgaatattggaatcagaaccaaaatcaacaagatgaaattgaacaggaataacagaaactgttatgctaaggttgagattagcagtgacataaggcagaacatccagtcagcagttcacataaagacctcagagttttggttcaacacaagctcaaggatgggcattatcatgtaatgggggaaaaacaacatttagattcaaacaaacccaatctcaaatgctaatttcaccactacattgctatgacccaagtctttgtctcataaaatgggcatactcactcataaaatgggtgagtatgaacaagataacacatgttgagcatgtgtgaacagtgcctagaatgcatgggagatactcagtaatccacaccccacatccctggaacctggcacgatgccccccccccatcaatacatttagtaggagacatcatagcactttccaaataatctattgaaacattcatttttgcctgtcctctttatttaggatgccagaagaaatgggaagacattaaggtttatgtgctaatatttgagtcctttcatggcatttacatggcagagccaaaagcagaagttgacaaccatcagaagccaaaccagccccacaaaatacctagccttcaagagagaaattggaccaatctatgaaaaatgttgctggtgtgtggggatggggaggttggaaagttgctgagacttcgggaaggaatggaggctcatgacagatatttgtgccacattcccatgtagaccttcctaaaatgtggcaggccctctaatgggcaccatcagaaagccatggcaactgacgatcaaaagatctgccttgaggccatggtccctgtgcccaagctgggctcagaaatcatggagtctcccgccttcaagggactgtgtcgatttaggcagtgagcacagccacagccgcccgtgtggatgtggactgaagtccagttctcttcatgggtgcttggctgtgagacacctctaagactcttgcacaaccaagcagcaggggaagaaggatattagaattgaatgtgatgattgagatttaatttactggttaaatgggtggggacatgcagcagatgggccgattgtaaaggaataaatataacatttattttcatccaagtactagggagtattttttttgtatgctttgtcagagatcagttggttgtaactatttagcttcatttctgtttatcacaccataattcacaattgcaaagatatggaccaaactaagtgcccatcaattaatgagtagataaagaaaatgtgatacacacacacacacacacacacatatacacatacatacacacaccatagaatactaagccataaaaaaaaaatgtattttgcagcaatttggatggaactggaggccattattctaagtgaaataactcaggaagggaaaaccaaatactgtatgttctcacttgtaagtgggagctaagctatgggtattcaaaggtatacagagtggtataatagacactggagactctgaaagggagagggcgagagaggagtgaggaataaaaaaatagtatactatgtacactattcaggtgacaggtaccctaaaatttcagatttcaccagtatataattcatccatataaccagaaaccacttgtacacctaaagttattgaaatttaaaaattgtaaataaaaatcccacatatattagggagtataattcacactctctatgaagtaaaaagggcttatacagtaggccaaactcaaccctaccactgtgatttaacctaattccccaagcatcatttatttcattagcaaaacagaaaaaaaaaacatacctcacaaagatatggggaggattacatgagataactaatagcaaaaatccaagcacagttcttagggtagtgtggatgcattttatacgaatttgaatttggtggatttaaaatagtgaaataaaaacataagcctcactatatggcaaaacttgaaataatgtgaaatcccactttatatttattcctaaatgaaaacgcatcttgagtgggtatcatacactaatcactaatgggacgtggagaattttttttaaaaggagaagtccaggatgattcccacaattctaatttggatgacaagtgatgacaccatttaccaagaaagcccaggaatacagaggggtggggagtagtcccataagagaggtggggaagtaacggcttcaagctgaacacgctagggggtagatgctatgaaatattccagtggagttacccagcaggcattgttaaatgacctgggtcttacaagagagtgatggctggagatacacagatttggcaatcgtgagtaaacagcatataactataacctaaagcatgtatttgaaatcacccagggagtgaagatggaatgagaagaacagagaaacaatgacagagtccttacaaacaccatgatacaagaaggcaatggggatatgttatcctaaaggaatcctaaaagaagtgatcaaaaaggtgaacagaaaaccaagtgggagtactgtcactgaggatgagtttccagagagaattaatgctgaagaagctattgcaggtcagtggtcagtctagctagcactgcttcaatgaagggtaaagatatgctcaggaatgtccactttaaggggcggggatgatacttgcactggatgctgcactaatcagataacacttggaatatttttttccacctccagacactgctgagtatgaagaactaattggagaaggaagccgttgtatagcagatgcagagcagcagcaaaaatggtaatgaaaatagaagataaattagaaaatttggaaaaacccaaacagatcagccatattgaagggaaaaagaaaaacaaaacaaagtgggagggcagaaatgtagaacggtatacactcttttaaccccaaggatgaatgtagccaagaacacagtggggacttaggagtctcagcacagagcattctctactccctactgctcaggcaaagaactccttcatcatgcagaaccaaaactggtgtagagtcttaaatgacctgggtatctctacgcagaagaaagcgctttccatgtaaaaggattaacttgaacctgggtgctcaagggacaccctaggctgcttatcccactgattctgatctgactgtgttaagtaataaatcatgtggttacatattcacattatcttgtgtagttttctctcacattgctacttaaagagaaaccccagacacaataatgagggagctcagtataagggtatgaagagatccaggcaagctataacctggagagctccttgcccttcagaaggtgagaccactcagaatgagggagaaaacgtggcccagcccactttatgaggaagctacaaacagaattcttagaagacagcagccaagggagtagcagggatggggacagggagggctgagactagaaactcacagaggaacaaacaattgagtaaactggaaacaagtaaccacaaaagcactagaaaataaaatgaaagctttgcatgaataattgacaaatttgatcttccttgtgaatgcagaagaaggaactagaaacaaaagataatgaggccgctttctctgctttgatctgaaggacaactttctaattatctgatctttcccaagacagaacagaatgcatcgcaaagtcaacagactctccagcacagaaagtactagaccaaatgctggataaacattactgctaatggagacgtttcattgccttggcctcacatctctatctagaaacactttagaaacactctgggcctctctctctctacccctcatatcttcccaggagaagaggaggagtgtttgggagaaagaactaggcttgcaattcagctcctgctccaccctgccttgacctgaatgcaagatgcatgcatcctggtctgctctcagcagcatagggaggcctgcagttgttcagctgtgcagtgaccgaggggcgagtctatctgattcagggatgaaagaatgaagtagtatcctttgtcagtgatcttaagtcatagtctcctatcagctgtatcagaaaatatgtccacttccatctctctatttctcaattggttccaaactcagatacggaagagggtgccctctaaaacctcaagaacatctgtgaggaatattttcctgtaaaagaggttggatcacataactctaaaattgctgtatatgtagaattcagtgactcttacttttcagatacttctaggaccttctaacttaatgtctcattgacatttcaaattcactgaatccaaaattaagtttctctttccccaaaaccagttgactctcccgacattactgcacatcataagtagcactggcttcacattcatcaagatttaaaaggttaaagtttccaaataataggtaaattggaaatgtccttatcatgattccaaagcaatgccgacaccagagagtggtgggtgaaagcctagctgtgactgccatgacctagtaagaatgtagggcaaagagagagagccaaagccaacatctggaggtacagtcagaccagagccaacatctgggtgtgaggagagagcaagaaacctatcctgaggatagagaaataattcccagagaaaagaaacaggaaatgtcatgccacagaagcccagaatcaagtgctactgaaaaagcaagacaagaagggatcataggcaatcagatttgatgattaagaaattcctgggaccttgatgagaccaagtttgtaatagtggagctgaaaagaaaacatcatttttcattcgatcattcaaccaatatttattgggcatctacagattgtgaattcaaagcaggtaagacactgtccctgtcctcaaggcacatatagtccaagaagaaaacacaaaataggccattataagagagtaaaaagtatctcaagagggactctgggaacagagaggaagggtaactaaccaagactgagagagaggacagaggatcaaaggtagcctttctggaagagatgacatctgagctgagcctaagcaggactgagtagggcaaggaagaagaggagagagcctacaaagagagcacgtgatgggtgaaggcatatggccagagagggtgccttgaacttgggtaacatggagtaactccacatggctacagccaagggctcgtctggagcaatgatggagaatgcagctgagaggtagtggaggctagaactggaaatcctcatgcagcatgttaaagccaacagagttcaggagagattttaaccaggaagtgacatgaataaatgtgatctgagaaagacaactctggtggacaaatgaaaaataagtcaggtggtcaaagtcaacagtcaagagtagatgccagaagacaaattcagtagctttgaatttgatagtaatgtcactaatagacaatgagtgccagagagaatggagagaagaaagaaagtgaaattacatgctaaaaagaaaaaaatatgcagtagggggtaaaagagagaagtcaaagatatttccaaattctggccaagtcagctgagtagatgatagtgccattcattgagaaacaggatacaagagacagggttggacaggatatgggggaaaaggaaggttggaggaagaaaatgatgagttctgttttggtaatgatgaattggcttgtgcctttggaacacccaggtagagactgtttaaagcagtttttgagtgtcacagtgggcaggtgggaggtagtgtcaagaagtctgccaacacataacaggagaaaaatagaatacttagcagcattgagaaatgatttataggaaaggagtgagtcaaacacatttttagacatgaaggaataaatcaatagaaagaaagaaatttaagatcataggaccagggaaggcatgggaaagagcaagttggcagttctctcctgtttaatgttaccttgtagtgcaataaaaggagggctgtctttggaacataaaacacggactcttgagttaattgataaattgcttcaatgcaaatcacaagccacctgaaacagatggtaaactgctaaaataaattaggttccaccaaccattccaatggaacattgtatgatatggaaagaaaaatacttaacaagacaggaagcatgagtcaggaataagtggtgcgcagtgtgagtcatgcctgtaagatcaataaagaagctggctctgctcctgactgcattacttctgagcctcctacccctccagtcacccagtctcaatgctgccctatcaccctcctcactcattctttcactccagatactatgggtcccagaattctgttaatgctttggttctcacatgggtccttttttttaatttcccactgatactatcctaatgctcttagagaaatctgtctacctccagacttcatccaacccccttgacccacccaaggcagggggagggtgagggaagaacagtgaagggagaaaaagaacagctttataagtctgccatcatgttactggcttgcagtggtccctcactgcctactggttaaaacccatctcctaagtggatactcaaggcctcaacaacgcagacccaacccacctttccaaacacatcttgttactgtcaacttaaattctctatcatctcctttttacaaatgagacaatttagaaacagaaacattaagcagcatgcccagccacagctgtcacacagctagtgacagaagcggccacccagactccagggcacattctccccatttccatgtggctgcctcttactggggtatagttttttgtctttcatatgctagatcattttgcaagggtggtcctgctaaaattaatagaactgcttctgcaatttaaaagtcatgaaaactttagatcaaaatcacttgtaaactttttccctttttgggagggggatggggtctcactctgtcacccaggctggagtacagtggcacagtcacagctcactgcagcctcaacctctccagacttaagcaatcctcccacctcagcccatcgagtagctgggactacaagacatacgccagcacatctggctaatttttgtatttttcatagagacacagttttgccatgttgctcaggtttctctggaacttctggaccccagcgatccacctgcctgtgcctccaaaagtgctgggattacaggcatgagccaccacgcccagcctgtaaacactttaacagagacagcgattaagactaaagtgatgaaagtgaggtctatgggtagagcaatgttccaccaaaaatcaactgttcccaaagtgacttctagatgttttgtttcatttgctttttcacccacaccacaacttgagccaatatccacatacttccttgatagagcaatgtggttgtggaacctttccttatctgaagttcacacagtacacagctatgaaacctggaaccactgtctgcattggtgaaatgaggtcagactgacccctgaggttatcaaaacatagatctgaaaagtcactgggaatattcttttgttttacaagtaattctaagtaatttaatcaaacaggcctgaaccatctggctcttttacaacatggtactagttttaatagctatccatgtttcttttcttccccaagtgagaaaatgagtcatcaacacagtaaaatctgaaggtgattttataaccgtttgcaagtccacatgacatatatcttttacaaacaagaagtcatagttgtttaaaatgaagacaaccctaaagcaacacttacattattaaactaatcaagtaattttacattttaagaaactgcattacttaactattttagagtttccaaattcatcagcataaggcttttctctgtgttgcttgccaaactacacagaaggaaaaaaaaaaaccaaacttgtattttcacggaaaacagtctttgccaaccctcccactagctctaagtttggccaacagtttgactgatagtgtatgagccctaccatctgctaactaagcagcatttcctaacgggtaaatgatactaagaaaaatggttgcaaaacagaacctgacttgttttcatgagttgatgtaactgaacctaaaatgcaagactacagtttgttatgtgtattctaagaaagttcaaattgtatcccaatccaaattgctggtttcaattattccttcaaaacattaaacagcctgtatataaaaaacctcaatttatttaaaaaactaacacttctaaccattttaaataaggttcagaccaaattcacatcacatttttgttttcacacctttccttctcaagtccctgagttagtgaaccagattaaatgccatttaaaaagtatgatttaaaaaattaactttgcaaatctattatacattaataagcataacaaacccaaccattcaagatattagtcttagaataattaacttatatgtttatatgctattatataaatctactcttattacttgtgcatttttaatgaacattctgcacattatttggggaaattttgaggatatctataaaaataatactggcttttttttctgtcatatcaagatttagtaactttaaaaaagttacccttgtttttttaaggacaggacaactaaacagatgtataatattcttaattattgctttttgtctcatgaaatattaatatatattctatttctttagaattctccaagaggaaaaaaaaaagatatagaggctataagcttagccaaggacacagaaaaaccaggtcctgccctcagttttgtagttgtctgactttggggatgtgaaaaaagttatctgaaaaggaatttcgagaagagagactttattccagtgaacagtttccaaacggggaagacaaacccttcagtggaaacaaaagatacattaaagaaaaaaggagggtttcgcttttatagttaaaattcccacccagctttccactcaggtcctcttatgcaaatacagaattcaaactggcttagttctgattggttgacacttgcagagttctgattggtcaatgctgctggcttctgattggtcagtgcaggctacactctattggttggttcaggccacgtggacagaaactgttagctatgacaaccccaaagttaagcagatgtgtaggttttctgggaactcagagtatgtgtgtgagctctagtcagcaaatggccacctgactctattttaaatttcagcccagttaggtactcaaaactcatcttgagagattggctctttcagattcgcacataaaatttctcagatccacagctgtccctcttgtaaaaggtaaaagcttagcacaaacatctctaagctgtcttctagcttgatcatgctatggtttgagcactctggtagactttataaatctgggccccaaagggctctactttatttcccatgagcatgggggaagctggggtgagagaaggcattaaaagcatagtcagccaggcacggtggcccacgcctgtaatcccagcactttgggaggccaaggcgggcagatcacgaggtcaggagatcgagaccattatggctaacatggtgaaaccccatctctactaaaaatacaaaaaattagctgggcgtggtggtgggtgcctgtagtcccaactactcgggaggctgaggcaggagaatggcgtgaactcgggaggcggagcttgcagtgagctgagatcgcaccactgcactccagcctggatgacagcgagactccatctcaaaaaaaaaaaaaaaaaaaaaaaaaataggccgggcacagtggctcacgcctgtaatcccagcactttgggaggcggaggcagacggatcacaaggtcaagaaattgagaccaacctggccaacatggtgaaacactgtctctactaagaatacaaaaattagccaggcgtggtggtgtgcacctgtagttccagctacttgggagtctgaggcaggagaatcgcttgatcccgggacgtggaggttgcagtgagctgagatggcgccactgcactccagcctggtgacagagcaagactctgtctaaataaataaataaataaataaataaataaataaaggcatagtcataaaccataacaccatacagaaagtaatctttaaaatgcaaaaactggcaatgatttctactgtcctgagcaacattccccaattattctacacatttcccatattctgaaatggttttcccaaagtgaacctaaaacttagattattccaaactctttgctattagtttagggtttggtgggaaaatgggggtgaggtagttttaaagatcaaaggccaagagggctgaaattgctcaaggtcatattgctagtaaacagttgagactggatttaaacccagttctccctgagtcctgagcctggacttttaatcaatatattgtcaaactaaaagattgctgttgagaaaatatgtaagttcatagtttgtcataatggttgctgtttccatatacaagcttttctaggccctggatcccattatgaaatgatttgctagactgtgggtgctgtggttcttcagtagttggcttttttgttctctgaattgttcaccacaggggtctgggataggaaagagcattagaccagagttcatttgcagcactgatataatgacttattaaacacttgcttacttcttatctgctgtgattgttcctttgttgttgttttgcctttttactgcaacctaaacaacatcttttctggcaaggaaaaatgcccttttagatactgatgactggtagttcaaatccacattcagtgagacagactatactgattaactcactcaaactccacccaaagtcctctcctccccagcagtttaacaaggccttgtgacaaagttctaacctaaaacacatcaatgaaattcctgactgtgggaatttggggaaactttggatttcctcataaacaaatcaacaaacatcttgcctttaccactgtgctttttcccctctctggcctggtaaaagaacatgaggctggaggtggagtagacatattgcaatcataagacaagcaagaagatcctaaggactgtggactaacaagatagaaagacttcatttttattggtattgtggatgactggccttggactgcttttctctgcacattgtgtaatatgaaacaaatagcccttatttctttaagtcttaccattggttatattttattatattgatagttgaagacagtgctcactgatatatttgagaattactagaccgagagatccataaaaagaaagatgatgtgttcataaaaaacgtgaagccttaagattttccaaaaccttatccctttattcttctgttccaaccagcactagaatatttttatagttattgaaagcttgccatttatgtctattcatcaataactgcttagagattttactttcagacacaaaatgaatgaccgcggaaaacattcatgcttttattatagatctgcaccatctttcttaacattggattagaacaccatgaagtaatttctcttttaaaatggatacataatagttgtacatattttgagggtacacgtgatattttaatatatgcatacaatgtgtaatgatcaaatcagggtaactgggatattaatcacctccaacatttatctttttatgggaagactccagttcttctcttccagctattttaaaatatacaataaattattgttaactacagtcacccaactgtactatcaaacactaactcttattccttctatctaactgtatttttgttcccattaactaaccactctctatccccccatactccctacctttcccagactctggtaaccaccaatatatcctctacctccatgagatccacttttttagttcccacaatgagtgagaacatgtgatatttgtctttctgtgcctggcttatttcacttaacataatgaccttcagttccatccatattgctgcaaatgacagaatttccttcttttttatgcctaatcatattccattgggtacgtataccacattttctttatccattcatctgttgatgaacacttacagtgacagatactcttggtcattgtaaatagtgctgcaataaacatgggagtgagatatctttggtatgctgatttcctttcttttggatttatactcagcagtgagattgctggatcatatggcaattctattttcagttgttaggaacctccacattgtcttccatatcactgtactaatttacattcccaccaacagtgtatgaatgttcccctttctctgcatcctcataagcatgttattttttgtctttctgataaaggatgatatctcattgtgcttttggtacgcatttccctgatgattcgtgatgttgaacatgttttcatatactttttggccatttgaatgtcattttttgagaaatgtctattcagatcttttgcctatttcaaaatcaaattatttgttctttttatgttctctttgctattaagttccttatatatttgggttattaatcccttttcagatgggcagtttgcaaatattttctcctattctgttggtggcctcttcactttgttgactgttttctaatccatgagcatgggctatctttccattttttgtgtgttctcttcaacttctttcatcagtgtttcagtcttccttctagtgacctttcacttctttggttaaatttattcctagatattttatattttttgcaactattgtaaatgggattgctttcttgatttcttttcaaaattatttgctgttggcatatataaatgctaccgattttaatatgccgatttttttatcctgcaactttactgaatttgattatcagttctaacagttttttggtggagtctttacgtttttctaaatataatattaggttgggcgcagtggctcctgcctgtaatcccagcactttgggaggctgaggcaggaggattgtttgagcccaggaattcgagactagcctgggtgacatggcaaaactccatctctacaaataaaataataacaataataataataattaaaattaaaaatataatatcatgtcctctgtgaacaagaataatttgacttcctccttcccaatttggataccctttctttctttcacgtagttgctctggctaggacttccagtactatgttgaataaaagtggtgaaagtgggcatccttgccttattcctaatcttagaggaaaggctttcaatttttcttcattcagtacgacgttagttgtgggttcaccatatacagtctttattttttgaggtttgttccttctatacccaaattgttgagggttttttttttatcataaaagcatgttgaattttattaaatgctttttcagcatctattgaaatgttcatacggttgtctttgattttgttgatgagatgtattatgtttatttatttgtgtatgttgaaccatctttgcatccctgggatgaatcctacttgatcatggagaatgatctttttaccatgttgttgtattctgtttgctagtattttatcgaagatttttgcatctatattaatcagggatattagcctgtggttttcatgttgtccccttgtctggttttagtatcgggataatgctggcctcatagaacaagtttgaaaatattccctcctcttcaatttcttggaatagtttcaatagaattggtattaattattctttaaatatttggtagaagtcagcagtgaagccatcaggtctggctttcctttaatgggtcactttatattactgctttaatctcattacttgctatgggtgtatttgggttttctatttcttcatggttcaatcttgataggcttcatgtatctaggaatgtatccatttcttctatgttttccaatttgttggcatagatgttcacaatactctctaatgatccttggtatctctgtggtatcagttgcaatgtctcatgttttgtctctgattttatttgggtcttctttttttcttagtctaactaaagatttgcccattttatcttttcaaaaaaacaactttttattgtgttgatcatttgcattttttcagtcttaatttatttctgccctgatcttcattatttcctgtcttttactaatttggggtttggtttgttcttgattttccagtttcttgaggtggatcattaggttatttatttgaaatgtttctatttttttgatataggcatttattgctataaacttccctcttagctctgattttgctgtatcccatagattttggtatgttgttttggtgtgtttttattttcatttttttaacttaagatatttaaaaattttcatcttaatttcttcactgaccaattaattactcaggagtatgttggtcaatttccatgtgtttgtatagtttccaaagtcatgttcaggctgggcatggtggctcacacctgtaatccaatcccaacactttgaaaggccaaggcaggaggattgctaatacaggagttagagaccagtctggccaacagagcaagacccttactctattttttcaattaaaaaacaatgaatgaatttttaaaaaacaataaaaaaccaaagttgcttttgttgtttatttctagttttattccattgtgatcagaaaagatacttgatttaatgtcaagtttctgaatttgttgagacttggtttatgtcctaacatatggtctatcctggagaatgctttacatgctaaagaaaacattgtatattctgcagcagtgagatgaaatgttctgtaaatgtcagttaggtccattggtctagggcataatatcactccaatgttcctttgttgattttctgtcggcatgatttgtccattactcagagtggggtgttgaagtcccctactattattgtattgcaatctagctctccctttagatctattaatgtttgctttacatatctgaatgctccaatattggatgcacatatatttacaattgttatatcttcttactgagttgctcctatatcattatacagtgaccttctttgtctctttttacagtctttgacttgcatctattatatctgatataagcatagctactcctgctcttttttggtttccaattacgtgaaatattgttttgtcgttgctgttgtttttggacagggtctcactctgttacccaggctggagtgcagtggcacaatcatggctcactgaagcctcaacctcctgggatcaaccaatcctcccacctcagcctcctgagtagctgggactacaggcacatcccaccacacccagttctatatatatatttttttttgattttttttttgtagagacagggtttcaccatgttgcccaggctggtctcaaactcccaggttcaagtgatccacctgcctcagcatcccaaagtgctagggttactggcttgagccacaatgcctggcctggaatatcttttcctatcactttgccttcagtctatatgtgcctatatgtgaaataggtttcttgtaggcagtatatatctgggtctttaaaacaaaaatctattcagccactcattgtcttttaattggagaatttagtccatttatattaaatgttattattgataggtacgatggttaatattaggtgtcaacttgactggattgagggatgcctagacgactggtaaagtattgtttctaattgtgtttgtgagagtgttgccaggggagattgatatttgtttcagtggactgggtgaggaagactcaccctcaatgtgggtcacatcctattggctgccagcatagctagaacaaagcaggcagaaggaggtgggataaatttgtttgctgcatcttgtggttctctttcttcttccctgctggacacttgcttcctctcttcctgcccttggacatcagactccaggtactttggcctttggactccgggaatttcaccagtggcttcctgggggctcttgggcctttggccacagaatgagggctgtactgtcagcttccctagttctgaggcttttggacttggactgagacactattagcttctctctttccccagcttgcagatagcctattgtgggacttgtaatcatgagaaccagttctccctaataaactcccttttatatatccatatatcctattggttcggtcccactggagggccctaactaatacaataggtaaggactgactactgccattctgttacttgtcttctggttgttttgaaactcctctcctttcttccttttttactgtcttcctttgtgctttgtctgaatacttacttttctctggtggtaatgtttgaattcattgctctttattttgagtgtatctattacaggttttagttgtgtcattaccatgagaattacaaaaaaaatcttatagaaatggcaagtttttttaaacagattacaactgaattttgatcacaaagaaacaaagtaaaaaactttaaaactctacactttaactcaatctaccacttttttttgttgtctgaattcacataattttatattgtctatatcttaacaagttgctatagttattattttcaatagatttattttttaggcttcatactagagatgagttgattatacaccatgacacactattagaagattttgaatttgtctgaatacttacttttgccagtgagttctataccttcaactgttttctttttgcacattagtgtacttttctttcagattgaagaactccctttagcatttcttgttaagatgcctttggtgttgatgaattctttaagcttttgtttgcctgggaaagactatctctcctacatatttgaaagaaagctttgttgaatgtagtattctcatttagcagtttttctacttcagcaatttgaacatgttgtcccactccctcctggcctatacggtttccactgtttgctgtttccagacaaatcagacctcttttatggttatttccttcttttttcttgctgcttttagaatcctctttgaccctgacctttaagagtttattacatgtcttggggtagtcttaattgtgttgaatctatttggtgatctctgaccttcctgactcagatatttatatctttctctaggtttcaaaagttttctgttattatttctttaaataatctttctaaccattgctctttctcaactccctttgaatgccaaccactcttagatttgctctttagaggttattctctatatcttgtaggcattcttcattccttttctttctttaattctttcttttcctttgcatattttcacattgcctgtctttgaactcactgattcttttctctgcttgatccattctgctattgagagcctctaatgcattttttagctcagcaaatgcatttctcagttccaggatttctgtttaagtgtgtttgttgttgttgttgttgttttggggtttttttttttttttttttttttttttgagacagactctcactctcttgcccaggctggagtgcagtggtgtgatctcggctcactgcaacctccacctcctgggttcaagcaattctcctgcctcagcctcctgagtagctgggattacaggtgcacgccaccatactggctaatttttacatttttagtagagacagggtttcaccatgttggtcaggctggtctcaaactgctgacctcgtgatccacctgccttggcctcccaaagtgctgggattacaggtgtgagcccttgcacctggccatttttgtttgttttgagacagagtctcactctgtggcccagactggaatgcagtggcatgatctcggctcactgcaacctctgcctcctgggtccaagtgattcttgtacctcagcctcctaagtagctgggattacaggcgtgtgcaacacctggctaatttttttatttagtagagatggggttttaccatgttggccaggccagtctcaaacttctgacctaaggtaatccacccgccttgacctcctaaagtgctgggattacaggcctgagccaccatgcccatctcttctgtttgagtttttaaaacactaaaaagtttttaatctccttgttacatttctctgataaatttataaattgcttttgtgtgttatcttggagttcactgagttttcttagaactgttattttgaattctcagtgtgaaagctcacacattaccatcttattactatcaatcactagctccttgctttgtctgtttgggaagatcatgcttccctgtttgctgtttttatgaatgtatacctgtggctttgcactgaagaattagtaatttatttcagtcttgctgtctagcttgttctgctttttctaagatatggttgtttggaggttctttgcagtttgcctgctgagttccattaatgctggattgctacctccttttcagcactagtggtgctgtaagtccatccaggtttgcctcagttctcacaaacattcagagtgttgcccatcataggctggcggaggaggccccagagggaacagtccaactgtgtgagaagaacactggctagaggtttgtgcccagaggacccatggagtgtgcctcttacagcatggtgctgctgaacagacactctgatttagtgtctcctttggctaagataaagagaagaatttcaagggctggggttgctctttgtctctaactgctctcaggggtttttctccctacaggcactcactatgcttcttgttccttcacaagaacagttttcctgcaaagaaactcaagacagtggggaggctggctggctgcctcaatttcactttttccagtgtggaaattgagttgcagaggaattttctgcatggtccctggtaaatgagaggagtgcatcacagagcagtccatttctcttactgtctgctgagagtttttcatttctttgtacacccaggaatcaactcagcctcagacttgagttctgggatactgatggtgataatcctggtgctcattttcagagggggagagtgaaggccagactggttctactctgccagtttggagacgttactccttcaactaacttgttaatttcttaaatcttatgatatattcacttacttgataaatattttacatatgcctgtaaatcaaggaacatagtcctagacctccaggtatgactcagtataggtcaacaactgagtaccttggttaagaggcaacaaaaattatattgacaaataatcttgtatttaaagttaattatacagctttctgtcaactacacttcatttactcagaactgatattaataatggcccaaaagtagataatatcactacctatggcagaaattaaataaaagcatctgatgtaaatactgcacattatataggcaaaatttcttgagaacagaaaaggaagcaaaagtaggtacagaggaaggtacatttgaaaagagggtagggacatcagaaaaacaggattgaggaaggaggtaagaaagaaggctgaaggagttcctacctgatggcatatattttctcagtgaacaaggacggaaagtaaaggcaaagagcagtgaagaggaggatttagcatgatgaaaattaaagagttgttttagtctgcttaggctgccataaaaaaaaaataccatagactggattgcttaagcaacagaaacatatctcacagttctggaagctatgaagtccaaaataaagaaactggtcaattcctttcttgctgtgggccctcttcctgatttgcagaaagccaccttctcattgcatcctcatatggcagagagagagctctggtgtttctttctcttcttaaaagggcgccagttctactggattagagcctcacccttttgacctcatttaatttttcatcaactctccacaggccctatcttcaaatatagtacattgaggaccagggattcaacatgtgaattttgaggggacacaacattcagttcagaataagagtttagacagactctgtaagaaactgaaaaaaaaagaagagacccatagaaggacagtcagaaactattatggctaaagttggctaccatgcaagttcagaaaactataaacagtcacccacaaggtaactggtaccaggctatccttcccaatataaaatattaaaaatggaaaaaatatatgaaacaactgctttcagatgtggataacaaggcagcacagtattgtgatctccaaaagaagggaaaaaaatgacacaagatctatgatagcccaggtttactacttgggggcgtatattagctacttatgatagaagcggtgccagatagtctcactaagccaagaagacagatcttggagttcaagtttgttgaggctgctggaattttagggcagaaaagtgggagctacacagaataagagcttgagaaatacacatatggatcttcttgagtctttgaccgtattctaagctgtgtatgcacagagtgagacaccatgaagctgaacaaaaaatatctaccagggacaaaacatataccagggacctgtaagctgagtcactagtacagttcatacaggattgagaaatttataagttaaaacaaaccaaaatggagacgtgtcattgaatacttggggcattcaataaagacccagaaatgtcacatgatagaaacagagataaactaaccttagtgtgaaagttactctagattttcccttaaaatgcttaaatataaatggaaaagattaaacttatcttcaactaaattaattgactaccagaacaaaattcaactctcttcaaagaaagacaacatttagacactcaacaatataacctataagattatccaacatataataaaaaattactagatttgtaaagaagcaggaaaacgtgacaaataactaagagagaaaccaaaaatagaaacacacagagaaattgcaaggataacagaactagtaaacagattctttaaaatagctattataaaaatgttcaaggatacaaagaaaaaaatgaacttaaaagaagggaagtgggattttaaaaatgaaccaaaggaaacttctagagatcaatacaatatctgtaatttaaaagttcactggaagagcctaatagcaaatcagacacttgcatttaaaaaattactaaacttgaagaaatagcaataaccgctattcaaaatgaagcacagaaagaaaaacaaggctaagagaaaatgaacagaaactcaatgacctatgggacaatattaagttatctaagttatataatatttgtataactggagtcccaaaaagaggaaggagacagaaaaatagctgaggaaataatggctgaaaactttctaaatttgctaaaaatataaacccacagatccaagaagctcaatgaactccaaataggacaagcataaagaaaatcacataaaggcacatcataatcaaactgctgaaaagtcaatgataaagagagaaatcttaaaagcaagaagaaaaaaagacacactacttacaaaagcagaaaaaaaaaatttagcccctaactgatttaaagcaatgctagccagaggatgatggaattatatgttaaaatagagtgaataaacttaaaaaaacctgtcagcctagaattctataactacaggcaaaatgctttttcagaaaaataaaactgagaaaacttagcactaacagacttgtgcttcaagaaatgttaaagggggttctttatgttgaagaaaaatagctccagatgaaaactcagatctaaagaaaaagagcacaaaaaatgaacaatttgtggagaaatataaaacaagtttttctggggttttaatttctttaaaaaataattgaaccccttccgttacccttttcctttctccttcccatagagttcacattctacagtcattagattgggccaagcagagtagacatccatgccagatgaagggtatgggaggagctgaagtggcccagggcaggtatatcagaacaagtgtggaaaggatatccaatcagtgggccatcctggcacagggtttcgagctcaagaagggtgaggagagtgtctcccacgaggaatggcccagagtgaaatatcagagcccaagtgggaaaaggaaggcaatgaggaggcatggcttattgtagggtattggagcccaaggctggtgatagatggagcccaagaagaagtcaactgcccaaatccaagtcctgtaccactgagatgatgccatgagaccacgtctatggtctttctaacaaaaacgcctaacattagtctactcatgcagatattatacataaaacaagcccaaattgagagacattctacaataaaacatccctaatctttatgtcaaggttatgaaaattaaagaaagattgaggaactattccaaactggaggaggccaaggagacacgacaaccaattgcaacatatgaactggacagggtccttttgctagaacattttgggacaactgaagacacctgaattgggaggattttgatgatcaactgtaaaagcatgccctgtttataggaaatacatcaataatattcatggcatcatgctggcaacttactctcaaattattcaggaaaaaatattctttgtactgtgtttgcaactttcctataagtttgagattgctaaaaatgaaaaatgtatgctggataaaatataattgactttttttttcttttgtgagacagagactcactctgtcatccaggctagagtgcagtggtgcgatctcagctcactgcaatctccgcctccagggttcaagagattctcctgcctcagcctcccgagtagctgggactataggtgcacaccaacacacccggctaatttttgtatttttaggagagacagagtttcaccatgttgggcaggctggtctcaaactcctgacctcaggtgatctgcccacctcggcctcccaaagtgctgggattacaggcgtgagccaccgcgcccagcttataattgattatttaaagcaaaaataaattatattgtcgtttataaatctataaaagcaaaataaatgacaataatagcacaatacacaggagggagaaaataaaagcatactcttgttaggtcctttaatgtaaagtggcataacattatttgaagacagtccatggtatttaaaatgcatattttaaatcctagagcagtcactgataaacaaaggaacattagcagtcaaaggcataggagttcacaggaaaaaaaaagatagctgcatgagtgtaggaaggagtgtgatatggcttagaaaaataactaagaatgacatattaatatgacatttaaaaagacaaataggtgaggggccaagatggcgaattagaagcagctcatgtgcgccactctcaccgagagaaaacaaaagggctagtgaacactgaccctgcaggccaaccatctgagaaaccacattcaatccatcaaggcagcaggggaacacagattgcagagaggaatgaagctggggaccagcctgtctgggctcagcatggagccaggggaaccactacatgagaaagggggagtgggtgagagcccccagggggattcacactgttcacaaggacttgtgcaagactgggaatgggagaatccccctggtttcccccaacaccctgctatcacactttagactgaggcagaaagccagtcagacatttttgaggggcaactcctgagtgcaaggggacctctacaaggcttgggccctggagcagaccagcaccagcactatagccccagtagaggctgcagtagcagtatctggaagcagtaaaattgttccacccctccttgctggacagggctaggcaccagtttccagcccagcagtcctgcttcagcccttaatgagccagccagccagccactcaacccaactctgccacttgcagcccggtgggcaacacttgctagagcttgcaacccagtggtcccacttttgtgtgaactcagctggggagtgcagtctcctactgtcctaggaaacacctggacagtagacacctgcccccaccactggtagccaggctggcaatacctgctagagcttgcagcccagcagccccacttctgtgtgaactgagccagaaggcatagcttcctgttggcccaggaaacacctggatggcaggcagagcccatgaccccgcccaccccactactggtaaccgggtgccagagcttctagcccagtggccctgcttctgtatgaactcgaatggagggcatagcttcctgttgtcccgggaaatacctggatggcagagtgtgcaaccccacccacccccgccactggtaaacaggcagacaatgcctgctagagctttcagcccagtgttcccactcctatgtgaacttagctagagggcagagcttcctgttgtcccaggaaatacccagatggcagggtgagcgtccccagccaccaccaccaccagcagacaggtaagccatgcctgctacagcctacagaccagcagtcctacttctgcttgaatctgctgagaagtgcagactcctattgccctggaaacacctggatggcagggtgggcaactccacccacccttgcctctcatagccagatgggccacacccactagagcttccaacccagcagtaccacttctgcctgaattctacctcagtctatagtgcagtaggggggtttagggggaagccaaggtgattctgccattcccagttttgcataggtccctgtggagagtatgaatccccctgggggcacccacccactcactctttcccatgttccagtggttctcctggctccatgctgagcccagacaggctggtccccagcttcattcctctctacaatctgtgttccccagcaatctcatgttttcccaggaagcacacagacagaagattagggctgacctggcaaggatatggcttatatgccaactgcagcccctgcctgattcagccctgtgcaaccgaacacccaacaaaagaaacatgggcatggagagagtaatcggaggtgggaggtcctccaagattcaggagtggattagaatcaaggccagtcgacagaccaccttattctataatcaaaccccaagggcatcaaagaagaaaaaagcaaaaaaaaaatccatccaaaggacagcagtttcaaagattcaagagacatcggcccacacaaatgagaaagaaccagtgcaagaactctggcaattcaaaaagccagagtgtcttcttacctccaaacaattgccctagttccctagcaatgattcttaaccaggctgaaatggatgagatgtcagatgtagaataaagaataaggataggaatgaagatcatcaatataccggagatagttaaaacccaatccaagaaatctaaggagtacaataaaacaatactggaggtggtagaccaaatggccattataagaaagaaacaggccaggcgtggtggctcacgcctgtaatcccagcactttaggaggccgaggtgggtggatcacctgaggtcaagagttcgagaccagcctggccaacatggtgaaaccccatctctactaaaaaatacaaaaaaaattagccaggtgtggtggcacatgcctgtaatcccagctacctggaggctgaggctggagaatcgcttgaacccgggaggcagaggttgcagtaagggaagatagcaccactacactccagcctgggagacagagtaagactctgtctcaaaaaaaaaaaaaaaagaaacaaacaaactgatctgatagagctgaaaaacacaataatgtacttgtaagtattaacagcagaatcaaccaggctgaggaaagaatctcagtggttgaaaactggctctcctaaataattcagtcagacgaaaataaagaaaaaaacaataaaggagaatgaacaaaacctccaagaaatatgggattatgtaaacagaccaaatctatgactcactggcgtccttgaaagagaaaagagagggagagaaaccaaggaccttggaaaacatatttcaggatatcgtccatgaaaatttccccaatcttgcagagaggacaacattcaaattcaggaaatgcagagaactcctgaaaaatgctacaaaagaaggccatcccaagacacataatcatcagattctccaaggtcaaaatgaaagaaaaaaggcagctagggccgggcgcagtggctcacgcctgtaatcccagcactttgggaggctgaggctggtggatcacctgaggtcaggagttcgagactagcctgaccaacatggagaaaccccgtcactactaaaaatacaaaattagccgggcgtggtggcacatgcttgtaatcccacctactcaggaggctaaggcaggagaatcgcttgaacccaggaggcggagattgcagtgagccgagattgtgccattgcactccagcctgggtgacagagtgaaactccaactcaaaaaaaaaaaaaaaaaaggacagctagaaagaaagggcaggtcatctgctaagagaaccccatcaggctaacagcagacctgtcggcagaaaccctacaagccagaagagattgggggagcctatattcagcattcttaaaaaacataattttcaaccaagaacttcatatgcagccaagttgtttcctaaacaacggagaaataaaatacttttcagacaagcaaatgctaagggaatttcttaccaacagacatgccttacaagaggtcctgaagaaagcactgaatatggaaaggaaagaccattaccagccactataaaaaaacactaagtacatagacaagtgatactctaaagcagccacacaaacaagtctgcataacaaccagctaacaacatgatgacgggatcaaatccacatgtatcgatactaatcttgaatgtaaatgggctaaatgcccccatttaaaaggcacagagtggaaagcaaaacccaatggtatactgtcttaaagagacccatctcacatgcactggcacctctaggcttaaagtaaagggatggagaaaaatttaccaagcaaaaagaaaacataaaaaggcaggggctgctattctaattccatacaaaacagacttcaaaccaacaaagatcaagaaaagataaagaagggcattaaataatggtaaaggactcaattcaacaagaagacctatctatcataaatatctatgcgctcaacccagattcataaagtcagttcctagggacctacaaagagacttagataactacacaataatagtgggagccttgaatacccccactgacactattgaacagatcatcgaggcagaaaactaacgcaagtattcaggacctgaactcaatgcttgaccaaatatacctaatataaatctacagaactttccatctgaaaacaacagaacatacattcttcacatctgcacatggcccatactctaaaatcaaccacacatattggacataaaacaattctcagcaaactcccaaaaaccaaaatcataccaaccaagctcacagacaatgcaataaatatagaaattaatgctaagaatatcaatcaaaagcatacaattacatggaaattaaacaacctgctcctaaatgacttctggataaataatgaaattaaggcagaaatcaagaaattcttttaaactaatgagaaaaaagatacaagatatcagaatttctgggacacggccaaagcactgttaagagggaagtttatagcactaaacacccacatcaaaaagttagaaatatctcagattaacaacctaatatcacaactagaggaattagagaaacaagaacaaaccaaccccaagactagcagaagacaaaaaataacaaaagtcagagacgaactaaaggaaattaagaggcaaaaaaaaaccatacaaaaatcaataaatccaggagctttttctttgaaagaagtaataatacaaggtagactggtagataaactaattttaaaaaacagagaagatccaaataaacacaatcagaaatggcaaagggtgtattaccactgaccccccagaaatacaaaaaaccctcagagattattatgaacacttctatacacacaagttagaaaacctaaaagaaatggataaattcctggaaacatacaacctccaaagattgaacgaggaagagattaaatccctgtacagactaatattgagttccaaaatcaaatgaataagtcatgacagtaagattataaaaaggccaggcatagtggcctttctataccagaaaaatacaaaaattagccaggcatagtggcacatgcctgtagttccagctacttggaggctgaggtgggaggattgcttgagtctgggaggttgaggctgcagtgagccatgatcacactactgcactccagcctgggtgacagagcaagaccctgtctcaaacaaaaaaatcaaatcagtaataaaagcctaccaaacagaaaaagcccatgaccagatggattcacagctgaattctatcagatgtataatgaagagctggtaccattctcactgaaattattctaaaaaattgaggaggaggaatgcctccctaactcattctatgaggccaacattatcctgataccaaaacctggcagagatacaacagaaaaagaaaacttcaggccaatatccttgatgaatatggatgcaaaaatcctcaagaaaatactagcaaactgggccgggcgcggtggctcacgcctgtactcccagcactttgggaggccgaggcgggtggatcatgaggtcaggagatcgagaccatcctggctaacacagtgaaaccccgtctctactaaaaatacaaaaaattagccgggcaaggtagcgggcgcctgtagtcccagctacttgggaggctgaggcaggagaatggcatgaaccccggggggcggagcctgcagtgagccgagatcacgccactgcactccagcctgggcgacagggagactccgtctcaaaaaaaaaaaaaaaaaaaaaaaaaagaaaatactagcaaactgaatccagcagcacatcaaaaagcttttccaccatggtcaagtaggcttcctccctaagatgcaaggttggttcaacacatgcaaatcaataaatgtgatacaccacaaaaacagaactaaaaacaaccacacaatcatctcaatagatgcagaaaaggctttcaataaaattcaacatctcttcatgttaaaaaccctcaagaaactaggcactgaaggaacatacctcaaataataagagccatttatgaaaaacccacagccaacatcctactgaatgggcaaaagctgaaggcattccccttgaaaaccagaacaagacaaggatgccctctctcatcactcctattcaacacagtactgaaagtcctagcaagagaaatcaggcaatagaaagaaataaaagatgctcaaaggaagagagaaagtcaaactccctgtttgcagacaatatgattctatacctagaaaaccccacagtctctgcccaaaagttctttgatctgacaaacaacttcaacaaagtttcaggatacaaaatcactgtactagctgtgcacagtggctcatggcggtaatcccagcactttgggaggctgaggcaggtagatcacttgagaccaggagtttggaccagcctggccaatatagctaaaccccgtctctactaaaaatacaaaaactagctgggtttggtggcccatgcctgtaattccagttatttgggtggttgaggcatgagaattgcttgaacccgggaagcagaggttgcagtaagtccaagtcacaccactgcactccagcctgggtaacagagtgagactctcatctcaaaaaaaaaaaaaaagcaatgtacaaaaatcagtagtattcctatacaccaacaacatacacactgtgagccaaattaagaattcaatttcattcacaatagccacaaaaaagaataaaataaacaggaatacagctctaaccagctataaccaaggaggtgaaagacctctacaacaagatttacaaaacactgcaagaaagaaaacagagatgacacaaacaaatggataaacaatccatgctcatggataggaagaatcaatattgttaaaatggccatactgcccaaagcaatttacagattcaatgctattcttatcaaactaccaatgacatttttcacagaattagaaaaaaactattttaaaattcatatggaaccacaaaagggtccaaatagccaaggtaatcctaagtgaaaagaacaatgctggagacatcacattacccaacttcaaactacactataaggctatggtaaccaaaacaacatggttccgttacaaaaacagaaatgtggggggggtggggggaggttccaagatggccgaataggaacagctcctatctatagctcccagggtgagtgacgcagaagacgggtgatttctgcacttccaactgaggtactgggttcatctcactaaccgaggtaccaggttcatctcactggggcttgtcggacagttggtgcagcccaccgagcgagagccgaagcagggcaaggcatggtctcacccgggaagcataaggggtcagggaattccctttcctagccaagggaaggggtgacagacggcacctggaaaatcgggtcactcccaccctaatactgtgcttttccaacggtcttagtaaatggcacaccaggagattatatcccgcgcctggctcggagggtcccacacccatggagcctccctcattgctcgcacagcagtctgagatcaaactgcaaggcggcagtgagactgggggaggggcgcccgccattgctgaggcttgagtaggtaaacaaagtggcctggaagctcgaactgggtagagcccaccacagctccaggaggcctacctgcctctgtagactccacctctaggggcagggcatagccgaacaaaaggcagcagaaacctctgcagacttaaacgtccctgtctgacagctttgaagagagtagtggttctcccagcatggagtttgagatctgagaacagacagactgcctcgtcaagtgggtccctgacctccgagtagcctaactgggaggcatctcccagtagaggcagactgacacttcacacggctgggtacccctctgagacgaagcttccagaggaatgatcaggcagaaacatttgctgttcagcaatatttgctgttctgcagcctctgctggtgatacccaggcaaacagtgtctggagtggacctccagcaaactccaacagacctgcagctgagggtcctgactgtcagaaggaaaattaacaaacagaaaggacatccatacaaaaaccccatctgtacgtcaccatcatcaaagaccaaaggcagataaaaccacaaagacggggaaaaaacagagcagaaaagctgaaaattctaaaaatcagagcacctctccccctccaaaggaatgcagctcctcgccaggaacagaacaaagctagatggagaatgactttgacaagttgagagaagaaggcttcagacgatcaaacttctccaagctaaagaggaagttcgaacccatcgtaaagacgctaaaaaccttgaaaaaagattagatgaatagctaactagaataactagtgtagagaagtccttaaatgatctgatggagcttaaaaccatgacacgagaaatatgtgacacatgcataagcttcagtagctgattccatcaagtggaagaaagggtatcagtgattgaagatcaaatgaatgaaatgaagtgagaagacaagtttagagaaaaaaaagagtaaaaagaaatgaacaaagcctccaagaaatatgggattatgtgaaaagaccaaacctagttctgattggtgtacctgaaagtgacagggagaagaatcaagttggaaaacactctttgggatattatccaggagaacttccccaatctagcaaggcaggccaacattcaaattcaggaaataccgagaacgccacaaagatactcctcgagaagagcaactccaagacacataattgtcagattcaccaaagttgaaatgaaggaaaaaatgttaagggcagccagaaagaaaggtcaggttacccacaaagggaatcccatcagaataacagcggatctcttggcagaaattctacaagccagaagagagtgggggccaatattcaaaattcttaaagaaaagaattttcaacccagaatttcatatccagccaaactaagcttcataagtgaaggagaaataaaatcctttacagacaagcaaatactgagagattttgtcaccactaggcctgccttacaagagctcctgaaggaagcactaaacacggaaaggaacaaccggtaccagccactgcaaaaacatgccaaattggaaaaaccatcgatgttagaaagaaactgcatcaactaatgagcaaaataaccagctaacatcataatgacaggatcaaattcacacataacatattaaccttaaatgtaaatgggctaaatgctccaattaaaagacacagactggcaaattggataaagactcaagacccatcagtgtgctgtattcaggaaaccaatttcacatgcagaggcacacataggctcaaaataaagggatggaggaagatctaccaagcaaatggaaaacaaaaaaacaagcaagggttgcaatcctagtctctgataaaacagactttaaaccaacgaagatcaaaagagacaaagaaggccattacataatggtcaagggatcaattcaacaagaagagataactatactaaatatgtatgcatccaatacaggagcacccagattcataaagcaagtccttagagacctacaaagagacttagactcccacacaataataatgggagactttaacaccccactgtcaacattagacagatcgagacagaaagttaacaaggatatccaggaattgaactcagctctgcaccaagcagacctaatacacatctacagaactctccaccccaaatcaacagaatatacattcttcgcagcaccacatagcacttattccaaaattgatcacatagttggaagtaaagcactcctcaggaaatgtaaaagaacagaaattataacaaactgtctctcagaccacagtgcaatcaaactagaactcaggattaagaaactcactcaaaaccgctcaactacatggaaactgaataacctgcttctgaatgactactgggtacataatgaaatgaaggcagaaacaaagatgttctttgaaaccaatgagaacaaagagacaacataccggaatgtctgggacacatttaaagcagtgagtagagggaaatttatagcactaaatgcccacaagagaaagcaggaaagatctaaaattgacaccctaacatcacaattaaaagaactagaaaagcaagagcaaacatattcaaaagctagcagaaggcaagaaataactaagatcagagcagaactgaaggagatagagacacaaaaatcccttcaaaaaatcaatgaatccaggagctggttttttgaaaagactaacaaaattgacagacggatagcaagactcataaagaagaaaagagggaagaatcaaatagacacaataaaaaatgataaaagggttatcaccactgatcccacagaaatacaaactaccatcagagaatactataaacacctctatgcaaataaactagaaaatctagaagaaatggataaattcctggacacatacaccctcccaagactaaaccagaagatgttgaatccctgaatagaccaataacaggctctgaaactgaggcaataattaaaagcctaccaaccaaagaaaaggccaggaccagatagattcacagccgaattctaccagaggtacaaggaggagctggtaccattccttctgaaactattccaatcaacagaaaaagagggaacaacccctaactcattttatgaggccagcatcatcctgatacgaaagcctggcagagacacaacaaaaaaagagaactttagatcaatatccctgatgaatatccatgcaaaaatcctcaataaaatactggcaaaccgaatccagcagcatatcaaaaagcttatccaccatgatcaagtgggcttcatccctgggatgcaaggctggttcaacatatgcaaatcaataaacatagtccagcatataaacagaaccaaaggcaaaaaccacatgattatctcaatagatacagaaaaggcctttgacaaaattcaacaacccttcgtgctaaaaattctctataaattagttattgatgggacgtacctaaaaataataagagctatttatgacaaacccacagccaatatcataatgaatgagcaaaaactggaagcattccctttgaaaactagcacaagacaaggatgtcctctctcaccactccgattcaacatagcgttggaagttctggccagggcaatcaggcaagagaaagaaataaagggtattcaattaagaaaagaggaagtcaaattgtccctgtttgcagatgaccagatgacatgattgtatatttagaaaaccccatcgtctcagcccaaaatctccttaagctgataagcaacttcagcaaagtctcaggatacaaaatcaatgtgcaaaaaacacaagcattcctatacacaaataatagacaaacagagagccaaatcatgagtgaacttccattcacaattgcttcaaagagaataaaatacctaggaatccaacttacaagaaatgtgaaggacctcttcgaggagaactacaaacctctgctcaacacaataaaagagaacacaaacaaatggaaaacaattccatgctcatggataggaagaatcaatatcgtgaaaatggccatactacccaaggtaatttatagattcaatgctatccccatcaagctaccactgactttcttcacagattggaaaaaactactttaaagttcgtatggaaccaaaaaagagcccacattgccaagacaatcctaagcaaaaagaacaaagctggaggcatcatgctacctgacttcaaactatactacaaagctacagtaaccaaaacagcatggtactggtaccaaaacagagatatagaccaatggaacagaacagagccctcagaaataatgccgcatatctacaaccatctgatctttgacaaacctgacaaaaacaagaaatggggaaaggattccctatttaataaatggtgctggaaaaactggctagccatatgtagaaagctgaagctggatcccttccttacaccttatacaaaaattaattcaagatgaattaaagacttaaatgttagacctaaaaccataaaaaccctagaagaaaacctaggcaataccattcaggacataggcatgggcaaggacttcatgtctaaaacactaaaagcaatgacaccaaaagccaaaattgacaaatgggatctaattaaactgaagagtttctgcacagcaaaaaaaactaccatcagagtgaacaggcaacctacagaatgggagaaaatttttgcaatctactgatctggcaaagggctaatatccagaatctacaaagaacttaaacaaatttgcaagaaaaaatcaaacaaccccatcaaaaatgggcaaaggatatgaacagacacttctcaaaagaagacatttatgcagccaacagacacatgaaaaaatgctcatcatccctggccatcagagaaatgcaaatcaaaaccaccatgagataccatctcataccagttagaatggtgatcattaaaaagtcaggacacaagtgctggagaggatgtggagaaatagtaacacttttacaccgttggtgggactgtaaactagtacaacgattgtggaagtcagtgtggtgattcctcaaggatctagaactagaattaccatttgacccagccatcccattactgagtatatacccaaaggattataaatcatgctgctataaagacacatgcacacgtatgtttattgcggcactagtcacaatagcaaagacttggaaccaacccaaatgtccaacaatgatagactggattaagaaaatgtggcacatatataccatggaatactatgcagccataaaaaatgatgagttcatgtcctttgtagggacatggatgaagctggaaaccatcattctcagcaaattatcacaaggacagaaaaccaaacaccgcatgttcttactcataggtgggaatggaacaatgagaacacatggacacaggatggggaacaccacacaccagggcctgtagtggggtggggggaggggtgagggatagcattaggagatatacctaatgtaaatgacgagttaatgcgtgcagcacaccaacatggcacatgtatacatatgtaacaaacctgcacgttgtgcacatgtaccctagaacttaaagtataaaaaaaaaaaccagaaatatagactaatggaacagaataaagagcccagaaataatgccacacatctacacaatcaagaaaaacaagcaacagggaaagaactcttcattcaataaatgatactgggataactggctagccacacgcggaatattgaaactggaccacttccttacaccatatacaaaaatcaactcaatatagatgcaagacttaaatgtaaaacttaaaactataacaaccctggaagataacctaggaaataccattctgggcatagaacttggcaaaaatttcattatgaagatgccaaaagcaattgcaacaaaaacaaaaattaacaaatggggcctaattaaacaaaagaacttctagcagcaaaagaaactatcaacagaataaacagacaacctatagaatggtataaaacatttgtgaactatacatccaacagaagtctaatatccacaatctataaggatcttaaacaaatttacaagaaaaaaacaccaccattagccaggcacggtggctcatgcctgtaatcccagcactttgggaggccgaggcgggtggatcacgaggtcaggagatcgagaccatcctggctaacacggtgaaaccccgcctctactaaaaatacaaaaaattagccgggcgtggtggcgggcacctgtggtcccagctactcaggaggctgaggcaggagaatgccgtgaaaccgggaggtggagcctgcagtgagctgagatcgcgccactgcactccagcctgagcgacagaatgagactccgtctcaaacaaaacaaaacaaaacagaacaaaacaaaaaaaaataccattaaaagagtggtgaaaacagacaaacaaacacttcttagaagacatacaggcaaccaatgagcatatgaaaaaatgctcaacatcactaatcattagagaaatgtaaatctcacaccagttagaatggctattattaaaaagtcagaaaataacagatactggcaaggttacagagaaaaggaaatgcttacacactgctggtgggaatgtaaattagctcagccattgtggaaagcagtttggccatttctcaaagaacataaaacagaattgccattcaacccaacaatcccattattgggtatatgcccaaaggaatataaatcattctaccataaagacacatgcatgcatatgcacatcacagcactattcacaatagcaaagatatgaaatcaacctaaatgcccatcaacagtagactggattttttaaaatgtggtatatatatacattgaaatactatgcagccataaaaaagaatgagatcatgtcctttgcagcaacatggacggagttggagaccattatcctaggcaaactaacacagagacagaaaaccaaatactacacattctcacttacaagtggaagctaaacttctgagtacatatggacacaaagaaaggaagaacagacaccaggatctacttgagggtggaggtgggaggatggtgaggattggagaagtatctattgaatgctaggcttataacctgggtgacaaaatatacaccaaattcctatgacacgcaatttacctacatataacaaaccttcacatgtactccctcaacctaaaataaaagttaaaaagagagagagagagagagagagagagagagagagagagagagagagagagaaataattagggcaaggatgacagactttattacataaagctttaaaatttctgtcatcagccgggtgtggtggttcatgcctgtaatcccagcactttgggaggccaaggtgggtggatcacctgaggtcaggagtttaagaccagcctggccaatatggtgaaaccccatctctactaaaaatacaaaaaattagctgggcgtagtggtgggcacctgtaatcccagctacctggaggctgaggctggagaatcgcttgaacccaggaggcggaggttgcagtgagctgagattgcaccaatgcacttccagcctgggcaacaagagcgaaactccatctcaaaaaaaaaaaaaaaaaaaaaaaattctgtcaccagaagactccacaagcaaaactgaaagcaaacatcaagtgtgggggaaaaaaatctccaaatatattccaaagggctaatattgccaatataaagagctactacaaaccagtaagaaaattataggaattacaatgtaaaaacagacaagataggagcaggtaatttgtaaaggaagaaataatgggcaaaaatatccttattctaactgaatgcaatacatcaagagtaggattatagtgtatacatacatatatatgtatatatatgtgtatatatatatatatatatatatattttttttttttttttttttgagatggagttttgctattgtcgcccaggctggagtgcaatggtgtgatctcggctcactgcaacctctgcctcctgggttcaagcaattctcctgtctcagcctcccaagcagctgggattacaggcatgcaccaccacacttggcagattatagtatataatgtatactgaattcatacaaacctgtaatattgctctttcaggtaacagtgaaatgtcacattttagagtctcatctacaagaaagacttcagaagaacttcgttcaggaaaattggattcttctgcagcagctcttttgagtattaacctatttttccattttttcaattgaagttcatgttttaatatctgcaatgaaaataattttaaaattccatggaattgctgtaacggtcaagagagatgacagacacaaagcacagtgcttgacacaagaataggaccaattaaacattatttatgatcgtcatcattactacataaactataatttttcataagcatgtttaatgttctctaaaccaccgaagtattacagatcatttccattagttgtcataaaacactggcacaggcagccatcttgaaacgctgatctagtctcctctttcacagatgaggaagtgaggaccacaaagtcaaggctctggcaatgataaaactggtaattggtgcatggagtgaaggtgattaacatacagataacaaaaaagggaagtcagtagtaatgcatttgggaaattgccaaatttattgtcacaggaagtccccattttaacttttgatacacttctgaaaactgtgtaataaataaaggtagtatttcagtcataaacatatacacaatattggcataatatatattgatgtaatatatatatgtgtatgtgtgtatgtatgtatgtatgtgtctgtgtatatacacacacatattagagcctgaggcagaacacatgtggagcgcttgacacacaggtgttccctgcctctgctcccagcatacacttgccatcctcactccatttaagtgaatgtagaatgattgttaggtcaataaatcatatatctagaaaaaaagttctctaaacacacaattaactatataatatatataatatacatatatcttgatgatattatagtacatatagcataaattatatatattaatatatatcaaccactgtgtgcaaaacattacgctcagcatatggacaatactaagagaacaatactgcctgctctcagggatttttttgtttgtttgttttttgagaaggagtttcgcttttgtcgcccaggctggagtgcagtggcgtgatctcggctcactgcatcctccacctcaagggttcaagagattctcctgactcagcctcccaagtagctgggattacaggggcccaccaccatgcctggctaatttttatattcagggatgtttagctgaagggggtgtataaggggggactggtcatgtacagttacctatttcactattagacaatcagtgatcaggcatagagggcagttatcaaaacactagcttaacatacagactggtggaaagcagtgaatgagcagactaacatagtattaggtacccaaagtagagctgtttcactggtaacattgaaaaggtagtttgcaaaaggcaaagcctagaggacagcctgcaagaccaccagctcaaaacctatagattataaacttctagagagcatctcaagtaatctctgagatgcttaaagctcagcacaggctctagcattgttttaggcatatgtaagtaataaatctcctcatactcttttgctgcgtgtgtgctattgtcagtctcaacatctgaaccaaatttaggtgagtagaggcattgatccatggggcaaccacaaaagaaggggatttaacttcaccccacattctctttcctatctacccttactttatatttcaaagaatattaataaaatatctcctactaaataatgtaactacagaaaaaaaaatccagcatgtttctacatctgatcatagtgttactttgagcatactaaaccaatattaagtaatgatatactaatagctgaagtaaattttaaattattaagttaaagaacaagaatcccggccagacacggtggctcacgcctgtaatcccagcactttaggaggccgaggcgggcagatcacctgaggtcacgagttcaagaccagcctagccaacatggtgaaaccccatctctactaaaactacaaaaaaattagctgggtgtggtggcagacacctgtaattccagctactcaggaggctgaggcaggagaaatgcttgaacctgggaggcagaggttgcagtgagccgagatcacaccattgcactccagcctggacaacaagagcaaaactctgtcccaaaaaaataaaaataaaaaaaaacaagaatcccatcaaaagtagataatattcaggattttagtattttccacacacggcattactatttgaggcaacatgaatataactgaaacattcggattcttaaaaaattgtttcaatatacaataccagctcatcttctttctttttactcttatgtcttgctgtattccgccattttgttaggataatggttagcttgtgacaatagatgatctgttgtatccgcaatagaatatctgaaggaaatttactagattactgtatatattaatagttatagctgtttccaaaaaacacaaagtgatttaatagtctatcatgtttatgagacaatgtcgcatctgatcgtttttgtttggtcttatttacacttgaaattaattacttttgatagcattagtactctcaagactttacgaactgggaaacatcacctttgcccttagaaattaagatgtaaaactgcaatagaaatgtcaagacatgtatcatttcctttttttaaacaaggttgttctttgtaaaaccagaacttctaaactttttcataagaaatacagtcataaggtagcatttagatccaatgcctttgaatttaattttatgtcctgtgattaaccagttcctaacccttcgttacactaatgttaaaattttcggagggtccactctaactgaggtaccaaccaaagccagccaaaaagaaatgattctctggtttgcaacagtcataaacaagttgttatcaggagagttgcaaaaaaatctaactggaagacaagagctcttggaggttatactgagtgagcatggatcacatgaatgtacctcccacccactcagtataacccccaaggtcttaagagaagataatttttattttttagtttcgtcatatatacattaaatataatctttgtaaaaagcataaacctctttacaaaaatagtcaattttggtacctgtccatactatttggaacccatccagctctctattatgtagaaaagctcatagtagattctatttatattcatgtatacatacacacaaatgcacacaagatttgattttaaatgttttctattaaaataaaatcctttgagacaaatctccttaagtatttttaaattagcagctctaccttcatttcatgacaattgtctagacataaaaatgataggttctctaagtacccaaagtatgcttaactgttagtttttttattatttcaataaatggatacaaaaagtaattgctactatgtaagaatttacttttaagtttttctttctggtcttccatataagagtgccagtgatgaaatacagatttttgaagtctgaaattgtagcatgtcactgctctgttcattttttcagccaggacgacattttcatttgtacgagctatgtctctccaagtgctgcaggcagaagacattttttaaaaaataatattttgatattagggcaatatatcattaaataaattaaggagaacaaagaatgatatctcctttatgacctcaaaaaccacagcatagaaagaaacttctacaacttgggtatgacctgaagaattcctaagagttatagagaaaaatggagattatatgagtcatatttctttttagataaaataaagaaatcatgggataaaatcatgttgtcataattccaatttaccaaaagaaccacctaatgatgtctttttttaaaaggaatctaaattccacaacatatttggctccaagggtttcagataagtggactgtgaaactaactatattttaattttaaagttttattttttaagaaaagataattataccttaaagaagtaaaatacatattttaactaagtaaaagctgattaaatataaaagaaatatataatacaaaatggtagaaacatgattaaacagataaaatcagcacaactggccaaaagtgaatttttctttgcacggagaatatcaagaataaaaactcaaagaggaagaaattgtaaaaatcacattcttaccaaaaatgagtctttactaaatgtccagtataaaagctacaggcttttatcatcaattccggagtcatctaaagtaaataaataattgaaataacaaatattagaaataaatggaatgcacagactacctctgcaagatactcaagaaaaagagagcaatggatgccaagagggaagggaattgggcagttggagacaggaatgggctgaaagaactatatactatttatgttttggaattttgtgtatgtctgtaagctatttttttaagttaaaataacagcttaatatattttcccattatatctcacttagtttgaagagttaagcatcatggcattgttatgataagctatatttataatagtatagaattgcagttctgctgttcactattaaaacagaatgattttctgaatcattctgaatcaaacagaatgatttttttcaaggatataaactgagattctcttttcaacatagaggaattcctcatttaccaagcaggaataggaaaaccacataaatgaaaagtctaaactgtggaatatgcttaaagagatgcaaatttatcacttacaactattcacaataacatgtggcaacagctaactgaaatcatctataccttctgtgcattctttaataagtaaagatattattatattaacataagtattatatgcacatggctactgttaagtgttaatggtgttttcctcttattttgttgcccctttgcttactatatagatatacaaacatatggtcacatctatttggtgtataggtaagtttggttcaaatctataccaacagccaggaattctgaattctacttttctaaggcaaatgttttctcctttgcacattgctgtaaatactttgttaaattaacagatatggcatacacatgttcatcatagatttattttaggcatacaagaaaggcccataggacccccgacatgtgaaaatcctcacttttgatggagattaaatgcaaattatgcctacagtgagggacaacataaacgattcaagtcattcttcactaaattcagatttttatagaagaaaggaatccagatgagtaaaggagtattgaggatattacagcaggcagaataaaaaccaagaaggggatgaggtggcaaaggcagacaaatttcactaacattacaatttttcagtactgttgtaggtccctaaatttcatgagcttaattctttttagatgatattacctgaaaagtcctaaataaataactacagtaaatgatatgtcataaaaatatgagtatattatatgaccaaatgaatgtagttcaaaacattatagtaataatgattttgaaaagaattattaaaattcagcaaataccatttgaactcaagttttcttttctgatgatcaactctttaaaacagcataaaagcattttctattctattattgaaagaagtaatttaaatcctcattaattcatgatttataatacaccagaatttttgttgttctaatattcattttttaagagtttctcttcataaatttttattttaactttacatttattgttctcccagtttgcaagggagggagggagcgagggagcgagggaggggaaaggaaggaaagagagaaagaaacaaactcacaatttttcattattattattattggtatatattcttttcttcacagggaaaagcaagtttaagagagcatctccaagggactaatatgcaagaggactccagcccagtaatgccccattccccacttaggggtgggcatgtgttgacttcactgcagctccaaggaatctctggccaatccaatcactgggcacatgtctggaccacttagtcacatggcttcacttcctccatttatgtttccaccatccacactccagccaatggcttcccacccttcacagtcgctgcatattgtttaactgcttctgactgaaaaatattcttcctctcaccttttaattccagctggcagtgttttgcacagagtaggagctcaacaaatatatatgtattgatccatcaacagaattagaaaactgcttaaatgcaagccaattctccaccatctgactaccacaaatggagggcaaaggattctggtaacaactttgtgggcaagtcagtggataaacagcaagttagtgctggctacagatggcctcagagtaccctcacataacactcacaccactagtgctgctatccccagacacccgtagttacaaacaaagtgagggaggaatggacagtgcatcacaatacgatttctaagagtccaggtacactgaaaggttaatttctagtctggaaataaaagaaaaaattctaccataagagatgatttttaaagttaaagagtgggaatgtgtaaataaataatgaattcgttgcaaaagatttttcatagtattaagttagggtttaacactacttttttaggccagtggcctacaagaagccagttggaatcaactgcaaaacttgtaaactacccaggctcacttcccaagattccttagccctccactcttaccctctctaggaattactgctgtgattagtcactattatgactaagagtatgtcttattcctcatgtacactggggacagaagaatgttaagtcccaaattttaagctgagttccagcagcatacaatagcacacacactagtttcaaggaaacatgtttttatagattaggagagaaaaagaagtgaaatataaaactgatttctttttgaaaagatattatatgtagcatgattacaacccagtcctaaaaaaatagcttataaaaaaatttcattcctctgccagggttggaggaaaataagatttaaaatttcaaacttacagagaaataaaataaacacctaatacccacaatccatgtttaacattgtcaacattctgccatacttgctttttctattttaaagtatataaattaagacatcatgacatttcatcccccaaatctcataatatccatctcttaaaaaatgagtaccttttctttgcaaccacaattccattatcctgccttagacacttaatagtaattgcttaatatcattgtacccatgccatagccaactctctggaattggcctccaaatgtcttacacggtttgttcaaactagaatccagacaaggaccatatatttgcattgcaaactcagttgatgcgaggatttcaatagctacagaaaaaaagttttagtttttccttctccttttctatattttcaacatttaatgagtatgaggtgtggaggtgggataacattggcctaaatctaatggattctgttacctgggcctgtctaatattacattctaaaagtcagccaggcatggtggctcacacttgcaatcccaaaacgttggatggctgaggtgggaggatccctcgagctcacgacttaaagagtagcctcggcaacatagtgagaccttgtctctgctaaaaataaaaaattagcggggtgtggtggcatgcacccatagtaccagcaacttgggaggttgaggtgggagaatcactggagctcagatagaggctgcagtgagcaagctatgattgtgccactgcactccagcctgggcaacagagtgagactctctctctctgtctgtctgtctctgtctctctctctccatccccccatacacacacacatacacactcacacacacagagttctaaaagtcaatttaaatatttttgacagacaagagactaagaaaggtttttttgtttgttttttgtttttgtttttcttttttttcttttcctatgctctgaaagaaagacaagaatggggatggggtggggagccacatgtcatctgtctctgccacctgaatcaggggtctgagtcttagggaagaacaaactgcaggcagaatccaaaagaactgctcctatgaggcacacagcactatttgtgcaatacaaagtgaaggaaaggcattgtgtccagaattggtgggttcttggtctcactgacttcaagaatgaagccgcggaccctcgcggtgagtgttacagttcttaaaggcggcgtgtctggagtttgttccttctgatgttcggatgtgttcggagtttcttccttctggtggattcgtggtcttgctggctcaagaatgaagctgcagaccttcccgatgagtgttatagctcttaaggcagcgcgtctggagttgttcgttcctcctggtgggtttgtggtcttgttggcttcaggagtgaagctgcagaccttcacggtgagtgttacagctcataaaggcaatgtggacccaaagagtgagcagcagcaagatttattgcaaagaatgaaagaacaaagcttccacagtgtggaaggggaccccagcgggttcccaatgctggctcgggcagcctgcttttattctcttatctggccccacccacatcctgctgatcggtagagccaagtggtctgttttgacagggcgctgattggtgtgtttacaatccctgagctagacacaaaggttctccacatccccaccagattagctagatacagagtgtcgacacaaaggttctccaagtccccaccagagtagctagatacagagtgtcgattggtgcattcacaaaccctgagctagacacagggtgctgattggtgtgtttacaaaccttgagctagagacagagtgctgattggtgtatttacaatcccttagctagacataaaggttctccaagttcccactagactcaggagaccagctggcttcacccagtggatctcgcactggggctgcaggtggagctgcctgccagtcctgtgccgtgtgcccacactcctcagccattgggtggtcgatgggactgcgcaccgtggagcggggggcggcgcttgtaggggaggctagggcggcacaggagcccatggacggtgtgggggaggctcaggcatggcggactgcaggtcctgagccctgccccacgggaaggcagctaaagcccagcgagaaattgagcacagcagctgctggcccaggtgctaagcccctcactgcccggggccagtggggccggctggccgctctgagtgcggggtccgctgagcccacgcccacccggaactcccgctggcccgcaagcacagtgggcagccccagttcccacccacgcctttccctccacacctcctcgcaagctgagggagccggttccggccttggccagcccagaaaggggatcccacagtgcagtggcaggctgaaaggctcctaaagtgccgccaaagtgggagcccaggcagaggaggcgccgagagcgaacgagggctgcgagggctgccagcacactgtcacctctcagcatgtcccccactactgtacagcacacagagtacaaggccatcaaatttaatgtgactttaaattttgcaaacttaaactaatgtgatacaaaatatattacaaaagtcttacattatgccagtttttgaaaaaacacaatctttcaaattaaaattttactgagaggtatttcctttcaaagctggtgggaaaacgaattaaaagtttaagtattgccacaaagtggtactattttggcaggtaaacaaatgcggctttagtcttgaagtatgagtttgagttattagcagtcttcagaaaaatacggcatcttgtgaaaagtgtgaccaaccagtgtggtctgagtaaagttggcaggcaagggaaaggaagagtatttggcacttaaggattccaggtgtacagcctggaacaccagctcaggcagacattggggctcttaggaagaccaggttggcagttctagggtccccttcagatggcctcacaggttccagacagacactaggaggaattcttgaatttacatgggatagctttgggattcccagacacaaatgggtagaacttgaagaggaaactgacctcttgtgttatgaagacaggagctagaggcagtgaaatctgggatattcctattaacactgctctactaatatcccaggttggtgagacctggggaagtgttgtagtaaatgaaaaaataatgaaatactattacaaattactgttgacttaacagataccaaatttatggctctttaatataagtagtaattgatcccattaatttttaattttgtaagatatccatttactatatgtaaaaaaatgcatttaaacaacagctatagaaaaaaagtttcagttctataaaatacttaaagtatctagtaaagtattaagaatctggtaagaaccaaatgtaaaataaatgtaaatcattaactttatattataatttttagcttccagcatattgtaatattatttttcttctggcaggcaattcccttttttgctcagttaacctgtgaatcaaaagattatatatgaaattgtcttaacataattcaccatattataaagtaccatgcctttacttcattaatgagcttcatttatatcccacatagtatcattctagaataggggtctccaacccccaggccacagactggtacaggtccatggcctgttaggaactaggccacacagcaggaggtgagcagtgggcaagcgagcattacctcctgagctccacctcatcagccgcagcattagattctcatgggagcacgaaccccactgtgaactgtgcatgcaaaggatctaggttgtgcattccttatgagaatctaactaatgcctgatgatctgaggtacaacagtttcatccttaaatcacccccaccaccccaccacagtccatggaaaaaatttcttccacaaaaccagtctctggtaccaaaaaggttggtgaccactgttctagaataataatagcaaaacagaatggggattataaatatgtgttgaatggatatgcctaatttaaatccctcccaactcagattttttttttatttttcaaaagccctacaagttaataacaatggcaaaaagaagccatgtctttaatacagagagaacatatctttatatatagcagcacggcatggtatgaagtgttgaatttttcatgatgagtcatttttcttatttcttgatcttctgcaaattactgatttatttatttatttatttttgagacagagtctcaatctgtcacccagactggagcacgatcttggctcactgcaatctccactccccggttcaagtgattcttgtgccttagtctcctcagtaactgggattacaggtgtgcaccaccacacgtagctaatttttgtatttttagtagaaatggggtttcaccatgttgcccaggctgctcttgaactcctggcctcaagtgatctgcccacttcggcctcccaaagtgttggggttacaggcacaagccacagtgcctggcccaaaagagtctttaatacctaaagggcttttgtgcctggacagaaacgctcactaacatttgtactttaatgctttttaccaataaacacatatttaaataaatacaattttggaaactcaatgtttcttaaacatgttcatgtttgttaccaacttcattaagtaaagtccctgaaataatttaaactacaattacaatttacaaagccattccttagaacacctaaaatgccataaatagcagacagaatatacataaatatcatatcattattatatgttacacttaaacttatcctaaacaacatgaatctagttcatatcttcattacttccacactttacttaatgttttactccttcctgattacagtaatgtttattttgatgccttatcagataacagtaatgtactcagtttcaaaagaaatgaaatacctttgcagagccaacaaggatacaggatcaaccaactgattatcaaccaactgattcttatttggggcacaggcattgtctgcctctcccaaatgattaaaactccagcccctaagggtcttaagattaagtttcctttccacagttaaactttgttcatcagtaagacttttcaaatccatatctttcatttacattttagggttttttttacacgatgctcctctgtgatagcattattttaaaatattttgtattttattttattattttaaaagacacagtgggtcacgcctataatcctagcactttgggaggctgaggtaggaagatctcttgaggccaggagtttgagaccagctggggcaacacagtgagactctgtctgtaccaaaggaaaaaaaaattagccaggtgtggtagctcacatctagtagtcccagctactcaggaggcagaggcaggaggattgtttgagctcaggaattcaaggttacaatgaactatgatcatgccactgcactccagcaagagtgacagagtgagaccctgtctgtaaaagaatatttttgggcatgcttccaagatggccgaatagaaacagctccggtctgcagctcccagcgagatccacgcagaagacggatgatttctgcatttccagctgaggtatctggtgcacctcactgggactggttggacagtgggtgcagcccacagagggcgagctgaagcagggtagggcatcgcctcacccaggaagtgcaaggggtcaggggatttccctttccaagccaagggaagccatgacagactgtacctgggaaaacggtacatgcctgaccaaatactgagcttttcccacagtcttcgcaacctgcagaccaggagataccctccctcccatgcctggctcggtgagtcccacacccatggagccttactcactgctagcgcagcagtctgagatcgacctgcgacactgcagattggcggggggaggggcatctgccattgctgaggcttgagtagctcacagtgtaaacaaagaggccaggaagcacaaactgggcggagcccaccacagctcagcaaggcctactgcctctatagattccacctctggggacagggcatagtagaacaaaaggcagcagacagcttctgcagacttaaacgtccctgtctgacagctctgaagagagcagtgattctctcagcacggcgttcaagctctgagaatggacagactgcctcctcaagcaggtccctgacccccatgtagcctgactgggaaacatctcccagtaggggctgatagacacctcaaacaggcgggtgcccctctgggacgaagcttccagaggaaggatcaggcagcaatatttgctgttctgcagcctccactggtgatacataggcaaacaaggtctggagtggacctccagcaaactccaacagactggcagctcaggggtctgactgttaaaggaaaactaacaaacagaaaggaatatcatgaacatcaacaaaaatgacatccacaccaaaaccccatctgtaggtcaccaacatcaaagaccaaaggtagataaaaccacaaagatggggagaaaccagagcagaaaagctgaaaattccaaaagacacagggcctattctcttccaaaggatcgcagctcctcgccagcaaggggacaaaactggatggagaatgagtttgacaagttgacagaagtaggcttcagaaggtgggtaataacaaacttctctgagctaaaggagcatgttctaacccatcccaaggaagctaaaaatcttgaaaaaagattagatgaatggctaactagaatgaatagtgtagagaagaccttaaatgacctgatggagctgaaaaccatggcatgagaacttcatgatgcatgcataagcttcaatagctgattccatcaagtggaagaaaggatatcagtgattgaagatcaaattaatgaaataaagcaagaagacaagattagagaaaaaagagtgaaaagaaatgaacaaagcctccaagaaatatgggactaggtgaaaagaccaaataaatatacatttgattggtgtactggaaagtgacagggagaatgcaatcaagttagaaaacactcttcaggatattatccaggaaaacttccctaacctagcaaggcaggccaacattcaaattcaggaaacacagacaccaacacaaagatacgccttgagaagagcaactccaagacacataattgtcagattcaccaaggttgaaatgagggaaaaaatgttaagggcagccagagagaaagattgggttacccacaaagggaagcacatcagactaacaggggatctctcggcggaaaccttataagccagaagagagtgggggccaatattcaacattcttaaagaaaagaattttcaacccagaatctcatatccagtcaaactaagtttcataagtgaaggagaaataaaatcctttacagacaagtaaatgctgagagattttgtcaccaccaggcctgcattacaagagctcctggtggaagcactaaatatggaaaggaacaaccggtaccagccactgtaaaaacattccaaatggtaaagaccatcgatgctatgaagaaactgcatcaattaacaggcaaaataaccagctaatataataacaggatcaaattcaaacataacaatattaactttaaatgtaaatgggctaaatgccccaattaaaagacacaaactggcatactggataaagagtcaagacccatcagtgtgttgtattcaggagacccatctcatgtgcaaagatgcacataagctcaaaataaagggatggaggaatacttaccaagcaaatggaaagcaaaaaaaagcaggggttgcaatcctagtctctgataaaacagactttaaaccaacagagatcaaaaagagacaaagaaggccactacatattggtaaagggatcaattcaccaagaagagctaactatcctaaatatatatgcacccaatacaggagcacccagattcataaagcaagtccttagagacctacaaagagacttagactcccacaccataataatgggagactttaacaccccactgtcaacattagacagatcaatgagacagaaggttaacaaggatatccaggacttgaactcagctctggaccaaggagacctaatagacatctaagaactccacaccccaaatcaacagaatatacactcttctgagcatcacgtcgcacttattctaaaattgaccacataattggtagtaaaacactcctcaccagatgtaaaagaacagaaatcacaaaaaactgtctcgcagaccacagtgcaatcaaattagtactcaggattaataaactcactcaaaactgtacaactacatggaaactgaacaacctgctcctgaatgactcctggctaaataaataataaaattaaggcagaaataaacatgttctttgaaaccaaggagaacaaagacacaatgtaccagaatctctgggacatatttaaagaagtgtgtagagggaaattgatagcactaaatgcccacaagagaaagcaggaaagatctaaaatcgacaccctaaaatcacaattaaaagaactagagaagcaagagcaaacacattcaaaagctagcagaaggcaagaaataactaagattagagcagaactgaaggagagagtcacaaaaaacccttcgaaaaaccaatgtatccaggagctggttttttgaaaagaccaacaaattgatagaccgatagcaagactaataaagaagaaaagagagaagaatcaaatagatacaataaaaaatgataaaggggttataaccaccgatcccacagaaatacaaactaccatcagagaatactgtaaacacctctatgcaaataaactagaaaatctagaagaaatggacaaattcctggacacatacaccctcccaagactaaatcaggaagaagttgaatctctgaatagaccaaaaacaggttctgaaattgaagcaataatagcctaccaaccaaaaaaagaccaggaccagacggattcacagccaaattccaccagaagtacaaacaggagctggtaccattccttctgaaattatttcaatcaatagaaaaagagagaatcttccctaactctttttatgaggctagcatcatcctgatacaaaagcctgatagagacaaaactaaaaaagagaattttaggccaatatccctgatgaacatcaatgtgaaaatccttaataaaatactggaaaactgaatccagcagcacatcaaaaagcttatccaccacaatcaagttggcttcatccctgggatgcaaggctggttcaacatatgcaaatcaataaacataatccatcacataaacagaaccaatgacaaaaaccacatgattatctcaatagatgtagaaaagacctttgacaaaattcaacagcccttcatgctaaaaactctcaataaactaggtattgatggaacatatctcaaaataataagagctatttatgacaaacccacagccaatatcctactgaatgggcaaaaactagaagcattccctttgaaaactggcacaagacaaggatgccctctctcaatactcctattcaacatagttttggaagttcttctggctaggcaatcaggcaagagaaagacataaagggtattcaattaggaaaagaggaagtcaaattgtctctttgcagatgacacgactgtatatttagaaaaacccattgtctcagcccaaaatctccttaagctgataagcaacttcagcaaagtctcaggatacaaaatcaatgtgcaaaaatcacaagcattcctatacaccaataatagacaaacagagagccaaatcatgagtgaactcccattcacaattgcttcaaagagaataaaatacctaggaatccaacttacaagggatgtgaaggacctcttcaaggagaactacaaactactgctcaacacaataaaagaggacacaaacaaatggaagaacattccatgctcatggataggaagaatcagtatcatgaaaatggccatacaacccaaggtaatttatagattcaatgctatccccatcaagctaccactgactttcttcacagaattggaaaaaactactttaaagttcatatggaaccaaaaaaaagcccacatagccaaggcagtcttaagcaaaaagaacaaagctggaggcatcatggagacttcaaactatactacaaggctacagtaaccaaaacagcatggtactggtaccaaaacagatatatagaccaatggaacagaatagagacctcagaaataacacaacacatctacaaccatctgatctttgacaaatctgagaaaaacaagcaatggggaaagagttctctatttaataaattgtgctgaaaaaactggctagccaagtgtagaaagctgaaactggatcccttccttacaccatatacaaaaattaactcaagatgcattaaagacttaaatgtaagacctaacaccataaaaaccctagaagaaaacctaagcaataccattcaggacataggcatgggcaaagacttcatgattaaaacaccaaaagcaatggcaacaaaagccaaaatagacacatgagatctaattaaactaaagagcttctgctcagcaaaagaaactatcatcagagtgaacaggcaacctgtagaatgggagagaatctttgcaatctactcatctgacaaagggctaatatccagaatctacaaagaacttaaacaaatttacaagaaaaaaacaaacaaccatatcaaaaagtgggcaaaggatatgaacagacacttctcaaaagaagacatttatgcagccaacaaacatatgaaaaaaagctcatcatcactggtcatcagagaaatgcaaatcaaaaccacaatgagataccatctcatgcccattagaatggagatcattaagaagtcaggaaacaacagatgctggagaggatgtggagaaacaggaatgcttttacactgttggcgggagtgtaaattagttcaactgttgtggaagacagtgtggtgattcctcaaggatctagaactagaaatacataccatttgacccagcaatcccattactgggtatatacccaaaggattataagtcatgctactataaagacacatgcacacgtatgtttattatggcacctccgtcgccgaggccggagtctaatggcatgatctcagctcactgcaacctcagccttcagggtctgggcaattctcctgcctcagcctcccaagtagctgggattacaggtgtgtgctaccatgcccaactaatttttttgcatttttagtaaagacagggtttcaccatgttggccaggctggtcttgaactcctgacctcaggtgatccacctgccttggcctcccaaagtgctgggattacaggtgtgagccactgcacccaacctgaatatacacatcttaaaagcaaaaagaattgcataatcttcttaaactgcattcagtagtctttttgttagtggttctatggtaatgttattcggaaatcattatatgcacattgtaggatacaattaatacagaatgatattaagatctctaggagtcaagattcattaaaagtgggtcaaccagatcatgtgtgcctccagatgtgatgcactaggaaaaacacaacacctctatgcaatattattgtccacacaaaatgttggtaggggggaacctgaatgaaatcaagcatctagatttaactaccagcttgcatgaaatacgggaaacagagtaagtaaaatgacactagaggaagcattgagaacctgggacattttacaagacaaattacccgtttccttcaataaataagtcgcatgcagaaaaaataagacaaggagaattcttgtccattacaagagatgttagataaataacaaccaagtgcaatatgtagactctgtatgaattctgatttgaacacagccacatgtaaaaagacatttttgagacaatctgggaaactaaaatatagaatatgaatctgaatataatcaggactagatgacattcaggaattattgttatttattcataagacagtggcactgtgtttctattctctaaaaatataatctcctattagagatgcacactacagtataatataatttctgggatttgctttctaatactccagcaaaaatggaggaagagagaataaattaacaagattggcaaaatgctgattattgttcaagttagatgatgagtgatcattatggtattccttctacttctgtgttatattaaaatgtttccataataaaaagattttttaaattttatatatgctttctcttgtagttagaaggcccatctggagatttcatttcctaagaaatgagaaccaagtctgtgaagttcatttcctccttacaatggttgattctttcatcttggaatgcttgaaacaatgaaattgtctttccttctactattatgagagcagttcctactttttctttactatttggcttactcacagtttcctgtattcactcgtctttaagtagagacatatttatcctttataaataggcaatgataaaagaaaaacttcagccgaattaaatgtaaaggaatttaattgagcaatgaataatttgtgaattgggcagcccccagaatcacagcagattcagagagactccagtgcagccacatggtggaagaagattaatagacacaaaaagggaaatgatgtgcagaaattggaagtgaggtacacaacagctggactggttacagattggtgtttgccttatttgaacacagtttgaacactcagcagtgtatgaatggttgaagtatggctgctgggattggccaagactcagctattgatacacgtgcatactcctagttaggttttcaatcttgtctatctattaagctaggttgcagttcgtccacaaagactcaaatatagaaacagggaatccttctcaggccacatttagttcactttaacaacttcccccttttggtcattttctcaattttgagagattgaccaaaactttaattatcaatgtcactatcaccattgtaaaagtacttatttggtcttgaaacatactgggaaacagtagaacattgagttttgcaaaggtaaaaacaagtatgagtagagggaccctttatgggtacctctttatgctggaatgtcctatttacaggagaaaaacaaaacctggtctgttctaggatctatgtgtttccgtaaagtcttagtttgattatgtcacatttagcataagtgaccccattttagtttggtttggcctgttggggcctagtgaatgagcttagtccaaaacagtggcctcccacaactttgtttaaaaaagattcccccctttttggtcaggttctcacttaggtgaaagtgtgaccaaaacttagggccttagtgccactctcagttaccatcattttgggtttccagtctcaccacgtcattcataggttatagtaatctcatggtcgcacatttctttcagctcgtctttccatttgaagagagaccatttgacattctagaggtggctgcatgcaagatttaaaaccttcgagagaatacagtgcaccagggagactattattatgactctcaggaggataataccaagagtttagagtatgctccttacccagggtacccataaaccgaaccacctaaaattaaatagattaaagaatgagctggataaagagtctacttgctttaagtggtcttttcattaatcatctacaactgaatttttataatctacgtttgatgtatttctccataggccacaagtgtcagaagctgcacaggtacttttctgtttagccaattatattatttagcataactttcacaagagaatttaaagtctgttgtgtaacaataggctttacattagaatctgctatacagcctatcatgagggatacatttctaattattgcctcttttattctaaaccatggaaaaaggacctaacaaatgatgtccttctagaagagtgaaggcctcctggcaatgttctatttaacccatgatgtgggctaagaggagttttgactgattatgaggcgacatatataccattaaagtttctcacctatgttgggccttcatcttttatccatcaaagtataaagttattcatgtataaggctggtgcaaaatccttcacgaataaaagtataccctataagtgcacataatagaccccctcatcatttctattggctacagaggcataaataaggaaaaaatattcaaagataagagtctcacaatagtagatgtcttgatctgtgatctcgggaaaagctgtttacatcaaggatgccatcttattctggggagaaactttcctggttagttttaccttaagggttccaatgggtgtacagttccaatagtgtggagggacccttctcagttgtgagattatgaacttaaagttcaaggttccaaagttttgttgcagtgtggatggcaagcacagtctttctctgatgttctcaaaagatccagtctttaggttctagactgtgaagcagttgattatcctcggtgaaccataaaaactttctttacctggtgaaaatatactgtggcgtaataattactgtagcataaaacatgcattaaaaatgacagttgaatgaactccctttataaatgtttaaatgacccatcggatagccaaacgtacctgatagccaagcgtacatgaaggtttgattgtcttcccaggaatatggaaccaaacattggttttaaactatttttgaaatgtataagtcattatatcaatatattcaatttggatgattttatcttttccatgatgagtcatggaatgcagagcctttaataacaaaagctttaagggctcaggaaggacaagatagccttcctggtcttccatgagtctatgcttaatattggacttatgtcctgttgaataccagttgtttctccaatttaaattcatagcactgataactaatggttatcacaggtaatgagacttagactatggaattcaaattgtatatctaatcaatttcactatcggctggtttaacatgaaaatcttggcaaagtattttcttggtatttaattaattttttgttttacttgggttagcagttctatacaaggaagtttggttatttctgtgatatacaataacttaacataataactataattatggttgacagtatatactcagacatattagaattttataagtcctatacatttttttttgtttgtttttgagatggagtcttgctctgtcacccaggctggagtgcagaggcacgatcttgcctcactgcaacctccgcctcctgggttcaagtgattcttccacctcagcctcccaagtagctgggcttacaggcacccgccaccatgcctatctaactttttgtacctttagtagggacggggtttcaccatgttagccgggctggtctcaaactcctagcctcaggtgatctgccttcctcggtctcccaaagtgttgggattacaggcatgagccactgtgcctggccccatacaattttagaacatacattaatatcattcactaaaatataacctgaagattaaacattatttttattttgacaatgcttcccatgtaacttaacatgttaaataattctgtttacctctcttttggatgcttcaggggccctctgtagcgttccaaagttagaggtcagaaaagaccattttaaagctgaaatttaattttgggaagcctattaaatataaagatatatatataaagttttaaaacacttgatattatgaactagaattccaggtcactgtaagtcactcacttagccaaaatgatgactcaaaaaattttttaaaggcaaaaacctttactcattgatagagggaagactcagctttccaaacaatctgtcttttgtctttcctttcttttttttttttttgatagtgtatttaaaaggcaaacaaaacaaaaatctttcattaccttttaatattacatgaaaatcttgttcaagagagaaagccaaatttcacccttgcattagtggactattaatgtcaaccccaatttttaataaaacctcacagacaaatctatctaatcttaatcagtttgaccataaggtgagattttcataaaccttttataaccctttaccaatttttattaaagagcagattagtgctttaagaaaaccctattatgcttttatttcaatgttcaatttacagaaaaactgaacaatacacttttaaatttagtcaatattttcacacacagaatttcttttacaaatttttacaaaccttccacaacttgttcaaacctttagctttattctatttaatttaaaacaatcctttaacccattaaactaggtaaaaatttacattcccatgcattcttataatctcttaccaaaaacatgtttcattctcctcacacaccttgcgtgtaaacctagtttttcagtagtctcaatcacatgttataatggtaattcttagcaactttcacttttggtgcataaattttcttttatgaatcctttcacgacttacacagaccatctacaacatgcttggtctttctgacttgtcctaaacatccctctttttaaacaaccagtcattttactttaggacaagaatttactctacaagatcctttcttatataaaatctcttttctttataaccttcttttcatagctaggtggcatggctaattccacatatccccaggacttatttagaatgtaatgtctccaaaataaattcaacaattttcaaaggtcaaagcagtttatggccttaaacatattaagcaaacctaatatctgacctgcataatttagactaaatgtctttattttatcaataatctttaaagctgtttatatttcccaaagatgacttaagttacatgaactaaaaagcattacagtttttctttcaaaatatttaagcacttatttttgtttaaaccaatgaattagagttcttttatacaaacattacacacacaacacatatataactacacagacaaaccaaagaagattactacagtagttgtaagattttccattcaccagtttttaagtttcttaattagattactggctttggggtggagtcctcgcaagaacagggccaagaaaggatctctggtgcctcctgtttttcccaaggagtcccaggctgtgagagcttgaatatccacttttaattaagctgacttttaaccatagcactctttaataaagtccttttaaaatttcttattacccgactttagccaggccaaagagctgatatttctggcttttaaactttacccaaggtaacctcacaggtgctctgagaaaggaaaattcaagacagttggtggaggggaagagaatcaaaaaatggcaaaggtcacccaaatatcaatcagaaaggctcatcccctaagctagggattgaactctgaacccaggccaccattgtgaaaagagaaagcatagccacgtggctacaaggtcaagcgcctaagcacataactgaccagtttgctgggtcgtcttgaacaacaggcttatgaggttttgggcacacattttatcctaaggtacccctctttatgacagaacaatacagaaagacacacaaagcacatcagattcactacagcttaagagaagcctcagaattttttttgtatcaatcaaaactttacacgggagataagagtaatttttgccattcatttaaccattttgcacaaagaaaaagaggaaaaaagccagaaatatgactggtaagaaattcttacccttttactagcatgccaggcttctgggctttctttccctttccctgagcagccctagcgtcccagcttgccacaccatcgccctgggggccaagctgcatcataaaggaaaattaacttttttcgttttggccagaacaaaacacatatgataaaacatagacattagccactctgcttagcacccaatatcaaactggtaaggcttaaatttgccttcagatggcccctgtcatctttaatccaacctccaactaggagtttcaacacatggtctctgggcaagatggttgccctgagtaacagaaaagataggaaaggaaaggtagagaaagaaaagtattgcctgtggcaaggtggggaaggtgaagagctcagggaggccagagcaagacccactcattgcaatgacactgaaaaattcaggcggccacttgtcagtagtgaaggcatcttttccagcaatcccatcagctctcaagtttccccttttggggaggaaaaagcttcccatgtcccatggtcctgtacatgcctaatactgtcacctatagccgtcagcaaaaagtacaagacagattaatcaaaagagaatagcagttaacatcccatagcgccaaacctgttcttaactgaaagagactttactgagaaccctcatttttaaacacacttcattgctttgttgctcatttggaacattccactgtaagttacctttagtaagattttgtcatttctctaagactatgctgcctcccaggcctaatgtataagctggaaggaacttagttttccagaaattaaggatctcatttttacctaaaatattggcttgattctcagggtctcttgattaactgagccaatgatttttcctacctaagcatgcaagaaaaatgaaacaaaggggtagaacataaaaattcctgtgaattttcaaaagccaacttttataacccctgcaatattactgcttactatcagttcctttctgaaccagtcaggtgtaagagacctctaactggatccaagccaattaattcccagatcaaatccattcctggacccagctgagtttctgtcgtgacttccaaaccctgtttggatcagaaatttgctcaaagaaactcggagagctcaaaacacaaatccatggagctctgaaatccgagagagagcttacccacgatccccagctgctctgagagatcagtgaacacaagtgggtcctgcaggtaccttgtttgttcagttcactcaacgctcctggggtcgctagaagctctacctcagatcccatttctgacaccatctgataaaagaaaaactttagccgaattaaatttaaaggagtttaattgaacgatgaacaatttgcaagtcaggtagcccccagaatcacagcagattcacagagactccagcgcagccacctggtggaagatttataaacaaaaaaggggaaatgatgtacagaaattggaattaggtatagaacagctggattggttacagattgatgttttccttggttgaacacagtttgaacactcagtagtgtatgaatggttaaagtacggctgctgggattggccaagtctcagctattgttacaggcacatactcctagttaggttttcaatcttgtctacctattaagctaggttgcagttcttccacaagaactcaaatacagaagtacagagtccttctcaggacatatttagatcactttaacagcacatattggcagtcctcactgtgcagaactgtgtagtgtaagactgaaaaaccctgcaattaggcaatccacaattaatgggaaaaattatagttattcataacctttgaagttttttgttgaaacattaaaaatcattttactgccagttataacggtatggaaaaccacataggaaaggcatatgaaaaaaagtaaaaccaatattcatttagtatactatacattttttttaagagatgaggtctcactatgttgcccaggttggtttcaaactcctggcctcaagcaattctcctacctcagcctcctaagtagatgggagtacaagtgcatgccactgtgcctggctttagtgtatatactttaaaatatcaaaaatattgaggactaaagtgttttgcttctttgtaaaaaaaaaaatttcatttttctctgacggtggaggagaaattaatgtggatccaacctaggttgagccctctaacaagcaaccctaggacacttggagattcacattttcatgtctaaccttaacaaatattttcgtcattgcttttgcaaagtcatatctcatttttattatttccaacttattatatgaagtggacaccttttctatgccttggcaaactgtcataactctaagtttggatcagcttctaatattttaacttttgcattttcaacatcatgaaacatctctgacaattccttttctttttttttttttttttgagatggagtttcattctggtcgcccaggctggagtgcagtggcacgatctcggctcactgcaacctccgcctcccaggttcaagtgattctcctggctcaccctcccaagtagctgggattacaggcacccgccaccacgcccagctaatttttgcatttttggtagagacaggatttcaccatgttggccaggctggtctcaagctcctgacctcaggtgatccacccgcctcagcctcccaaagtgctgggattacaggcgtgagccactgcgcccagccgacaattccttttctaataaaactttaggtttgaagtagctatgatgtctcttgaaattctctacaggttttttgtttgtttttgttttgttttgttttgttttgttttttgagacgaagtcttgctcttgtgtcgcccaggctgaagcacagtggcgcaatcttggcacattgcaacctccacctccttgattcaagtgattctcctgcctcagcctcctgagtagctgggattacaggcacccgccaccatgcccaactaatttttgtacttttagtagagacagggtttcaccatgttggccaggctgctctcgaacttctgacctcaggtgatccacctgcctcggcctcccaaagtgctggaattacaggcatgagccaccgcacccagccagaattctctgcagtttttaagtgattccctacgggcttctagctggacactggacacagcctgattttatataaggtctttgtcgtaatattgacaatagggtttaccacgctaaatcagtggttttcaaaaactttagcatattttagcaatagttgtcaagcttttctcaagcaaaatcatactgaaaccaaaactattctggagtataggagtaggcatacacaacccagaatcctgtcccctaggcctctccctcagctcctgaggttgtccccaaacagctccaaaaacacagtaatttgcagatatctgcactccataggtcaaaagtctgtggttaataaagtactataaaaacacctacacaccatgatgcagatcaagtaggatgggatacatgggttctgcccagtgtactggcacctcagaatcatctcatccctctaattctgtttctctgttgcagaccactgattaggatccagtgttactctccacccatccttctaaacagatgcctcaaattgtttttgcctctcagcccccaccttgaacatggctttgattccacttttcaacatccaacttcagtagcaactccaagtcctgcctggacctaccagacaacagccctgtaatcaagagatatcatgcacgggccaagcacagtggctcacacctgtaatctgaggctgaggcaggtggattgcctgaggtcaggagttcgagaccagcctggccaacatggtgaaaccccgtttttactaaaacacaaaaaattatattttagtggcgtggcagcatgcatctgtaatcccagctacttgggaggctgagacaggagaatcacttgaacccgggaggtggaggttgcagtgagccaagatcgcgccattgcactccagcctgggcagcagagcaagactccgtctggaaaaaaaaaaaaaaaaaagagagagagttatcacacatggttccacacatatctaatttgtgttagtatttctctcttcatgtgccttttgctctgttagcctctcttaaacatttatctttgttctaaagtcttcatgtcctaaattacttccttgccctctttacaggatcaaaactagctgctggtaccagttttcagtaacaatgagatctgtcttttaagttggatgtcaataatattttggtcatgtcattacgagcatgattccctgtaacctaatctgagaaggcagacagcagagagaatgggcggtggaatggaacacagaaggaagcagattagaaaggaaagaaaacatcctcttgtaaagctttccataattctattttcatctttataaagatgcacgagaggagaaggaggagaaagaggaaagggggaaaacttaatggaaagattttataagagaaggaacaaatgcctttgtaaatactttctggaaatttgggaaggttactatgaatgtggctttgcatgcgtctgtgtatgtgtgtggctattccttcacttttctcggtgcccccaacaacaaaaacagtctgacctcacacctcccataaatataaaatctacttggaaaattccatcgaagtttaaaatatatatttgcgtattcttgattactaataattaccagctgatcatccaattcaaaaagttgttccaggtaagtttcagacaatcttcgaatgtttggtttcattgatggagtaatgcacatatccctttaataacatcataaaatacagtcaaaattaatttcattaattagttagttccgtaattaaatcagtgattcttgtaggtggaatgaaagggaggagaaggaaaacacatttccccttaggagaagcagatcagaatcacctggaggactttttcaaactactctcgcaagattttgctgtgtcccccaaaggaggatatgcctccctttcctctttcccaacttgaaataaaccggccctatgaacacgttactgataagaatacaccgtatttctcaggttgagatctagtgggcaaattattcaggtttgcgtctttgaaactgaaaagcctgtggagggattccttaacaatcttgagattggaagcattcattggcaagaccttattttgttactatgcaataaaagttttccttcaaaataaaatatttccctatcaaaaatcaaaacaatacttaccaaagaagattctgaagaccacttttgattataaccatgatcattccctctaaatacctcagcggatcctcaggacatgtaacaagtataccacataacagtgcctaggggaaaaaagggaaatggcatcaatgtttctgaattttcacgtttttactaagcagcacgtaactttttattgttcaatttgttttgggtttttttggtttttaattatttatttccataggtttttggggaacaggtggtgtttggttacatgagtaagttctttagcggtgatttgtgagattttggtgcacccatcacctgagcagtgtacactgaacccaatttgtagtctttcatccctcaaacccctcccactctttcccccaagtccccaaagtccattgtatcattctatgtctttgcatcctcatagtttagctcccatttatgagtgagaacgtataatgtttggttttccattcctgagttacttcacttagaataatggtctccagttccatccaggttgctgtgaatgccattaattagttccttttcatggctgagtcatattgcatcatatatatatgatgtgatatatatatctcacaatttctttattcaatcattgattgatggacacttgggctggttccatatttttgcaattgtgaattgtgctgttatagatgtgtgtgcaagtatctttttcatataataacttattttcctctgggtagatacccaatagtgggattgttatcccactactgatcaaatggtagttctacgtttagttctttaaggactctccacactgtttactagtttactttttttttgagcagagtcttgctcttgtcgcccaggttggagtgcaatggtgctatctcggctcactgcaacctccacctcctgggttcaagcgattcttctgtctcagcctcctgagtagttgggattaaggcatccaccaccacgcctagctaatttttctatttgtagtagagacagggtttcaccatgttggccaagctggtcttgaactcctgacctcaggtgatccgcctgcctcagcctctgaaagtgctgggattacaggcatgatccaccatgcccagcctagtttacattttcaccagcagtgtagaagtgttcccttttcactgcatccacgccaacatctattttttttttttattttttgattatggccattcttgcaggagtaaggtggtatcacattgtggttttgatttgcatttccctgatcattagtgatgttgagcattttttcatgtttgttggccatctgtatatcttcttttgaggactgtgtatccatgtccttagcccactttttgatgggattgcttttttcttgctaatttgtttgagttctttatagattctggatattagtcctttgttggatgtatagattttcgcctactctgtgggttgtctgtttactctagcagcagcaaactttttcttatacagttaaaaagtcaaataatgtgacagttttaaagtaaatgtgtttttacatacccctctgtatttattcagtgttaatattctgctaaagtaaaacaaaaatgcagtttatcttgcctctttctaaaaatccatcataaacaatacaataaagtcactgtaccgtgagggtttgcattacttgaggagtaagttctttatagccaatctgaagacataactatgatgctttacatcagggttttctagccttttaaagtatgagaaactcattggggttggggggggttgttttgttctgttgttttgttttgttttgtttttgttttgccaaaaagttccttagacccaaccataaaagagattgagaaaatccaccattaaaatgtgtgaatttaagaactcttaaaaacacatttgtattttatcattcacaacatctaccgagtatatacatttgaaaaattgtagcttagtacacataggtgggaaacaatggacttgctggatctaagatactgtttaaagcacatatgtggaactcgtaaagttgctgctgtctcattttccttatgaggtccccccaaaagaagaaacttcttgttaaaagtgtctgcaagatatacagaattactgatgttttctccatttgagacagatgaaaaggtctgcagcacacttcccacagaaaccacctggaattctccatcggcatttctctttccctttgtggttcactgttttctggtggggtctagtgtgcatgttgggggtggtcgggatgcttcagacccactcctgctggcttcttctcttgatcctctatttccagaataaaataattccatcacttgagttacacagagcagttctccctacctccataggccaagtgtcagcagatctaggcctggggtcttttcttagactctcagcaattctcatactgttcctccaaaactaaaaagggtaatttctcctaattggaccctgcataataacaatctccccctttgcaatggctccatgctcctcttcttagtgtacagccttcaagcaggaagctcagtcctttagagaatggcagaaaggtaagatttagatccctctccctctccagctctgccttcagaccaagcccatagtaactgcttacaagtgctcagccacctgcagactgacttccttttcccccaaaccaagagactatagttgcacaggagattagtggtctcaccacagttgcaacctgaatttggacagtcatctattacctaaagagccagcaagagtgggtcctacagggacctaacaaaaagggctgaagccatctattatctggaggccaatcagacttcccacagctccctcaatatccttggtgaaaagcccatctgctctctagcacttctgtgcctgggtctccagagtactgagtttttgtattcctcactctacatccttttctccatcttattctggcaccctgaggacatctatatcagaatcacctggagaatgaatttgtctctgagaatagggcctagaaacctgcattttactaagctccccaggtgattcctatgcatactgatgtctgagaatgagtgcctaaatgaagttcagctttatggtacatttttaagaaagttgagatctggttaatgtatgtgagaaattgattatatatatatttccaagctccacttataataaactacttttcctgaaaagctatcctgcagaagtcaggttgagaggataagtctctgaaatgctaataaaggcatatggaactagcagagttgaaatgcacacttttcacataggaaatctcactgttggccaggtgtggtggttcatgcctataatcccaccactttatgagaccaaggtgggaggtttgcttgaagacaggagttcaggactacccggggcaatacagtgagaccccatctctaaaaaatacaaaaattgttttaaaaattagctgagcatggtggcgtgtgcctgtagccctagctacttgctaggtgggaggtgggaggtgggaggattgcttaagcccaggagttcaaggctgcagtgagttattatcacaacactctactgcagcctgggtggcagagaaagaccttgtctcaaaaaataataataaagaaagaaatctcactgtttgtctttttcccttggacaaaatagcacagcatgatattttttgtattaatgagtgaacagcgcatagctacatgccaataagacagcagttaatgaatcaatagctttttccctgcccaatgaaaataaaaatcacaaaaccattaacttagtctttattgtaagcagaagcaaaataaacattcccataagattaacgtttgactctcaaaaacattaatcagggccttattattaataatattctcagtaaaaacttacacaatcaaggacaaaaaagtccatgagttaattattggattagctctctcaagcttgtaaattcacaaagcaattacgtaatcctcagtttcttttggctctacttccctacactcagttcccaatatttctcatctattctgaaggatgttctgggtcctgaggacaaacatgggtttaaccaggactgttgcttccactcctttctcctgctacctatctttcaaagagcaagataatgcaaagggtggagtccacttggtttaaatctgggatctgcaatcttctaccatgcaaccattgacaaattacgtctgtttccgtttccttaaaaaagggggataataaaggttcatacgctatagggctatcatgaaaattaaaaactgctttgaatagtgtctagcacaaaataggcattcaacagataatgatagcaagatattttatatatatatatatatatatatatatatatatatatatatatacttttttttttttttgagacaaggtcttgctctgtaacccaggctggagtgcagtagcacaatcaacccagtgtaacctcaagctcttgagctcaggcaatcctcccacctcagcctcccaaggagctaggactacaggcatgagcccccaaactcacttaattttgttgttgaaatggagtctcactctgttgcccaggctagtcctgaactcctggccttaagtgatcgtccttcctctcagcctcccaaagtgctgggattacaggcatgagccactgtgcctggtccatcactatttttaaccattccactgttaattatcaccttaattagaggaaaacacttggacatagagaaaataaattgaaaatattcccttgtaccactcaaagtccagtgtgatgactgagagagaaagacagagactgactctgacttaaaccacacctaatagaagatgttaggacaaaagcatttaggggaaaatggctaggagagaactgaatagaccaatagttcaaatataaatagcaagatagtaactattataacccttggtggacacacaaaaacaaatgtaagacacttaagagaacaagtcttgcttagctttttagatactcagataaacatagtgaaatacgctgagggctgaaatagtaatattataatataaaaaataattactccaaaagtgcagagataaaagtgattatcaaatacttggggaaccctcagcaggtgaagaaacagaaaaacattgttcaaagtcccttccatttccctatcccctaccccaacctctgaaacatatctaaagcagtatctcacaaatgattgccatccccctgtgggacggagatggaggtagcacgctgttgttttgggagatatcttaatttgtatttatggaagttagtaagtcacaattttgaaaataaaggggcttttatgtctttttaacattgaaatagatggtgtcaaaattttattttagaaactctataaatgaatattccggaagattactgaaagaggccaactagcttcaacattcagatgagaccccaggaagaggaagatgcccctcaggaccagacttgaagggttttttttttttgtttttttcttttttgttttttgttagacttgaaggtttttaaagcagactggacaggacaggtgaggagcagcaggctctatgaggtaagagtgagacaaaggactctgatacctgccggactgggcctgtcccagaggggaagcagtcccagccgtctcatcccctctaagaaaattgttattggaaaattaataaatcatgtgcttttctttgtttagtgtcctgtggatttacctcaggaactacacgtgtaaactgcctggctgggctgagggaattcagcaaaggtaactgtcctctggagaagccacagccttcctgcccaaggtccagcaaaatgagttagtgtatccagctcctcctctcctaaatgggcagggcagtcccttgctcaagaatcagcaatttctgattcttgcatctctgacaaatacgtgcagcaattagtctcttaaaaaaaaatacctggcccagcacggtggctcacgcctgtaatcccaacacctgggaggccaagacaggcagatcacgaagtcaggagattgagactgtcctggctaacacggtgaaaccccgtctctactaaaaatacaaaaaattagccaagcatggtggcaggcgccggtagtcccagctactcaggaggctgaggcaggagaatggcaggaattcaggaggcggagcttgcagtgagctgagatcgcgccactgcactccagcctgggcaacagagcaagactgcgtctcaaaaaaaaaaaaaaaaaaaacctgattggcaacttaatcttgaaagaaacataaaacataaaaacttctcagaaaaatcataattaccaaaaaaaaaaaaaaaaaaacaaacctttgctttaaaaccataatttgtagattaagtactccctctgctgagcagatctggttttgcaaactcttttcatcttccctaaatgctaaactgaaattggagctcaccatttgaagagtactttcttcctctcagatacaatcactaggtgtatctgcttaatgtttttgtagaccataatatctagctcatctttggtccctgtggggcagtccttgtttgtctgtaaacaatgtactgacttctacctagtagaaaattgagggagaaactagggtttctatgttatttctggatgacccactgtctgaaggtctaccaataaggctttattatatgagttcctatcttaataatctctttcaaaacacaaatgcctttgggaaggagtatatccaaaaatagagggcacattaagctaattcccacagtggtggaaagagtatctcagagttctgagagacagaaatgaagaatacaaggagagtgagggatcgcaaggcaatacttagttttcctacaatttctacctatcttcaggtgacttaaaaaaaaaaaaacctctgaatttctaaaatatatttttcctgaatcttaatgatgaaatgtaaatatcttcatctctatttctccaagatagatttctatgaaaatatagaatcaaaaggtatatattacagatcttcatacatatctcaaaactgttttcccaaaaggtattatcaatgtataatctcatcccaaatggataaatgctcagagagctcaggagacaagctcaggctagggacagcctcagagttacagctccaagtggttgaagccattgaggtgttttcaactagcacgtggtagagacccagcaaatatttgctgatagaatgtcctagtgtatccccctcagctgaccactcttgctgttccccaggagaaaagactggctggtgtcaagagcctcatctgttcaaaaaattaagttacttgtttaacttgaattgaacatagaatccagtagtctttaagttggacatgtgaatctccaagagcccacaaagacttttgaaggattacatgggcaagaatagtataacggagtccactttcagatcttcacctttcctatgcaggttggccttctatatccatgggtcctgcatccatagattcaatcaaccacagatcaaaaatatttgaaaaaaagttttatctgcactaaacacatacagaatgtttcctcttgtcattattccctaaatgaaacagtataccatctacttacatagcatttacattgtattagatataagtaatctaaagatgatttaaagtatagaagaggatgtgtataggttatatacaaatgctatgccactttttatcagccaacatcagtctccaaggaaggtcttggaaccaatcccccatggatactgagggattactgtattctttacttaaactgatctgcctgaggacacagtttgctattttctttttctacttttctctttcacaatggctcttcctcccactctagaaaataaagccctctatcacatccatctggaatcttactataaagaaaactgaagcagagagatttggaaattttctcagtcacccagttaacaattggtgaagcctagaatcaaacttaggctttttttttttttttttttttctgtagagacagtctctcactatgttgcccaggctagtttcaaactcctggcctcaaggaatcctcctgcctcacactgccaaagtgctggaattacagtcatgagccatcatgtggggcctaggaaggtcttacaaataagaaataatcccctcatcttgcttcagatgctttaggtttcaagtaacaaactcaacttaatacgtactctattagctcctacaagaaattcaaaggtagatgaagcttcagtgtgggtttaacccagtggcttactgatgtcactagggcctggtttctttccatttccccaactggccttttgtggaatccacttcatgctaaaattctctctccttgtggccacacaggtaattgccaatgttcccaggactaagtgcttccccatcaacatccagagagggtatatccaaccagcatcctgatctaaatcagcttggattacatattgccctcccccatgaccctataccttctgcctccctgtcgttacaaacattatggccagggaaactgaatgcaccggttgttgcaagccagttggggtccaaccccagagatggggatagacagttttcttgaagcaaatgggctaggtgagggaagagacagcgtatagaataagaatgtaggaaatattaggaagagggaagtagatgctacgtaggcaacttgtaaatgcccagtagacatctgctcctggagaacatgggaaaggaagaagaaaagggggtaattacagtaattgagatccacttactgagtgatgctgttgtgatctatatctttttagagactgctttgagatccaacttgatctgactccccttatatgaacaagccaagtatggcagattatattttccacaatggccataacagtatctcccatcctccatgttctttttgcaatgtgcctttgttatacctcccatcatgaaatgggttccatgttccctccccttgaatctaagtgaaaataatgttgacttccaaatctagatcataaataatggtataacttctacctggttctctctggggaggtttggtcttagaaatcagctaccatactgtgaggaagtctaagcagcccatgggcaggtccagatgaagaggaaccaagcctactggttcacagacctggctgaactcccagccaacagccagcaccaacttgctaggcatgcaaaagaagatatcatcttaaaagtggatcttccaccccctgcaaaaccttgccaaaatttcaaatttttaagcaaactaagtgattcctgttgttgtaagccaccaagtgctttaactggttgcatgtcacatggcaatagataattgacacaccaaacaaacagaaaatgactacacagccaaatcaaatctgtcattccatccatccctagcaacatacattctgaaaaaaaaagcctagccataactatctttcattttagatttttaaatttcaaacatttagaaacagtagtatagggaacacttatgtacctatcacccagtttcaacaataattattctgtgatttttgtatcatctatatatctacccatttctacctattctcaattataatttaaggtaaaatttatattatttcaaatgcataaatcttattagtataattttgataatgaaaatacccacaccccgggtgtggtttctttccaactctccggaaagttctcatgtccctctccagttaatcctcctgtatcactcagagtccagtcaagagacagaaatcacacccgtgttttgaataaagaacaatttattctatctcataaagagattctaataaagaatgcaattcaaagaattactaactagtaaaaagagagtaactactaagagcaaaagagaacactaaaggacaccctgtggctcagacagagtacccaaagatgaaataaccttggaaggagggcagccacctccccaaggctgagattcagagaatgtggagtgtggctgaggtatagtggggaagtccattaggttgccctgagacagagatagttctcagccatgatggtccaaggcttggtgaacaggaccccaccagctcacactagtgagcagacgccccctgctggggtgccaatgggctgaggctggtgagcaaaacttgctgaagagtgggcaccactgggtgcaccacacacatgctcctggaagctgtgtcatgtgaacaagaagtgaggaagcacacaggaaccaggaactgaagtccctctccctccagggtccctccagcactgacaaggcttaacaacatgctagcccaaagcaatgccaaggtctagatcatgacaccagtccagcttctaggtgtcaagggctacttttctcctcctcaatatttctgcagtattataatcagctgtctagttttatggggaaaaaaattttagactttaactaaaattgcattgaatttatacattttctgggaagacattacatgttgttattttcccattcataaacacagcagagtacttcatttctttaggtcaccttaaacatctttcaataaaattttacaaattcctccaaacaggtctttcacatcttgtcctaagaaaccttatattttttgtggctattatgaatgtaatttctttttttttttttgagacagagtcttactctgttgcccaggctggaatgtagcggtgcgatctcggctcactgcaagctctgcctcccgggttcacaccattctcctgcctcagcctcctgagcagctgggactacaggcgcccgccatcacgcccagctaattttttttgtatttttagtagagacgaggttttaccttgttagccaggatggtgtcaagctcctgacctcatgatccacccgcctcagcctcccaaagcgctgggattacaggcgtgagccactgcgcccagcctatgaatgtaatttttaaaagctactgtttaaaactttggttctagtgaattgaaatgcaattgattttttaatattcagtggaagaattttgtgaggatttttttttttttttttgagatggagtttcgctctcattgcccaggctggagtgcaatggcgtgatcgcagctcaccgcaaccttcgcctcctgggttcaagagactcccctgcctcagccactcgagtagctgggattaaaggcatgcgccaccacgcccagctaattttgtatttttagtgatctttctccatgttggtcaggctggtcttgaactccaaacctcaggtgatctgcccgcctcggcctcccaagaatttttttttttttgtctactctttcactgtgggtgtaatggaattgtcagaaactgaaaatactaggaaatgtaggactatggatattgagagcccatttgacaactgaggattgaatttaaagtgacacaattcagtttaattgtgtgttcttcctttaaataatgttcagttgctcaggggtaagcacggactgctggatatttgagttttaccagggatgggtgtttgtcacatcaataggacagagggagaaacaggtaaaggagataatcgtatttgaaagtgatcataatgatggtgtggtggcattttaaaagcatgtctgcaaatgatatttcttacataaagaggtggggtttaattcctctcctcttgaatatggattagtcttaataatccacttgtaatgaagagaatacagtgaaagtgatgttgagtaacttctggggctaggttataaaaggagattttacttggctctgtctcttggacacctgttttgggacccagcctccacgctgtgaggaagctcaagctacatggagatgttacacatagatgttctacctgtcagtctcaggagaggtcctcatcgacagccagcatcaactgccaggcatgtaggtaaggaagccttcaagatgattttaacctcagccactctgacatgtaagtgcatgagggatctcaagcaataatattctgtcaactcccataactgtgagaggcaataataaaatgaatactgttattttaaatcactaaatgttgtaaagacatttaggtaatagacatccacaataatgatgaaccaaggaatctaagatgggtaaagagagaaataaggacataagagtaatatttgacagtgcaaagataattgaatgaaatggtggtttgagtcagttgaagaagtgctagtgtagaagctccaatgtgagtgagctaagaaattaagagataagtggatgaagaaatggagatttcagagatggtacagcaatttaggataaaatggttaagagtatgaccatagaaggacatgactgaggaacggtgaaagcaaagataactggaagaaaggtcaaggatgtgaacggaacatccctgtgaatactgcgggcacaagaacaatgacaggagtagagaaaaaggaagatggtgagccagatgctaatgctaccaacaaaacatagagattggtacataatgaagacagtgagtgctaaatctgatgttatgaactacaaagaagctgagactttagaaaaaggagggaagatacatagtttggaagtggaaatggggagccaaggaagacacctaacctatctctagatctgaggtaaactgaggagtgaaacaagacagtctccctaggatttcatatctgagtaggatgtggaaagtcaccatggtccaatgaccctgctacaacaactagaaaaaaacagacacattacaaaaatcacatttaaaaaagatattggcgagccatggaattccaggggaaggaaatttttctgaagtgagctgacaatgcacagctgctttttttccctgggaacgtgtgccagctctgggtaggaaagaggacagggctgggcccaggcagagaaagtctacaaatgggaagagaaaccaataggcttatggtggtggcacgggggtaacatgacaggttagaaacttgaggtgccccaagtgtggccactgtctcccataaggcagtgagttctgggagtgttcacacaggaggctgaggagctagaacatcaactcctacaaggcagagtgagtctttcataatctcagggaaggaagaggaagcctgcctcaaacatacagccagcataaccttcaatgtacttgccagattttaaagttgagggcccacggccaccacgccatctgggaagtaaggagcacctctgcccagccgccccaccatctgggaagtgaggagcgcctctgcccggccgccccaccgtctgggaagtgaggagcacctctgcccggccgccccaccacctgggaagtgaggagcacctctgcctggctgtcgccccctctgggaagtgaggaggccctctgccctgccgccccactgtctgggaagtaaggcgcacctctccctggctgccccacagtctgggaagagaggagcgcctctgcccagccgctgcaccttctgggaagtgaggagcgcctctacctggttgccgccccatctggaaagtgaggagcgcctttgcccggccgttgtgcaaccctcgaagtgtgaagtggcagccttgtgtgtgatttttatgccctccccaagtttgcatttttgatattaaagtttacttttaaaagttttaaattggggaatatatatacatatataaaagttgagggcctagaagggaaactaaagagctaagcttaaatacctccgaagagcagaaccaaatctctcacaatctttcagtctgaggagacagagactggctagcttctcaatcaaaagcccagaagagctatgcctgaggaatagggatgaaccagatgtaaaccgaacccaaataaatccacagtccaagctcaacacagatcagtcccttcctggactgaggtcatgagctctgtaccctatacagaggaaaggacgaacctttgctggcgaaagagtatatcatctggaacttctattgttcttttctcacacaatgtccaataaaaataagaaattactaggtatgggctgggcgcggtggcccacgcctgtaatcccagcactttgggaggccgaggcaggtggatcatgaggtcaggagatcgagaccatcctggctaacacggtgaaaccccgtctctactaaaaatacaaaaaaattagccgggcatggtggcaggcgcctgtagtcccagctactcgggaggctgaggcaggagaatggcgtgaagccaggaggcggagcttgcagtgagccgagatcccgccactgcactccagcctgggcgacagtgcaagactctgtctcaaaaaaaaaaaaaaaaaagaaattactaggtatgtatgaaggcaggaaaatgtcttgaattatcaacagaagaaaataagcaatagaagcagacccacaaatgatctggatattcaagttaacaaacaatgatttaattttatgtatttattttatttatttatttttttagagacacagtctcactccatcacccaggctggagtgtaatggtgtgatctcagctcactgcaacctctgcctcctgggttcaagcgattctcatgcctcagcctcccaaatagctggaattacaggcgtgcaccacacctggcaaatttttgtatttttagtagagacagggtttcagctggtctcgaactcctggcctcaagtgatccacccacctcggcctcccaaagtgctagaattacaggcataagcaacaaacaataattttaaaataacaaccatcaacatgtgtgttgatccattttgcacggctataaagaaatacctgaggccaggtaatttataaagaaaagagttgtatgcggctcagggttctgcagggtgtacaagaagcatggtgccagcatctgctcggcttctggcgaaggcctcaggaagcttttactcactgcagaaggcaaagggagccagcatgtaacatgggaagagaaggagtaagagaaacagctagagggaggctcttctaaacaaccagctcttgggtgaactaatagagggagaactcactaattatcacaggggagggcacaaagccattcttgagggatctgcccacatgactcaaatacctcccactgggccccacctccaacactggggatcaaattttaacagatttggagagaacaaataaagaaaacagaaaaaggcaaactgaatgaaaagatgcataattctaataatcagaatttatttaaacatcaaattgtcattctagaactgaaaaacatgtctaaaattaagatttcatttgatgtatttaagagtagactggacacagcataaaacaaaattagtaaacttgaaaaccatcaatgaaaaagatccaaacttgagctcaaaaagaagaaaatggggaaaaagcagaagagatcaaaagaggcatgtagaacaaggtaaagaaaaagaaaaaaaaagctaacatatgtacgattggagttccaaaaggaaaagagagaactgaatagaagtactatttgaaaagaaccaagaattttctaaaacggatgaaaaatatctatcaacagattcagtaagcccaggggaccaagcaggattgtttaaaatgttttttaattttttatttttttagagatagggtcttgctccatcacccaggctggagttcagtggtgcaatcatagttcactgcagcctcaaattcctgggctcaagtgatcctctcctctcagcctcatgagtagcagggactacaggtgtgagccactaagacaagttagcttttttttttttttttttttaatttttgtacacacagggtctcactatgttaccgaggctggtcttgaactcctggcaagcaatccacctgccttgggctctcacagtgctgggattacaggcatgaaccaccaagccaggcctgatttttaaaaaaatcagtctctattcaagagatttgcaggaaaatgatattgtaggtagaaaatcaggttttatttaggacaggtagatgaaattcagaagaggttaaatatacagggaaaactttaatgaaaggttatttatgtattccaaggcttgcagaagatgggttttagaaaagtataaaacctgccagacatggtgggtcatgctgtggtgggtcatgcctgtaatctcagcactttgggaggctgaggcgggtggatcacctgaggttaggagttcgagaccggcctgaccaacatggtgaaaccctgtctcgactaaaaatacaaaaattagctgagcatggtggcaggtgcctgtagtcccagctatttgggaggctgaggcaggagaatcgcttgaacccaggaggcggatgttgcagtgagctgagatggcaccactgcactctagactgggcgacagagctagactctgtctcaaaaaaaaaaaaagtataaaacccatctgggaaattgagtcagataaataaatgtacagacaggatatgaggcagaatggaattcatcttgatattctcttagaagaaatgggtaatgagtttaaggtgggtgtgtggggcccagaggattgctcctttgcacttcctgctagtgtgctagcagaggtgagtgaaggactcctcaggagaacatgatcttagacaatggagaatgcatataagggcctcctctatgggtgcagaacaatgcagtaagctggtaaggaaggaatgctttcacccagagggggaactggggactgcctcattgcagctttgtgatgttatagtaactggcggcctagatgagaagaggccatcccttccttgatgtaccctgactctcaactcaagtccatttctgccacctgctccaccgccatatcacagactgagccatcactcagaatggctgcaccctgaattgtaaatataaacgttccactttctgacccccacctcctgtgtttccagctccctcacttaattactccctctacttctcttcactcacctcttagaggagtcttcactttctgtccatgtatcagtatgatatccttttctcatttcccactgagtccttagagtccttggcccatcacttcagatactcaggagcttagctccctaacctactgcctttccattctattaatatatgcctggcaaattcctatcccagacgaagtcaacttggttatctctgtacctacatctgatttactgactgctacttgagaaaatcacacaaccgggaagatgggtaccattctccctacatattttcaagcacaattgtatagaggtacaacacaaaactcactgtaataaattaaaacaatacagctatggacagagtaaaaagttagaattctccatcttttcccccaaaaccattccacaagacatctgttattaacagtttggcataggttctatgcatgcactattgtcttaaagctagatatatacacatatatgtacataaacacatatacaacatatatgaaatcaaatggacagctagagcagaatggacagttgctaagcaacttgcactttttcttttttacttaataatatgtgttgggagccagccatgtggtgtatgcctgtagtcctagctacttgggaggatgaggtgggaggatcaattgagcccaggagtttgaggctgcagtgagctaggatggagccactacaccctagcctgggtggcagaccaacaccccgtgtctcaataataatgatgataataataatatgtcttggaggacatttcttcttagtaggtacagatatactttattctacataatgcctcattcgcttagtcactctaggtcatttactatttttactatgaaacaaagttataatgaatatccttgtacatcctcctgaacacatgtgcaagtatttctctaaagtagatccctagaagtagaaatgcttggttaaagggtacatgtatttaacatcttaataaatatttctcaattaccatccaaaaaagagacgggtggggggtctctaccaaattgccctcccaaccgcctaggagcgttactaccctcaggtaggacctcctctttctttccctagacatctctctccctcattctccacataacgtatctttgctcgaacctcctactgcaccaacatccccatccccactcaaacacgcacattcttggtaaatatctcaccaactatttgtagagaaaaaaagaggtcaacaaaggcaaatgttctcagcttcctacccccaaacctacaaaacctaatgtctatccccttcctgtcttccttccctactcttataacggcagtaggagggcagtccttcctgttgtctaaaggcaatcctggttgagagggtccttaccttcacaaagggctgactacactgaccaaaggtctcagcttccactcttccctccgctaacctccatctattttctgccctcacggctccatggaaacctcaggctcaccttgggcagaatccagctccttatcttaggtgactagtgcctactccctacttctgacaacattcttcataatgccagtctgctgattttcctcctcaggctctctggcacttctttctcactcctccactcctcaggtacttcttgtccaaaccttaaaatctgagtttggggtttccgatctgggccttgtgctcattccccctgggagatgtcacccattccccacgtgcagccaccatcaccctctgttttctctctaatcagcgtcttcagccctgatcgcctacaagtccgaatttgacttcactttctcgcattctgccccgccttccctccactcctccccaatcccgaaacctagtccctcctccgggaagtctttcctgactcctcccccttctaactccccaccgacggtctgtgtccgctgccacgcgtgtccagtacctcgcagacctgaggaatgtagttctccttgaagtagttcttcagcctcgggttggcattgcgtagcgaggccatggcccaaggcctgacggagaagctgcgatagtaccctccccgcgctgggactaggggccgggcgcgtgcgg

SEQ ID NO: 1532 - DNA, 261708 bp, Homo sapiens
gagacggagtcttgctctgtcgccgaggctggaatgcagtgacgtgatctaggctcactgcaacctccgcctctcaggttcaagcaagtcccctgcctcagcctcctgagtagctgggattacaggcgcccaccaccacacccggctaatttttgtatttttagtaaagatggggtttcaccatgttggccaggctggtcttgaactcctgacttatggtccacccgccttggcctaccaaagtgctaggattacaggtgtgagccaccgctcctggcctggcttcttttttaaatcatgattatttagacagaagaactactgatgtgtttggaaatatttgtagttggaataagaatcagaagatggtttgttgcttgtttacattgttattgagattcagctagtaaacatacttgcaacaaatggagaaaacttgccaagttcttgattttttgttcttcctgcttgaggctgaaggtcacgctgcttggtcttcactgctgtatgttgactttttcactgttaattctaaggctcctttagatgatgttatgttgtcaagctctgtaacagggtttccttccctatcatagccaaaccaacgtggagggtcattagtgttgtattcctgctgctgaactttagatgacattctttgagctgccttcctgtaataacagtgcttagcattagctagttgcagaagtaacccctagtgcaaaattttcaaactcaaccaaatttggagttagggaattcactgtcacaatctgaattcacatgagacctctcttgccttgctgagagtgaggatatgggtaagtgtacaaataaacagggtcccaaagcctcagtaactctgattcagccagttcagaaattaacagatacagtgaatgggtaaggaaactacacatggccatggaagaggaacactgaggcctctatttatttatactgctttaagtaagccccttccttggtatttctagtttctctgatgagggagtaacctaaccagcctacctgtgaaggctgaccatgcaccaggccaggagctcttaacccagagttcacagatcccttttgactacatggatgaacttcagggaggtccatgaactccctgaaagttcatgcagttttgtctataatacacatttttatgagaaggtttgtgactcaaaggtgtcacaacactataacacagtattaaaaaatactgttatagtctttcttagcaggaaacaagaaagtaaagaatgcatcagaaaaaaagtaggtctaacttgaaaacaaagccattttgaggacagaaggaagaatttcctttcctagaaagttggtttgaatcacgagattagtactaaagaggagatgagtaattgaccacttctgtacgattagaaatgagtaactatgatgtttacccatgaaggcactaccttccccactcttgccgtatgttaccttgagttattaattgcaaaagtctggaaactgagtcattgatatggagctggcattaccatacacttcgagttaagtttgtgctgaatggccatatgagttcaggtaaggcaatgaaataggaagaaaaaaaaccaacaacatagagataacagtttaaaatgctatttcagttaaatcaaactttagatgtattaaaataattgtaaccaaacttaacagggaggtaaccaaagcattcctaattctgcctctaagcacattgctttttagcttattattggctctcacacaaaacttctacaaacttaaagaacaaattgagtaaaagcaattatcatatactaattcctagtttggagccaccaatccctatggactaaaacttggcaaacaagtttattctcttcagagaaatatttattctcagttttgaaaatggtaagtttattgtcaaagataatgttttgcattctgttaattttttaaatctttttttaaggtgctagcctgcattttaaacctcttatataatctttacatatcctcaaagtagaacattactatgcaaaagtagtgggtttatatcttttgcttttcccacattattctcctaatgatatttctcccttttcaattctataaaggtgagattatcatatctttcaacacattttctgaacatttttccccttaagacttactgaaatataataccaaatgttgaggcatataacattagcaccatcagtttcatgtaacaaacagcaaggctccatcattacccttcacccatctctatcagtctaaacattatccatttttcaaaactccaaaccaatccagcctccttggaaatggctcaaacccagtcttctcctcctctaaacatctacaggaagttgatcatagaattaatttctttctattacatagcttcagggcattaattatttataattttaaactttgttattttccttttgtttaagaaggtagtaagttacttaagagtttattacatttctttgcatctccctgaaactcatcatgaatagctcaaacgagagatttcagcagcttacaccaagaagggaagtcctttaaccctcttggcttctgctggattgctggtctagaaggggcattcttatgttcctatttccaacaccctcctgccccctgcctcccaaacaccagagttctggacacacactgcagttcacagttgttcataatcattcaatgccactgatgttgactgtagtacaagagtagcacagttagaggcaacaatgatcttgacctataggaaaaggaaatgcttgttttagggagtaaaagatttgcaaatcctcattcaccaagttacatcttaccttaatgtcagaagagcaacagttttgacggctctagataactggtaagaggataagtactactaatgataagtctgggaaagtgtaaatattgagtcctatggttgctcagtcagctacaagccagggtaaattagatggtaattgtgacataaaacaattagcaagtagtgggggtttgagaaaataacaagaaaaaggaaagtgagaatgctgactccttaatataagataaggaaaacagtgagtgaacagggagactactcatttaatgcagtgtgatgggacagaatcgaaatgagctgcatgttgaaccccagccatgggtgaagtgcccactggtatatgcatttctttaatgtcctcattccttagtccctgtcccccttaccctagctctgctctccagtccacccacagacagctttagtgaaaccaaacatcagtgggtccctgactattggaagtgatgcttactgactggaggggagcaaaggatcagatctcagacccactctccttccagactcaagttctgggaggttaaggcttcctccacctggtatgtctttagggcctgttttagtctgaagtgctttcacagcaagggtggtcctagggaaaaacagaaaatatgaatctgtcctggagcaaatctaggattatttttagagagctatggatactagtatagactattccctattccacttctttcctgcccttcagaaaatccttagccgtgactagctgtcctcaccacctttggcatcctcacacggactgactaacctaagacccaggaccttgccaagagaagagatcggcaagtggctgccagaaggtttttctgagttctttatcatagcatcctatgtagctgtgtgtttgcacacacgcacctttaaaaaaaaatttagattcagggtgtacacgtgcaggtttgttatgtgggtatattacataatgctggggtttgggctgctattgaacccatcagccaaatagtgaacataatgcccagtaggtactttgttaaccctcgccatcctccctgcctccccacatttggagttcccagtgtttattgtttccatctttatgtccaagtggttagctcctacttttaagtgagaacatgcagtatttggttttctgtttctctgttaattcacttaggataatggcctccagccgcatccatgttgctgcaaaggacatgatttcattattttttatgactgtgtagcatcccatggtctgaatgtaccacattttctttatccaatccaccactgacaggcacttaggttgatcccatgactttgctattgtgaatgatgctgcaataaacatacaactgcaggtgtctttttgatagaattatttcttttcctttgggtagatacccagtagtgggattactggatgaaatggtaattctattttagttctttgagaagtttttatactgctttctattttggctgacctaatttacattcccaccacagtgtaaaagcattcccttttttccacatcctcaccagcatcttttattttttgactttttaataatagccattctgattggtgcgagatgatacttcattgtgatggtaattttgcatttctctgatgattagtgatgttgagcattttttcatatttttgttggccacttgtatgtcttcttttgagaggtgtccgttcatgtttttgcccactttttaatgggcttatttggtttttgcttgttgatttgtttaagttctagattctggatattagacctttgtcggatgcataatttgataatatttttctcccattatctttactctgttgatagtttcttttgctgtgcagaagctcttacacatgtattttgaatcgtatcaggaaagttaaaaatgtagaaactatatttctgggagaaacctctctctctctcctgcccctcccctttctctcttaatagcttgatgctgtagtgtgatcagcacatgggagctaggaaatattgaaaaaaacatgtattcttaggaaccactgtgtgttctaaattccatagagcacatatggaattctttgactgcattccattctgctttggcctaagtgactgtgagaccccgtatgaaatgatttgggaattgaaccaatctgctgcaatggttactcatttatcctggtgagaggtttctttggatcagtatagaacagtgattttcaaacatgatatgtcatagttgtaacatttcacattagatggttaataataacactgtactgaagtttgttagtgatttttgtttcttataaattaaaagggattcagggttagccctgtagtaacactgtgtgccttagctcacatttccttctaatctcttgagtaggcaaaaaaagggaatgttggagccaccaccaaggactgctcataatccacagcctctcttattgtgcatcagacataaattaggcaaaacagagcacgtgtctacccttactgaccacatcccttgaatgtcagagctttttaaaagcttgagaatgtaatataaaggcgaagagcagcacagtatgattaagacctaggtacaaagtatggctctccttatttgtgtggctgtgggcacattatttaacctgtttaaaccagtttccttatccattttgatgataaagtgtatttgtgaggcaatatctgtaaaataggatttagcacagtacgtggcaaataataattgttaaataacattatttgttcatactgataataaaagtcaacagctccacatcagaaaggcttgaacctttccatgagctagagaggagaactctgataagagttttattttttatcaacacagatctcctagaatgcctgagcagtagggactgtccgagtttaagcttctagcaactgctaaagaaggccttccaggaatttcatactgtgatttggggctctgaaggccactaagactttctctactagttctctagaattgaaggttttgggctccagatagaaatatatcaaaagttccctttatttttttaaaaaatttatttccaacttttattttaggttcaggagtacatgtacaagatgtacaggtttgtgacataggtaaacgtgtgccatggtgttttgctgcacagatcattccatcacccaggtattaagcccagtatctattagttattcttcctgattctctccctcctcccaccctccaccctctgacaggccccagtgtgtgttgttcccatccatctgtccatgtgttgtcatcatttagctcccacttataagtgagaacatgcgttatttggttttctgttcttggattagccttttcgctaactatacaattagtgattcttcaggttctctgtggttcaggccctcctgggttgtgggggccattgtgagggtctttcttcctctctctcactcctaccttgttgcctttccccacagagggccataagttgaatggctggctgtcacagctgcttcaaatacaaatagcttgtcgttttctgatcatagttgttacttattcctccttgaaataaaggagcctttatcttgcatccacacggtgcttctggggtcacttcctggaaacccttcagactctggggttggtagaatgccagccatatcttctgcaggaaactctcctgcaaaagggctacagccaatttgctcattgaccaaaagtttgctactcctctggttcagaaagggtgagctgagcagacatctttgatttgcaaagctggtgcagtagtttcagattccattgagtatgagtgaatttatgtataaaacagcctcttctgacggctgtaattggaccttaagggctgcatcatacattgttttcatgttcaaaatggaatcaagcatgtggagagcattgctttgtgattcaaagacattgagcttcttcccaagccagaaaaatctctcttatcccacctgccaaaggttctgtttcacccagacaaatcaaagcctctgcagttgagggagccacactggccctgattagatagtgagcataggtaagggattagagatcatcaagggcttgagttttgaagggtctacatacactgtgcatttccaactgcactgaaggatctaaatgcaaaacgaagctgctccatagagcacccggagctgatcgcagaaagctgcatgcaactaggcccccttacagcttctctaataaaaaaatttgaggccagggtatttcaggagccccctaactgacaagtagcaacctatcctagatgttgaacataaagacagatgtttctggagctttactagtccaaacactgggactctccaagccactctacagtgaggactgtctttctccattgctagacaaagatggaatcgagggattctaggcctctttcctgctagagctaagcaagggtggagctttcagggagactaaaaggtagtggtgtggcctctttagacaacgaagtgcacacaccaaaccagcccctttctaagcattagggccaagtctctgcctgcttcttgtgcatagggacagccaagtttgattgcagaagacaaaataggccttcggctgtcatggcttagacaatggaatttttcacagctatagctggttaattagagttctacattggggttttgggacaaagctcagctagtagtcaagtcttactatgccttgttttattttttttgcacgtatattttttaaatctagggacctagcaagaagaccgagcagttaaggcaggattcggatgttactggatatcctgggtcttcttgaccactcactatattaatcatacttcagtgtcccatatgtcttggtccattttgtgttgccataacagactactacagactgggtaatttataaagaaaagaaatttattgctcatagttatagaggctgggaagtccaatatcatcccatggcaggaaagaaggagccctagctcatccttttatcaggaacccactcccatgataactaactcacttccatgataacggcattagtctgttcatgagggcaaagccctcatcacctaatcacctctgaaaaggtcacacctctcaataatgttgcattgaagattaattttcaacacatgaacttgggggaccacattcaaaccatagcatcacaccatgattaggttcaaagagccccttgccagaaagtctccattcattctagaatcttacttattagaaattcaataatattacctcttataaatagtgattggcaaaatataatcaaaaaattagaagctaaactcctttgagtaacacgttattcattcactgtcatcttgctgaaagttgtctgttaataatctaacaagtttggcagagactcctaggaccctatttcattgtatatcctttaaatgaggttagcagtattcatatcagagttatctccagacctatcaggaagggttgagtctccaaccctcctcaaaaattttcaaggacctacccccttctctctgatccaactccagctggctgccctacccctgcaggcctgggcccagtgggaatgtctattttacaagtaatttttctttcttttttccatttcattttaacacacacttccttggataagaaaccatgttcttcctcaggcctcaagaaaccagggctcatggttcagctcatgccataactacttaattaagaaagttcctctgtgaaatctacatgcttgagccacattgtacactttatactttgataatattaattcatagtattaatttttcacatctgcctaatagaaccttaccttctatgtcagggaatggtcaaggattctcattttaagcatttcatatgttactttatcaggtcagttaaaatacttgcacatttttgccctcagtcaagaggcaaaaacttgtgagctggcttaatcagatgattctcttaatgctctaggggagattaactgaatggactgtattttgagaaatgagcagaggaagagctagagttaaagctttggacacctgcttagtcaaggaagggaagatgcttaaagtaaaaggcctactggaaaagggataggaaaccacaaaggccgttttagaacaactcacaatgttagcttcaattaggcaaaaaataaaatgaaatgaaacttcctaacactgaaagctgctatgtattatgaaccttatagccatatactatgttttctcagaaagtagttctcaaaagtttgtcatagtcaggtacatacttacttggaaatatttgtgcagtattgcatcttaaggatccggagttgtttgcagcctatctgaaggtcctcaaggatttggtcagtaagcaagacacaaccagagatatccaaaatgtgcaggtaatggcattttgccgataacatctccattgctgagtcagtaatctgaacacagagccaaagtaagtactggttattcaaacactatctcagggaagaacagtgccttagtcactttgggcaactataataaactaccacagactgtggcttaaacatcaaacatttatttctcacagttctagaggctgggaagtccaagactgagataaagatagaggtacctgcaattggtgtcttgggaagtccctccttatttgcagatgcctccattcttgctatcttctcacatggcagagagagagagagctctagtctttgtcttcttatatggtcataatcccatcatgggagctctacccttatgacctcttctaaatctgtttactcccaaaggccccactttctattactgtcacagtgggagttagggtttcaacataataatttttggaggacaaacattcaattcataacaaatagagtaacaaaatcagacacttgcatattctctttcacccagcttgtcacataatgggcctacaattcaagtgagttgtttaactgtttccaaataaggtcagaacagtaaaatatctgcctcaagtagcaccaatagaaattatgatcttagcaaggcacagtggctcatgcctatgatcccagcactttggtaggctgaggcaggcagattgcttgaacccagttcgagaccagcctgggccacatggtgaaactcccaaaaatacaaaaattagctgggcatggtggcacgtgcctgtagtcccagctacttgggaggctctggtgggaggattgcttgagcctgggaggtcagtgcttcagtgagccgagatcacgccactgcactgggtgacgtagcctcagtgacagagcaagaccctgtgccctgcccaccccccacacaaaaaaagttgtgattttgctgttattttcatttaagagtcctctggtttggatggaaaacttcatcaaaattttttagtaatacctgtcacaccaatatgagcaacttatgaaatgctatagagatgggatttggctttaaatttaaaatcctctctaaggcatcaccaatttaaaaacatatgtttaataacattacatgctacaaaactacaaaatatatatcccccaaagttaatctgcagacagcctcatattactatgagaagggacctggacatcactgatggtttagatgtaaaaaagatggagtaacctagttctggaaagggacaagtaggtgagacagatgtttggaagcaaggggagaaagaagcagaagccacagagactacacaaatcccgctctgaaatatcctgccaagggttccaacatatcacagttttgcccagatgtcctacagaggtaattcaagtatactacttagagtatttcacttactccaggataagctttcaaatttatagctaaactgagccttgctgcagaatcaactagattactctctccaaaggaatttttttccaactggattcaatttcttattttaaatgtttgaacattctgaaaaacataggccgtgaggcttggctcttgttttaacataaagttaaaagaaaaatcacttcagtttggaacatacactttttaagtttggaaaaagagacgttgccattgtctaaacacgctttgtttccggaacacgctcaggaccaaggttaaacattataactgactctcacaaaaatgcctcagacattcctgccatactaggttgatctctgaggatctgatgtcattgataaaagaaaaaaaaaggcccacagaattgtagaagaaaggaaggacaacaaggtgatggaaaagtccaggggaggtggagttcagagtagcaggtttggtttgatactaggagagctgaaaaggagcctgacagttcctgtagatcagtagctcatgttgttcaatgactgatgtgatgttgttgggatttatggattaagggctgggaactacagatggaaacaactttgctgcatttttaactcccagatataaggtcctgctcccagcctcattgggcagattatgttacttccaacacaactacttttgattccttgaaaaaatgttttggtttatttttaaatgaaattattttatattttagaaataatataagcacattgccaaaaaaatagcaataatagcaaaggaaagcaattacacatttatcacttaacataactacttttaatgttctggagtatttcttgctcgtttctcattcctatccccattaacagatttgtaaatacagtaattacatttattttgcatcctctttttttctttcttttttttattttgctctgttgcacaggctggagtgtagtggcacaatctcggctcactgcaacctctgcctcccaggttcaaacaattctcccacctcagcctcctgtgtagctgggattacaggtgcccgccaccacgcccaactaatttttgtatttttagtagagacagggttttaccatgttggtcaggctggtctcaaactgatgacctcaagtgatccgctcaccttggcctcctaaagtgctgggattacaggcgtgagccaccatgcccggcctttttttttttttttttttttccgagttgggtttcaccatgtttcccaggctggcctggaactcctgggctcaagctgtcttcttgccgtagcctcccaagtggctgggaccatagctgcacaccaccaaacctcgctttcatcttgcttttttgtttttcctagtgcattcttatactacttcacagtcttcatatttacaatctttaattattataaaatgttttatttagtagatgtagtttagtttatcatttacatatttctggtcatttccgttgttttcaagtttttactatttaaataacattttgatgactgttcataaatacagtcttttccaagttttggactgttacccttaggatagatttcagaaagtggatttgtatgctatggtttgaatgtttgttccctccaaaacacatattgaaacttaacccaagatgtggcagtattgagaggtggggcccttaagaggtaatcgggtcatgaaggctctgctctcatcagtggattaacctgttatcatgagagtgggactggtggctttataagaagaagaaaggtctgaactagcctgttaacatgctcatctcccttgccatgcgattccctgcgttgccttggaattctgcagagagtccttgccagcaagaaggttctccaccaaatgctccaccttgaccttggacttcccagcctccagaaatgtaatattactaaattttgttcttataaattacccagtttcaggtattctgttatacacaacagaaaacggactaagacagggtatgaccacttttgtggctcttgtttacgaattttcacattgcttcacaaaaggattatacccatctataatgctatctacaatataaggaccagtttcactgaccccctgccaaccactgggcattaccataaaaaaatgtgcaatttggtaggtaataaatgatacctcaaataataatgttttaacttggatttctttcttatgttggatcttttcccacattgtttactagcagtattttctctgatttgaattccccagctctggcactatttaattgtgaccataggcaagttgcttaaattctccgagcctcagtttccccatttgtagaatggttacccgagattgccacagaactaaaggagaacatgtatgtgaccagtgactagcataaagtaagcactcaataaatggtagctataattatgattattcatctcctttgccattaatatatgtgatttttttttagtaggacctctttatacaaaagagaacttgactgttggctttcagtttgctgaattatacttttgtttcttctcccctttgccccctccccaccaattcctgttttgattgtgtgagaagtcaggtaattttactagcacttctggtgacgatcccaagaaaaaacccgccttgaagatggacagcaagaaaggggctgaatagtccacaaaatgaacttttaggttaataacaggtggtttcatgagatattaactaatgaaaatctaatgcagtaagaaataatgtgctttaaaggtcaggccaaaaagagagtccaagtttttgccctagctttttttaaacccctgaactgtgggagggcttttaaatataataaacatattttgaatataagctgagcgtggtggctcatgcctataatcctagcattttgggaggctgaggcaggtggatcacttgagcccaggagtttgaaatcagcctgggcaacatggtgaaaccccatatctacaaaaaatacaaaaattagctgggtatgctagtagtccagctactcaggaggctgaggtgggaggatcacttgagcctgggaggttgaggctgcagtgagctgtgactgcaccactatactacagcctgggagacagagtgagaccctgtctcatatatatatatatatatatatatatatatatatatatatatatatatgtatatatatctctaatatattaatatatatctaataaatgtatcttatatataataaatatatctaatatataatatatatatttccaagagagggagaggctcttaggaaattatcttcttgcatattatgttatattatgctatatttggctatttcctaagagctctatcgtattattttcatttatttgtgagaatgtagctgtggtagattaaaaatggccacaaatgctttgcagctactgtcagcaagaagtagagtctgtttcctcacctcttgaatctaaactaaccttgtgacttgctttgaccaaaggaatggagcagaagtcatattcttctgagccaggcctcaagatgccttgcagcttctacctttagcccttagcctcttggaatgtgttactgcccttgaagcagctcagctagcttgctggaggatgagaccgcatgaagcaggaggaagctgtcccagctgggtcccctaggccaaccagctctaaggggagtcaagagatgactgcaaagagatgactgcagctccttgggcaaccctggggccaaccactgtcagaagaaccacacagccaaaaccagcccaaattcctggcccacaggtttgtgagaaaataaaatggtagttgtcttaagccactgagtttgagagtgactggttacacagcaaaagatcagccaatactatgtgccaggaatctcatcctttgtaatatatggtaaaatatgacccattgatcattttttttttatactttaagttttagggtacatgtgcacaatgtgcatgtttgttacatatgtatacatgtgccatgttggtgtgctgcacccattaactcatcatttaacattaggtatatctcgtaatgctattcctcccccctcccgccaccccacaacaggccatggtgtgtgatgttccccttcctgtgtccatgtgttctcattgttcaattcccacctatgagtgagaacatgcagtgtttggttttttgtccttgcgatagtttgctgagaacaatggtttccagcttcatccatggggaatcctttccccatttcttgtttttgtcaggtttgtcaaagatcagatggttgtagatatgcagcattatttctgagggctctgttctgttccattggtctatatctctgttttggtaccagtaccatgctgttttggttaccgtagccttgtagtatagtttgaagtcaggtagcgtgatgcctccagctttgttcttttggcttaggatcgacttggcaatgcgggctcttttttggttccatatgaactttaaagtagttatttccaattctgtgaagaaagtaattggtagcttgatggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgatcatttcttttccttatgaccatttcgaaacctctaattgattttccttatggtcattttaaaacctctaagctgaaagaatttccaaacatgttagccagctgcactaagaaaataaaggttgaaaagggtaggattgtcatggggaatcccagaattagcaaatctcttactcctctccctttacattataagtctgtagaattgggatgaagttacctcactaaatcctatttgctcaatacttcatgcctttccactcctaatttccccatctgtaaaatgagggtaatttaaaacagacaaaaaatagtgtttactctcatctcccagtgtttcagtggtctagagacatttctccaaataatgaactttttgggtaaaatgttttaccatattagtataagagaaattctgtgcatgccctggggatttcgcccagctcacaagtttgtgtagctttagctgagcctggggccttaggggagagcagccaggctttgtgacctggctcaatcaccttctcagatgtacttcacctgcaggacagttcaagtagccttgggcacacccagttctctcccttttgtagattgtcattctcaagaataactatagaatgtgctggggatgtaacatcctgagactgaggatagggggtactgactggaacagccaggctctgttccagttccccctagaaacaggacatctttccgtgcttcagcccagtgggtcaagtgaacccaaggttataaaacccaagatggtccaccttccagataccctcagctgcggtgcaagtggaacatttacagttgagatttcatccaccttgagcagctttcctgagccttgggaaacaggccctccaggaatcctcggcttctgttgtcacttgctgcctatctgtaagtaatctgcttcatgaagctttttgcatatgaatgtgtcctgtctcaccagactcagacaagttggtaatcagtgcacagtggacctgcttcacatcacctacacttgtaggacagaaatgcagttctaaagcactggcctgctttcgcttaccttatccctctcagaggtgcattgcagagacattttgtcattgttcagggctttgctttaatttttctcatttcccacccccttttctttctaatcattactaactcccacttcacgtcggtcatgagggtcaaaagtgacagtgttaaccacagggcctagtgcactgctgagtgctttgaactggccccagagcaaccagcttttcctctgatttgtagctatatttgttttccttggcattttagtgtcgagtaggatgaggtcacagtactactaactgaccttcgaggtgaggtggttgcaaggaaaagccggcctttctggggatagataaggtgaccattcaaaattcacctgtggacttttgggaaacctggcacagaatgatgagccagacaccaatgtgttttacggctcatcaaaatcaacataagtggaatatgttaggttggaccacagccttatgaattcagggtgagttgaggagtattcagattggtccagatgatggtccccacatcttctcaatcaggatactcatctgacccacagtctgaccagaacaattcagatggtaaagctaaatctttctactcctttgtatcagcgttctaaaataattgactcttccttcttcctctttctccctctaaacctttgatacagagtgatgcatttcttgcatatttgtttaacatcccccttagcttctgggctgcaagacaatagccatgcacagtttacagaaggaattccctcagccttcataacaaaaaacaaaaaaccaaagcaaacaaacaaacaaacaaaatcctctgccctattttctgtttgcactggagccttttcttttctcattctcctactttctgctttagagccactaagaaacccagtctccatctgtgcctgctttatagccagggcagttctcacttctcactaagccatgtgttgcccatatgtctgtgtgctatgaacgcaagaatctctgtgaactatcactgtttaagttgcagagagtcagttggtcagcgcttctagtgttctgggtcccttgacccagctcactaatagaaccagatgatgctgaccagaaagacatctggttcccctagttctaaacaagtatattattaaacaaaaataattttgctgtgaactttttggcttagttttgtcacggtttaccacatctttttccctgctgcctcctcctttttattgcagcacaattagctaaccatacaaaccaaacaacatagaagctgaacttctagattaaataaagcgtagggcatcttgagagttggtgtgatgctgtagtaaacaaaagccttcagtgtgtacaatagaagagaacacgattgttaataaccttgtaatttctgaggattttcaaaaaaatttcttagttttcttccttcttcatattttgctaactccaagtttttcctgttaatttgtgttgatcaatatcttccactttagagactttcctcttatgtctggtaatccttttgttcacgattaagagtggaggactaaaaactaatcggaaggtcagagtacacgcatctctattgtaagcttcaatgaaggatgatctacgtgtgttatttgttgggaaccacccctgtcagtcattttaggtctttcatcttgggctagtcagggttcccagagaagaggctaccaatctcccacctggagaagaagatctggcagccaagttcttgatgctcagttggaaaaagtgcttgaatatctctgcactcagcattgagtcacttagttagcctagcaaccctctgttttagtatctctagagtagtgggtaattcaagaacaattttggccctcacctccaccagagaacatgtggtaaggtctggagggatgggatcttatgtgctactgacatatagtgagtagagggcaggcatgctgttaaacatctacagtgcccgggacacacacacacacacacacacacacacacacacacaccccactacagagagttatcttgtccaaaatatgaatagtgtcagggatgaagaaccagaatttaggaaataaatctccaggcttctgtttggggtggggagagacagttgcccagatttatggagtaggggctggaatctagagatctatctacttcttaagaatctctaactcagtctcccttattttcatccccactcttaacccagttccaaaggtacacggtgctcccaagcttgaagattgtggtgtaaatcagatttttttttccagctttctctactgttggcttaggattcaaagcagtctctggtctgctaaattagtccatctattttcaagcttccaaatttttgttgctcttatctcctctcctgttttccttatccatatgggccctcactcttcatctctagttctggtagcgtttcaagaggaacaaaattatatgtgtatattcagtctactattattaatccagaacctgagatctctagttctttacatggagatatgtccatagtatattaaaaagtaggttacaatgtattttggaaagtatgattctattattttaaaaaacaaggcaaaacacaaactttctgtaactatttctaatctttttgtgcatagaaaaaaatctagaagaataaaataccagcgatggttatgtccaggtggtgacaggacaatggatatttactttctcccttaagcttttatatgtagtccaaatttttcataatgagtacttacttcatttatatacagaggtcccagaaaaattataaaacacttgaaaataacacaaaagatgatggtatgtccttggagtgtcaaactggaacactgtttaacaggcctacctggagaattctataggaaatcatgcctttgtttgacataccatttactgtccactaaggccctagctcaatgaagttatatgttgttatatttttgtccaggaaagatgcaaattatttgtatctggtataaactgtaaccccaaggttatggatttaataacttgtaaaacacttttagatctaacctaacactcttaatgcaacattctttcatcagttcctacaaatactaagttcattcaaatgctctacgcactggctttgtcattttgttggttctctcattagtgaattaaagaaatctttgacacatgtttatatttgtatgagaattatgtttttaacttttggaaaattctactttgacaccagtggaatcataagctatttccaatttgaggatagaagaaaaaaatccaatgaatacctcaaccatggcaaagagaacatattctgagtccagccctgatcgctgtcctgccttgtcccttggcagtgcttaaattggatgtgtttgagccctgactcctgcacatacctttggacagccagcaatgctgagagatgtgaggttaatgcagtaaatggccagtgctttgataatcatatctgacagctgggagcaataagagacatccaaatgttccaagatcagtgagcttttgcagaatgcctgcaaaaaattccaaggtcaaattttttcttttctttagtcatctagaactgtcttacttatagtagcttattaaatgtacatttcagtccctgaaatacagatgttagatcttgatgcccccaaaaaataatttaaaaaacccatgttacatccaacatctgtttatagcaaaagatattcacaaagcagcttaacagcttagtgatattcaaatgcctgctaacaaaatttggttttcttgaagttaggtctaatgaagtttgactcatatggtcagtaatgagtagaagaaaagaaatctgagggtaagattatatggcagacactccaagattgacagtggaatgtaatggaaagaacagattctttggaatcagacagacccgagttttgctttcgtttccaccatttattacctcttaaatcttagcaagttactatctttctgagcctgtttcctttttttttttttttttgagagtcttcctctgttgcccaggcttggagtgcaatggtgcaatctgagctcactgcaacctctgtctgccaggttcaagtgatcttgtgcctcttgtgcctattgggactacaggcgtgcaccaccacgcccggctaattctttttttttttttttagtagagatggggtttctctaggttgcccaggctggtcttgaactcctgacctcaagtgatccaccctcccaaagtgctgggattataggcatgagccactgtgcccagctcctcttttttaacttagggaaaataacatctactctctagcattgttttgaaatgctgaaatgttcacctgaaatatctaggactagaaaaaggcctggaaatcattccctttatatcaatacttcttaattttcattcctacttttcagttaaaaaataactcagtgataagaatccatgaggaaataacacttaaaagtttacaactcagcagttatacaagaacaaaacaatccacaaaagtaaacctaaccgtaattgtaaaaatatatttaaaaagcaataggagtagaaattggaaaccatgatgaaggaaggaaggaaggaaggaaggaaggaaggaaggaaggaaggaaggaaagaaaagaaagaaagaaagaaagaaagaaagaaagaaagaaagaaagaaagaaagaaaagagaagacaagagaaaagaaaaaggaggaaatttcctcccccaaaatgtgagaattattataattatctacatgtgctcaatcattctaagaattctgcctcattatgaagcagctcctcttagaatacaaagttagagacctcagtaaatggtagtttaccattaattttagttgtaagtactagattttagtaaccctaatgggttactaaagatacttcttatttatatataaattatatatatatatattatatgcgattatatatatattatatatatgtgtgattatatatattatatatatgtgattatatatatatatatatatgtgatgtggctcttagcacaaaatagattctctagctatctctaagattttatatactgtgttagttgagaggcagtatgcacactggctagtgcttggcacatagtaagcaccccataaaagttaactagtgcttacttcagcagcacagatactaaaattggaaaaatacagggattagcctggcccctgaacaaggatgacacagatttgtgaaacattcaattgttttttcagttaggaggagaaagttcaagagatctattgtatatgatgactatagttagtaacgatgtattgtatacttgaaatttgctaatggattttaaatgttctcaccataaaaagtatcataagtatgtaaggtgatgaatgttaattagcttgatttaaccattccacaatgtgtgtgtgtgtgtgtgtgtgtgtgtgtgtgtgtgtgtatcaaaacagcatgttgtacttcataaatatatacaatttttatttgtcagttaaaaattttaagccattaaaaagaataaatgttaactactatcaggatttgcacatgacaccaataataataaagatgcacaaatgtattgtactttgagaaaaactgaaagatattggttatttaaccctaagtcatcatcttttcctgaccacaacagccaacagtgattcattctttgatctcatgcagaacttgtctttttcaactgattcagcacttagggtatttgactcattcctgtactgcatgaaagtctgtcttgtctggcaactacgtgatggcaaaaattagaaggggcagcttgtcaggagatagcttgggacctgtcactggagataatcaagcatagtggggcacacccaaggaggtacagaaaggaatctacctttgaattattggaatcagtggcctggaatctcagtttggagattcaataaaaatgcaataagccccttgtactgcctggaaatctgctagctttcatatccctttcccaaacatcatattagaacacagtaagtgctcagtacatactagttggttcactgatcctttatgtcttcaagaaaattaagaagtctcttttaataatacaagaatttttatgttgcaagaagtaaggtgacattgttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccgacattgtttttcccttgttagagacattaacattgttagagagaatggacagagttagaggaaccagagaaaaattaaagcaagaaagaatatttaaactataagaataatttattgaaggatgaaacaagctttagagggagattcaaggctcttcgtgtctgaaaaccctcttcagtagcatctgccaatgtcttggactgctcgaatcaaatctgccttatgcctttttaaaagctctaatattctttaaagacaaatgttctcagaggttttaaatttaaaactaacttaaaaatgattacaaggtctatgatacattcatggtaccattctcatccatggaaaatctgaggcacaaaaattggtctaaggctttatgctaaatcagtggcagattggcgaactaaagtcagaacttttcctctcttagaattcgtgttttcctttaaacacatataagtcatattaagtacttaaatctgcaagcatgtttcaacataatcactcatgaaattccatttcccccctacagataagattacaatatacacttctggctccaatgctgcagaatcatacttctatcgatgctgctgattttctttccttggaaaatgcaacactaaatttcttccaagtcaaaatcttttacagtaaagacagagataaaaatgcaaacattatcaagtttggctcctttcccatgtatcagccaattttgctgtgtgttggcaatctggaagaaaacttccatatctcttagcgagttagatcattccttcttgtgtcttctgagctgagtcacagtgtaggcacttaatgactacattcctaaatagggtacgtagaggagactgaatttcactcacatttattgactgtcacaataatgtgcttctgccaaaatcctgaattaaaccactttgacaggtggcagcttctagccttagaaaagctcacttcgtgttgcatactcataacaccatctcttgactatttgcctcattaggtcccaattaattctactgcaaagttggggagtttttccctgttggtaattctggaaaatatgtgctgtcaagaaccattttctataatgaagacatttttggctgccccaaaggctaaaatgcaacttccacaattttaagatatcaactaaatacaaaaacttcagtttcttgggcatatcccaagatatctacttcgcatatcccatgagatggagagctacactccaccaacaatggccttgttcccactgggcatcagagcaagtgggactggtcatggcctggcaccacaactaaactctgcagagcctgaaggtgcccctcctggagatgccactcttgcattcccaccttccctgccagggaaaccaggctgagcaaggcttagcaaaggcccagcctcagagaagctccctgttttaaaacatggagagaactctgaaagggaaagggggataaggccaaggaccaaaacaaatatttccaaagacactttcatgatgaaatttgttataaaattagatggtgatgtgagggataaactttggcttcaaaccagctcaaatgtggtttattctacagtcttccccaattcttctctgtggaagagatgcgctttcaaattcttataagcttttctttctttttgacagggtcctgctctgttgcccaggctggagcatagcagcatgatcatagctcactgtagcctcaaattcctgggcttgaatgatccttctacctcagccttccacatatgtgcatgctaccatgcctggctcattttttaatttttatagagacagggtctcactatgttgcccaggctgatctcgaactcctggcatcaagtgatccttcctccttggcttcccaaaacgttgggattataggcatgagccactacgcccaggcaactttctcactttctacttgtattatagttattcatgtaagtgtcttatcttctgcattgactgtaacttcttgagggtagaatccatgtctaatttatctttgccaacatctggcatacagaattagttcaagatgagagagtatccaaaatgaatgaagaatgcttctcagcacaggagtgaggagaatgagcttccatatatggccctcagaatactaagcccagtccttcttctcactcggttcagtaactgccagaggcagcatacagggttggttaagagcacagtctgggggcccactggcttgagttcaaatccttccatgagatgttttgtgtctctggataagttactcaacctctcttacccctcaatattctcatcagtggtgtgggaataacacaggagtagcttaatatgaggagtagcacctacttcatagagttgttggggagattaaatgagttaatatgaataaagcagttgaacagtaccttgcacatagttagcagtcagtagatagtagctagtattattatttgtatgcactgcttctctgtggctctgattgccaaactttttaaatcatgaacaccatagtaaaaaaaaaattttttttttgagacagagtgtcactctgtcacccaggctggagtgcagtggtgtagggaaaagagagatcagactgttactgtgtctatgtagaaagggaagacataagaaacttcattttgacctgtaccctgaacaattgctttgccctgagatgctattaatctgtaactttagccccaaccttgagctcacagaaacatgtgttgtatgggatcaaggtttaacggatctagggttgtgcaggatgtgccttgttaacaaaatgtttacaggcagtatgctgggtaaaagtcatcgccattctgcagtctcgataaaccaggggcacaatgcactgcagaaagccatagggacctctgccctggaaagctgggtattgtccaaggtttctccccatgtgatagtctgaaatatggcctcgtgggatggcaaagacctcgtgggatggtcccccagcccgacacccgtgaagggtctgtgctgaggaggatagtaaaagaggaaggcctcttgcagttgagataagaggaaggcctctgtctcctgcctgcccctggaaacggcatgtcttggtataaaacctgattgtatatttgttcaattctgagataggagaaaaaccgccctatggcgggagacgagacatgttggcagcaatgctgctttgttattctttactccactgagatgtatgggtggagagaagcaaaaatctggcttacgtgcacatccaggcatagtacctacccttgaacttaattgtgacacagattcctttgctcacattttcttgctgaccttctccccaccatcaccctgctctcctaccgcattcctcttgctgagatagtgaaaatggtaatcaataaataatgagggaactcagagaccggtgctggtgcaggtccttggtatgctgagcgccagtcccctgggcccactgttctttctctatactttgtctctgtgtcttatttcttttctcagtctctcgtcccacctgacgagaaatacccacaggtgtggaggggctggcccccttcacagtggcatgatcttggctcattgcaacctccacctcctgggttcaagagattctcgttcctcagcctctagctgggattacaggtgtctgccaccacgcccagctaatttttgtatttttaagtagagacagggtttcaccatgttggcagctggtcttgaactcctgacctcagggatccgcctgcctcagcctcccaaagtgctgggattacacatgtgagccactgtgcctggcatagtaaaaatattttgagcatacactttcagtaaatgtatattaatgtactttgtaaattatataggcataaactattcaaatatatattatatatttaaacatataaaatagaatgtatgagataaaaaataaatctgacatttctagaactttcaatattttcttgtcacaccaaaaaaattgtgttgttcatttgctggagtacatgctttctctagagacacctacccaacagcacacctttggttgccagtaaatcttgatggcttactggctgcacagatccagaacattttgtaaaaataaaggaattatctttaacatataaaatttgacagatgcataaaaagaaggaaaattggaagaaattaaagaacagaaagggtaagcagtgaaagagaatgtatattgggaaaaccaaaaggaaagatgaccaggaaaagaccaaaacaaaatgtctttgaattgtacttggtaactagaatttattgagaaaaattttagaacagcttcaggttttagattttctctccaaaataaaaatgaaccaggattgaattacccaaatggcaatcagatatttttcttgttgcctgtggcataacccacactttttacatttctctaagtttatttcaaaaagtggtgcctagtggcccaattacctggcactagtccagggtcctctgtggggcaagaaaggcgggggaattccttaagctaaaataatcagccagaaagagttgatgggtgtctatttgcacagccagccacctcactttttgttcttagtctttcccaagaaaatgacaactcataatgtttactgtaaggacagtcacagcatcctatgacctcttccatttaaggatctctaagaaataaagagttcacgaactattatcagtactgctttcacctcccatttgcggacataatagaataagaggtgatctaatcaagggaggctaccagtctagtggaaaaaaagagagcctggaatctgaaattgtatctatgtgaccaggaacaagtcatgttacctcaagtttcttcatatataagaggagaaagaaaataactgtctacctatctcataggcctattagaagattaaaagaaaatgtgtattccaaaagcacttggaagacatggaccctggcttttgtctgtgaaccagagagatcctggaacgatcctatctatgatgtatgtgatgagggctttaggatgaggaaatataatgaacaaaatttaactggaattgatagggagggttattacaaattataacatggagaaatcatagctcctgtgagacatgccacaggcccttggtttatgtcaggcaaggcacaatgagcaaagcctaggtgtgtcacatagaagagggatcaaaaacatatcaaaaacctaaacataggtttaaaaaacaaaagaagcaaacattctgatgtttattttccctttttttaaatttttgccttcagacaatctgacagtttttttttttttaacttttggcaagtttcatcttacaaaggataaactaatgttccaggggcagcttaaagagtgggagagggctcctacggattatcttccttttaacacattctcttttagttctgttctgtggatgctcaatatgaaaagaacagatgtgcacattcatttagcaagttcagcagtgcttcagttgtctgagagtggttcttccccaatgggagtgggcaagaagccaggactggtgtggggtgttctcagcttcagctgtttttcggccaagaaaacacagtacccatgactccagtatcccttggaaccttacagacaatgggaaactgacaaactgtcaaatcccacatcctttgaagtctagcaaatttctaattcttttgaactgcctccacaattagaaacacactagtgtcaggagccacagagaatactgtttatttcttttgctcacaggctttgaagaaagaataatgcctgggtatcttggcaagagtttatctgtgactcccagttgattccaggtgtcttgggtctccaggagtatgttgttctattataaagtttaggaaactatccttggcatggatagccaagcagcacagatttccatagtaaaactcttaattattccaggttttgtagggggttgctttctccacaagctaccagatatccccactacccttcattctaccagaggaattccttagtttcctctcccaataccctgtaaaacacttctaaaccagagaccctctggaatctccatcatagacagtttagtcaattatttcctaatcataacctggagtattggatgagaagagagactttgccaagcaatatggtcaagagacaaaagatccaaatgtccggacgttccacctccccatacaagagatttcagagcttctgctgcaacaaaggccaatgattaaagtcattttggaaaggagtcctccgttgcttctgttgcgaaccataaacacaacttgtaaccctagagaagaggtggagttactgaaatctcatgctttgataattactgaatgacttaatcttggaaaacaaatagaaatcaatgttgagttctttaaaaaaaaatgttgctacatggagccaacacatctaatccatctttggcattacaagtcagtatgtgtcaaaggctaccaaaatcaactttggttgagcaccagggggtggagtctatcaactgatgagaatgattgatgagaatcttgcacaaacaacatttataactagttagaaagtttagtgattcaaactaagtatttaagatcagaagagagtcactggagaataatccagttcttgctgttagagcacatgaactcaacccttcttacactccagagaggaatgtgtagaacaggctggtcataggccattgtcggggaggaagattttgactggactgttgctgaatgaggtaggtactcctgggcctttctgacctgagtatccttgtagatgttccttacaaattctaggggtttcagttccatagcacagatagtccagagtacaagactcagaactctgaaccctcagtttctacttagactatgcctggagccactcaacttactgaacattcctgggtcagaccaaaagtcaaatgaacagcaatgactgttgctctgttgttctcccaactatgaagtagcttatgattgtgccacatggctgccgcccttcccagtcccttatgccgaatccctcctcctctacctccttttctatttgtaaatcaagataaatgttaccaaagggcaaatttttaaaatcgaaagtttataatctaagagaatgtatcataaaaggttatgaagattaagggagagaaggagtatgttatttcaagtggtaggccgggcatggtggctcacacctgtaaccccaacactttgggaggctgagacaggcggatcacctgaggtcaggagttcaagaccagtctgaccaacatgctgaaaccccgtctctactaaaaatacaaaattacctgggcgtggtggcgcatgcctgtaatcccagttacttgagaagctgaagcaggagaatcacttgaacccaggaggcagaggttgcagtgagccaacatcgcaccactccagactgggcaaaaagagcaaaactccatctcaaaaacaaaaacaaaaacaaaaaacaaaaaaacctgccacagcttttaaagaaaggctgggtacggtggctcacgtctgtaatcctagcacttcaggaggccaaggtgagtggatcacttgaggtcaggagtttgagaccagcctggccaacgtggcgaaaccccgtctctacgaaaaatacaaaaaattagccagacatggtcgtgggcacctgtaatcccagctactccagaggttgagacaggagaatcgcttgaacccaggcggcggaggttgcaatgagccaagatcgcgccactgcactccagcctgggcgacagagcgagactccgtcttaataaaaaaaataaaataataaaaatttaaaaatccaatgtgaagcagctagagcaagattgagggtctcaaaaaagacggggcctgaagaggacaatgagagaagtggaggttctaatatctctactgccgtttatactccataagccgaagtcagatacctaagtgatcatcagacaacagggtgctgacctaggttacacccttaaaattcatcagtggtgtcatctgcaagatattagtaaaccagcttgtgaagaatataagccacaaaccaggcagaaaacacaagagagcagatgaggctgaaccactaccacagacttccttcttttgtgtaattataaatactacccactgcattctggtttcagggctttaaaaagcagatgaactgtctctgttagagatacttttttataattaacttcagagtcatttattaattatcttttatagttaataaaaataagagggagctatgtttgggtttggagaacaatgacgattatcgaagtctgaatcttcgcctcccctccaaaccagaaaatataaagagaaaagaaataaaactgcacaggacccatacattcatcattactagaactaagagaacaatacatccttcaaattacttgtaggtagagtaaaaacaaattcaaacagagctcccttagcctgcctgcggctgccacaaacctaaagatagagtgggagagagaatgcctaaaagactgtcgtaagagtggagaggtgaagagagcttagaggaaacacagacaaaatcatgccatattaaaaaaactgtttttttctctatagtcacaccactctcaatacttccagaacacttcacttctgataccagatgtgtgggtttttctatacactgaccaattctgtgacaccaactggatgttctacaatttaattcaactctgacattaactggagttagcacagaccccacaggttaagagcccaatcccagtagatttcagatgccaatcgcaagtcccaggttgtcacttggacttctgatgaaccagctatatattagtgttcccataactacctccttgggcttgataatttgctaggacaactcaaataattcagggaaacatgtttaccagcttattatataataaaggataccaatgaacagccagatgaaaaggtacatagggctaggtgtagaggtcctgagtgcaggaacttctgtccccacagagttggagtgcacccctctcctgacatatggatgtgttcgccaacctggaagtactctaaaccctgtagttcagggatttttatgggggcttcgtcatatagacaccatcaattattagctcaatctccagcccctctccccttcccaaaggatggggaatggagcagaaagttccaagattctaatcgtggcctggcctttctcatgaccagcccccaaccaagaactcaccaagagtcacctcattagaacagaagatacacccaggaaactccaaggaattaggagttctgcatcaggaaccatggtcaaagaccaaatattagaacaaaagatacctattacccctattgctcagaaagttacaagccctttaaggagctctgtgccaggactgtggataaagaccaagatatatatatttcctataaatcacatactcacaagaagagaaattttgacaacagtaagtgccaaaatactgaatagatcttggtagttcatagggcttgaaagcggggacaccaccaacattcctggcagccaagtcagatgcatggacatcgtctttaaccacatcttcacactcatccctcatctgaactatcaacaatttcatggattttgctatctaaatgttcatgttctctaatccatttccttctccccagcctccctgttacttcccttgttcaggttgctatcctgtcacccctggactataacaaaaacctcttagattcctaccttcactctccttttccccttctgctcttcaatgtaacttccactttccttgttaaagtgatttttctgacagataaacttccctggcattcccatgctggattaggtacctcgcctgaatcctcccatagcctcctacatacctttatcacagcattatgactaaaagcatccttttggaattagacattttatacactagctcatgtacttacctgtttcatgacttgggagaagtttttaacctcttggaacctccagtttgtaaaatggaattaaaagtattgcctacctcataaagtaggaaattaatacatggaaaatacaacagtgcctgacatgtagtaagggctaaattgatattagctgacaaccaccacatagtattgaatttttctgcttatatatctgcctaacccactaaacctagcctcatcatttaaaaaaaaattataatgatttctgttttcaaaaaacaaacagattatccatgtcctctacatggaaagtctaatccaaaatgttttgtgttcaatcactgagcaagatggtcacattttcacaaaattaattaatctgaggctgggcatggtggctgatgcctataatactggcactttggaggctgaggcaggcagatcacctgaggtcaggggttcaagaccagcctcagccaacatggtgaaacaccatctctactaaaaatacaaaaatgagctgaggatgatggcacatgcctgtaatcccagctacttggaaggctgaggtgggagaattgtctgagcccggaaggaggttgcagtgagccaagatcgtgccactgcatacaagcctgggcaacagagcaagactcagtctcaaaaaaaaaaaaaaaaatctgaaatgagatggtttgagcatgatcttacttgaaggtatggagtagcctaattaatcatctaagctctttccaacttgctaattgcaaataataccccagtgttgtactaaggaagcttaatggacatgaccaaagtgcctgaactttgggacagccacaggccacctatgcaagcacagccagcccaccaggctgcagggtagagagcacaaacagcatttgcttatgacagccacaggctcaatgctcactgacggtggctgtctgcctgcccagctaacctgtagttcttctgtatggcctacactctaagaatggtgtttatatattttgaatggttgaaaaaaaagcaacagaagaataatatttcatgattatgtgaaaatgatatgaaattcaaattttcagtgtccataaataaagttttattggaatacagcaactctcatttatttacatattgtctatggctgtttctatgctcaatggcaaagttgggaagttgcgacagagactgtatggcctgcaaagcctaaaacagaaactacctgacccttcaaaactttacaggaaaaaaaaaaaagcctacccctgctctagggtgcaagctcctgtctgcttcacaattgtagtcactgtaggggaatgaattgttgtgggccaagtgaattgcttaagaaaatgtggccatgtaagaggcagaattggaataaaaattaggactcttgacagctagtcccacattccctaaattatattattacttttgctatcagagagctaatccacacacttccacaggaaaaagagctttgtcatttaaatggatgattaatttttaaaataaaacatagacaaaaaggtaattctttaacactcaatttttttttctttcttttcttttttttgacatggagtctctttctgtcgcccaggctggagtgcagtggtgtgatctcggctcactgcaacctctgcctcctgggttccagtgattctcctgtctcagcctccggagtagctgggactagaggtgtgcgccactatgcctggctaatttttttgtatttttagtagagacagggtttcaccatgttgggcaggctggtctcaaactcctggcctcaggtaacccacccacctcggcctcccaaagtgctaagattataggtgtgaactactgcacccaaccaacaaaccaatttttattatctgctttaaatactgaccatcatctattggttttagcctagaaatgtataatcacatagcatctctctatacacaatttgggtgtaataaatacatatacacattgacatatgtatatgatctaatatataccaaggtgtatacatatatttaatttacctacatatactagacatagatgtacctttacatatatttgcatgtaaacacacatatatgcacactttcactgcatacacacctgccagtccttctggtgcatcctaatgaaacctgattttctcctgctaatgacattagcacctggctgctaatgacatttcttaatcaactacctcaacctgctaacactgaaataattagaaatttttgtctagctgcaagattttcatttagagataatctgcataaaaaatacacattcgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtagtggcgggcgcctgtagtcccagctactcgggaggctgaggcaggagaatggcgtgaacccaagaggcggagcttgcagtgagccgagattgcgccactgcactccagcctgggcgacagagcgagactccgtctcaaaaaaaaaaaaaaaaaaaaaaaaaaaaaaaaaaaaaaaaaaaaaaatacacattcgtgtgtacggatattatataaatgtatttatattatgcttcattctaggaaagaggaatcagaaatgcaaaccagattaagagtataaaaagcaaccagaggccaggcacggcgcctcacacccataattccagcagtttgggaggccaaggcaggtgcatcacctgaggtgaggtcaggagttcgagaccagtctggccaacatggtgaagtcgcatttctactaaaaatacaaaaaattagccaggcatgatggtgcatgcctgtaatcccagctactcgggaggctgaggcaggggaatcacttgaacccaggatgcggaggttgcagtgagtcgagatcgtgccattgcactccagcttgggcaacaagagcgaaactccatctcaaaaaaaaacaaccagagtaaataattggatttattccattggttctatcaaaacaacttattaagatggaacttctaatacgtctgaactgtaacactgcatttaagcccatttctttgccatactttgccgtctgttatttaactgacctcataaaatcctcaagaaaacgatttcttaagaaatgctcagttacagctgcatcaaacatcttctccaaaatgcctttcaagagcaccaaataattttagtgtaacataatcattgaatgtctgttgttctcagaaaagaactaacgttggagaaagtaattaaagccagatcctaaaagtcaatacatctgaggctccagacactgactctgcgtgtgctgtggtttccactaaacactaaaatgaggtaattttttattcttattatgttcacaactcttgcaaaacctaaccagggtaaaaaatttattcatttttctcattaagcgaattatgtagtgtgtaagttttcaatgtcttgtgctaaaaacagaatctctcctatagttaccttatctaagtaacgagagagcattctttataaagtgcagataatctaaacatctcaatttactcactttattttattctctttccttctctttttaaatccaggtaaggaattgtgaaattagtttgtaagtcactttctcctcccccggctttgtctgttcccttttgggacttaataattgggctggaggaggcaaggggaaagattaccacatgcccagaagtatgaatcttggaagaggtaaaactggttaaaagccacaacacagacacacacgtaccaaaagcagggaggagaaaaagaaggatgagaaatgatgaaaaagaaaaatttcagggttgagggtgaggggagggaactcagagtacaggtcaataggtgcagcaaaccaccatgacacacgcatacctatgaaacaaacctgcatgttctgcacatgtatcctgttttgttttgtttttttagaaaaaaaaaagaaaaatttattgttcatgaatttgagtagaacaactaatcttttagattactgaaaataaatacatgtcagtttgtaaaagattaaattgttttaaagatatgccagaactcagctgtatggtcatatagttaccaaatgggtaaatgctttcatctacaatctcagagcacctaaaaatagtacaatttttaggctccaaagagtgaaaagaaaaatgtctggaccccacagaatcaaaaaagaatgacagaaaacactggtctcctgatacttaacatcaaactttggccaatactccttcatcccaaggatgagaggagcatctaaaaattaatcaataatgtacattaagaggctatgtcatcaccatggtaggtttcaatacttctaaatgatttctagttattgttcaaatataactgatcaccatatgagaaatataacccagtattaaaaatgttaatattttaaactgttttgtctagtctatcaccttgtcaaagatcttttgaaagcctgactatatcatattcatagataaaactttgtataaatgcatgtttaacccttaagttaattgcagcaggtaaatcatggcttaactttagaggaatctttcaactttttgtcttagtaggttacatacatctaaatgatttgtaaccctttttgttattaaagagttacaatatttccaatatggaagtttctagtcctctctgggatatttgttttgtgttcatttatttaactctacactattaaatatactaccaggcagatttcttagggacttcttagaacattagtatccctggtctaaaattgggggaaattgacattatgtgacactaatgctccttaaagcagattcccttaagtatgattacattgttcccagtgagcaacagcagacccagtgagaaacagcaaaaataatttgaaaacgtttttctctcactaagctgtcaaacaaccattcagaacagcagttctccgtttctacctttcattttcataaaactgttactgaattagtttgctgagaaggtataagactttgggccagtcatttaagcgctcttggcctttgaggtaattttttattcttactaccttaacattagggagttgctttagatgtttctaagattctttcagctccagaagtttagaattcaatgctagaggtctagagaatcttttgacctggaatcctctacagcccacactagttgggatggtattttaacagtctcctgttagtcatgttaaaacttctgggaaagtctacttcaaattgacagagataatttaaggtttgccatgctctgtggacttctcagctattattgcattatcttcctacttgtgggacaaacccttttataggtttttctttctctctttcttccctccttccttccttccctccctccctcccttcctttcttccctttccttcttctccttctccttcttcttttcttcttcctcctcctctcctcctcttccttttccttcttcttctctctctctctctctctttctctttctttctctctctctttctattcctactttagcttcaggtttttatgagtgattggggttttaaactctcaaggcacatttatctagagcttccaatgtgtttcagtgcttgtattcctaggttactgcttcccttcttgttcaatacatgtatgacacatgactttggggttttttctaacagcatattgatatgcttgaagtgatgaaaaaattacactgtggcttgctcacaatatgtactttatgacttcctacacatcacttaagattaggtctaggaattttacttttctcacacgctcttgaagaatcaattgagcacgtaatcatttatcctagccaattacttatctcatgctttccattcccataaaggatgttaggaagtatgtttgagtaacttaagttcctaattgttgagtatctggcataatttttcaaactcccccaactttcatgattagatcatataacatttctatccacagaatactttgtttatatgagaagacttttaccacactgcagttcatcgctctccatgtaaaatatccctgtttattttgaatctgacatgaggaagggagagagtagacagggaaaaatgggaaaataaatctcaatcactttggctgtggagacctaactaagagcctggaggtgaacttggttcaactaagatcacatatgtgttgttacatttccaatccatttctgttttttctactgtgacccacaaaatttattcaatttgtacttaattaaactaaaaagtttcagcacagcaaaagaaacaatcagcagagtaaacagacaatgcacagagtgggagaaaatcttcacaatctatacatctgacaaaggactaagatccaaaatctacaacgaactcaaacaaattagcaagaaaaaaacaaacagtcccatcaaaaagtgggctaaggacatgaacagacaattctcaaaagaagctatacaaatgtctaacaaacatatgaaaaaaaatgctcaacatcacaaatgatcagggaaatgtaaaccaaaaccacaatgcaaaaccatcttactcctgcaagactggccataatcaaaaagtcaaaaaataatagatgttggcagggatgcagtgaaaagggaacacttctgcactactggtgggaatgtaaactagtacagccactatgaaaaacagtgtggacactccttaaagagctaaaagtagaactatcatttgatccagcaatcccactgctgggtatctacccggaggaaaagaagtcattgtacgaaaaagatacttgcacagacatgcttatggaagcacaattcgcaattgcaaaatcggggaactaacccaaatgtccatcaatcaatgagtagataaagaaattgtggtatggaatactattcagccataaaaatgaaacaatggcatttgcagtaacctgggtggaattggagaccattattctaagtggagtaactcagtaatggaaaaccaaacattgtatgttctcactcataattgggagctaagctatgagaatgcaaaggtatatgaacgatgcaatggattttggggacttgggggaaagggtgggaagtgagtgaggaataaaagactacaaattgagtacagtacagtgtacactgcttaggtgatgggtgcaccaaaatctcacaaattaccactaaaaaacatactcatgtaaccaaacaccacccattccccaaaaacctatggaaataagaaataaagtgaattaatcagttttcaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgatgaatgggatctaattaaactaaagagcttctgcacagcaaaagaaactaccatcagagtgaagaggcaacccacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttctgcagccaaaaaacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacactgtcggtgggactgtaaactagttcaaccattgtggaagccagtgcagcgattccttagggatctagaactagaaataccatttgacccagccatcccattactgggtatatacccaaaggactataaatcatgccgctataaagacacatgcacatgtatgtttattgtggcgctattcacaatagcaaagacttagaaccaacccaaatgtccaacaatgatagactggattaagaaaatgtggcacatatacaccatggaatactatgcagccataaaaaatgatgagttcatgtcctttgtggtgacatggatgaaattggaaatcatcattctcagtaaactatcacaaaaacaaaaaaccaaacaccgcatattctcactcataggtgggaattgaacaatgagaacacatggacacaggaaggggaacatcacattctggggactgttgtggggtggggggagaggggagggatagcattgggagatatacctaatgctagatgacgagttagtgggtgcagcgcaccagcatgtcacatgtatacatatgtaactaacctgcacattgtccacatgtaccctaaaacttaaagtataattaaaaaatagtaaatatttagctacattttaatactttacatgttataacaatatcattaattttgttgtttttaagctttatttgtacttgtaaatttttattttgtagttacttaagaactaaaggcaaaagtgatttatattttgcaattctgttatttcaataaaaatagtcctttttattcattggaaaaaaaagaaaaaaagaaaaatttcaatcttaattctttaacagatgatcttaatgatcttacctgaattccatcatcagtgattctataacattcagatacagaaagttccttcaattttttatgtctggaaagcacattcaaaccctaaaaatatttaatataaagatcattttgtgattatcatttagtatggaatatatagttccaataaccatttatacaaactgacaacataaaaaaccatttatgaaaactaataaattttagttgctgtcatatttctttacacttaacaaatcgtaagaccacttagattaggcaatgccattaagtaaaattttcaggttgtctctaatgttttacaaaagcttttatggaatcccagagtcagaaaactccttaggaggttattatcttgccacttgtttccagataaatgttatctgaatcaatataaacaaatccaacttactaatttattttgaagatacttcatgtggataaagaacctatttgttaatatatttttatttatgcctaaccaaaacatctaaaaatctttagctcattttataatgattaatcccttgaagaggaagagaatagatctttatataaaggcctagagacagataatcattcagtcatagatcatttctttttcaggttaaaggccttggatttttttaatttaaaaaaagagattgcactttcagccataattttttttatgtgtgcttgtgttgtcccatttctcagtactttttccccaaatttactggcacaacactcagataaggaactgactaatgtggcttattgatgccatccttctgtttttcaatcaggatcacattacttttatgtaatcccatacaatgtacttcttaaactaggtggacaagagcagggttgttccccccaccaccccccaacccacccctcacctgccgccattctatgattccagggctggctggcagggaaaataccagaaatgacacatagatttgtcctttttatattttatttgcaggattggtttatattttatcgatcttaaatacaacatttggaccacaatttaaaatgggctatgcaaatattatatcttgttttttttgtttgtttgttttgttttgctttgctttaattcccaatgcacagattgggccttctcataaaaaaaaaaaagcctgtattaataaaaatgttttatttaagcctctgcttaaactatgatttctaatttcttttaatggtattgcataccactccaaaataaaatctgtgaattcttttaactttttaaaaacttttatttgcatttattttatgctgaatttattcctgtgccataagtttttatttgtttcttcagtttcttcaggaatatctttttcttctatgcaacctcattctttcaatttgattgttgactgtggattcttttgctaggaacacattatgttttctgcctccctgtttcaaaacaaagtctgaccaaatcctgtggagccatcacatgtggtctgggttccagatgtggatgctattttattcatgttaaaagaattggaagagtttagatattccccaatagaatccaaattgtttgaacacaaatatcaagtaacagatgcaaagtttgtctctttaccctatacttgataatagctaagtatgttttagtatgctatagaaaatttgtcctatgaaactatctctgaagttttcacttagatttcacttttatgtagtcaagttagaattttttaagataagctgtaaatgaagtgcatttgctaaatatgacatataacaacatatatgcttactactttattcaaaatcattaaaaattaaaatattaaaacagaatgtcatgtctcatcactgtaattgttcattaaaacatatggcctaaaaattgaattgatcaacattattagccattagataaatgcataatgacataccacaacgtacctactaggatggctataatttaaaatacagataataaaatgcattggtgaggatgtggacaaactggaactctcatatactgctagtggaaatgtaaaatgagccagccactttggaaaacagtctgcatttcctcaaaaattaaacatagagttataatatgacccagcaattctactcctaggtttatacccaaaaacagtgaaaacatatgtttacaaagacttgtacatgaatgtttataccagcactatttataataaaatccatgcattcttcaacaaatggtgctcttcaataagtggtgctgggagaacttgatatctgtatctagaagaatgaaactagactcctgtatctccatatacaaaagtaaactcaaaatagactaaagaattaaacataagacctgaaacgatagagctattagaagaaaacagggggaatgcttcagggcattgatcttggcaaagattttatatagctaagacttcaaaaccacaggcaacaaaaacagacaaatgggatgatatcaaactaaaaagattatacacaacaaaggaaacaataaacaaagtgaagagacaacctatagaatgggagaagacatgtgtgaactagtcatacaacaaaggactaacatccagaatatacaaggaactcaaacaactcaatagcaaataaacaaatgatctgattaaaaagtgaacaaaggaaccaagcagacatttctcaaaagaagacatatgtgagggcgatgtggctgtgatatctgtcaccccattgatcaccagggttgattcggctgatctggctggctaggcaggtgtccccttcttccctcaccgttccatgtgtgtccctccccaaagctgcgtgctgggtcaaagaggatagccaaccctgatagaggaggatgggttattggtctaggatacaagtagctgcactcccctgcttgaacctccaaacctctcaggaagacatacaaatagtcaacaaatatatgaaaaatcatcatcagggaaacgtacatcaaagccacaatgagatgtcatctcaccccagttagaatggctattatcaaaaagacaaaaaataacaatgctggtgaggatgcagagaaaagagaactcctatacactgttggtgaaaatataaattaatacagcgattatggaaaacagcatagaaatttctctaaaaacagaactatcatatgatccagcaatctcactagtgggtatttacccaaaggaaaggaactcagtatatcaaagggatacctacactcccatgtttactacagcactactcacaatagctaagatatagaatcaacccaaatgttcatcaacagacaattgaataaagaaaatgtagtatatatacacaatggcatactattcagccacaaaaaagaatgaaatcctgtcatttgcagcaacatggatgagcctggaggacatgatgttaagcaaaataagataagcacagaaagataaataccacatgtcctcactcatgggagctacgaaaaagtagagtacaattgtgggaattagaggatgggaagagtggcagggagggaggatggggattggttggttaacaattacaaaattatagtttaataggaggaatgagttcaggtattctgcagcactgtggggtgaatatggttaaccataatttattgtatattttcaagaaactagaagagaggatctttagtgctcacaacacaaagaaaatgataaatatttgaggtgatggatactaactaccatgattagatcattacacataaggaaataacactctgcattccacaaatatgtacaattattatgtgtcaactaaaaataaaagaaaaaagtggaaacccaaatgcctatcagttgatgaaaggataaataaaatgttaggtccatacaatggaatattatttggtaataaaagtagtactgatgcatgctactatatgaacgaaacttgaaaatatcatcctaagtaaaagaagacagacccaaaaggccacatattgtttgattccatttgtatgaagagtccagaataggcaaatatataaaaacagaaagtagattagcagttgcctaaagcaggctcagggtgggacaggcataaggagtgactgctaatgggaagggcttttcttttgggagtgaagaaaatgttctggaattagattctagtggtagttccaccacaaacaaacatactaaaaaccactgaattgtatactttaaattggtgagttttatggtacatgaattatgtctcaataaaaaatgtttaaaaaaagattgatgtaataattgtataagtacataaaactcagaaaatattcctacagcatccttaagtccaagatgaatacagatgttacccacttttaatatatttttgttagcaacttcagaccctgatgacaaaaatagtagcaaaacggggagcaagagatgtcaccctgctcatgtgttagacaagtaactagaagccctttctgctgtaagtaaacacatctttgtaactgagcagcaacaaatcgagccggcagagatgaggcctccactaaaaattgcctcatgctggttacaggaggccagtgaatttcactgcctaataagtgaaacacactatttcaggcaacaggattcacttttaatgtgggttttttttttctcagaaactttttagattagtgacctaaagaatgtcagagccagcaaggtaaatattctgtttggcactgtgaggttcataaatgctccaaattaggaggtgttctctgaaacaagtgacatttacattttacagatttctgatgccaaggttttagccctgggagggacaggaagagtggagtgggaagagtggagtgggaagacaggccaaaaatgaggaggcaagaggtaacagcaagatagagtgactcggtctcagtggggcaaagggcagattgatgcttacctttcaggaaagctgtggcatcactgcaatggaaatcatccttggtctccctcataagtcagccaaactcatgaatgcttttgctggagagaggttttgcttttattttcccaaagcataaaaagggactacattttatggtcagctgaagtgcagaggaaagcagctggagtggtggcctggggaagtcaccagcattgcaagttgcatgagaatgtgaggcaccagaaattcacaggaatcctggggagcactttgctcctccattgctaatggaattaaggggcctgaatcttaggggcccaggagtcctgagtggaaaagtggcttcgttatagctccagtatcacgttcattgaggggcatatcaggacataaggctcaaaaggaagcaagcaccaagtcacaagaacctcgtacattattctaaggaatctggacttcatcctatgcaacagaattaaatagaactttctctctctggggaatatgagtgggtacataagtcactataatgaggttccttatgtaccaactcattctctacagaaagaatgaagtatgtgtttcaagagagctatagggaccacacagcagggaatgaatgcttccagttggaagaaagagatggcagtctagaaaagagtttcacagaggaaggagattttgaatcaagccttaaagattaagtatcattttgacaagtgaaacaatgggaacagtgtttcaggccgaagaaatagcatggacagagacttcatgtgcaaagtgtgagttgttgggaagtagttcagtttggggtcactgggagtagtgggagggaagatggaacactgccaggaacagacacatgcacacagacatttgagagcagacaaatccttgaacactacactttccccacactttttcatctggaattgtttagctgatgtacatagacaatgtcaatgaactagttaccaaatgttggaatgctctgtgtgtgtgtgtgtgtggtgtgtacttactatacggctgagtcatactacatctggcttagactatcaccaacataaacagaaaacatgcttccccaactctctattttgaaaatattcaaatgtacggaaaggtttaaagaatggttataaagaatactgacatacacttcatataaattcaccaattataaacatttgccacatttatttagttgagtgtgtatatgaacatacatattttattcatatatatgtatgaataaaattttatatacatatgcatagtttatatatagttatatatatatacacacacatatatatatacacacaaatatacataaatttccctgaactacttgaaaataagtttcagatatcatgatgctttatccctaaatatttcatgtgcatctccttaggaataacgacattttcctatgtaactatgtagtattatgcatatatagtatagacatatatagtattatgacacccaagaaaatgaacagtaatactgtaatatctagtacaaagtcaacattcaaatttttttgtatccaagacccaatttgtgcattggatttggttatcatgtctttttagtctttttttctttaaatttttcttttaagacattgactttttttaagggtctaggccagttattatgcagaatgtctcacattctggatttttctaattgttccttatgattagattcaaggtaaactttttttgcaaaaatactcctgaattattatagcatcccattgggaggcacatatgtccagttgttccacaactggtgatgctgttgggccacttggttcagaagatgactaccatagatctctttattagaagaggtatatttacccctttttatttaaaaagtaatttgttgagatgttatagtacacccagaatattctgcaaacatgagaagtgtttgttataaagaatatatagtaacatacttaggttcaaaaagcagtacacaaaattatatctgcaggccgggcgcggtggctcatgcctgtaatcccagcactttgggaggccaaggcaggtggatcacctgaggtcaggagttcacgaccagcctggccagcatggcaaaaccccatctctactaaaaatacaaaaattatccgggcatggtggcaggtgcttgtaatcccggctactcgggaggatgaggcaggagaatcgctttaacccaggaggcagaagctgtagtgagccaagatcgtgccactgcactccagcctggatgacagagtgagactgtgtctccaaaaaaaaaaaaaaaattcacatctgcatatgtgtgtgtatagtgtatgtatatgtgtattaaaagaaacagacgttttgggcagggcgcagtggctcacgcctgtaatcccagcacttttggaggccaaggcgggtggatcatgaggtcaggagttcgagaccagcctggtcaatgtggtgaaaccccgtctctactaagaatacaaaaattagccaggcgtgtagtccccgctactcggtaggctgaggcagaagaattgcttgaacccaggaggcggaggttgcagtgagctgagattgcactactgtactccagtctgggcgacagagggagaatctgtctcaaaaaaaaaaaaaaaaagaaaagaaatggacgttttggagggtgcgcaatgatatgaatatgttttttcattattcatatttctttttgtattactagtgtttgtgaaaatagcataatttggaggaaaaacccaatatgtgtctgttattgaatatttttgtgtatcaacaaagaattatataaaatatttacactaggctttatttctttatacaaagcaacacagttctggttagtttactttctattctaaacaaaccatcagcacaaatgtgctaatattcaagcaaagtactcagctatgaatgttaacatgtacaagtattatatacatagatgaacagttttactttacaaaaattgatggatactgctctatcttcatattacttgacccagctttgaagcctgactctgctgaccatcccctgctttttgaaatagcatcttccttgtttctcatgatattactctgacctctgtctccacctacttctctggatgttcgttttcagtttcctttgtaggttcatcttccaaatctattcaatacatactgatgttccctggagcttggaacttgaccttctcttctctttgtgactctcatccatggctttgaccacttcagccatctctagatctagcccagatctccctcctgagatacagatcttgttctctaactgataactagacatctgaatgtgtcataggcacctctaactcagcactgttactttcagagaactagaattcaaactggaagccatgagatttcattgagctcttcctattctttttgctagcttcagtcaggagtctgtgaaagatgaatgctcatgatggactttcctttgatttaaatacaatggctccttcctctgcattttgtacctttatgaccctctttatagggctccaatttctctatatgggaaatctatataacctagggtatttgatatttgaattcaggatattggaaaatgcactctatgaaataagatggaatggggcacccaggactccaggatgtagttactgggggtatagatcatgggaaatctaaaaagtcccccgacagtcagtaaacataagaaggcttctttcatgcctttttaatttgtttttaaggataaaacagagtataagtttttgctgtgatagaggggataaaattggggggggggatggtactgaaaatccttgtgtgagttttctttcagaaatgcttgaatttgaacacactgaattcctatgattccagatatcctgaggaaaacaaagcaaagtaaaacaaaacaaaaacaaagattccaaaagtcagatggatgtttgtcttctctgtcacccagaatcaaaggggcccatagtttagagagatgtgctagtactagtattaaacatgtccaaaatggaattcagtatcttgtctccaagccctaattgctctcctaggttcttttcctggtttgtggcaccaccatgttcacaactgaccaaataaaaaacctgagcatcgtctatgtctcctctctgcctccctgttccccatattcagccaatgaataagccctaccaatgccaccccctaaatatctctcaaatctgccccctctgccgccactatcaaaacctcattatttctagctatcattgcaattgctcatcctttcttcaatagatcatccacactgccaccagagttatgtttcttgtgcacaaatctgtcctgctctcctactcagagttcttcaatggctcctactgcatactgcatgtagcctgaattgctgtgcagggcactcaaggccacccacattctgccctccatctctttctccagcctcatctccctccacatcccctctcttctctggccatgctctgacagcactgagttatctgtgaatcccaacacataaccctccttatgcctccaggccttatcatctgcttcttcctccagctttcagctgcatcccaaaagctaaaaagcttcccttgactcctccacagagacaacagagacaagtgttcatttttttttttaagatggagtcttcctcttgtcgcccaggctggagtgcaatggtgcaatttcggctcactgcaacctctgcctcctgggttcaagcgattttcctgcctcagcctcccaaatagctgtgattacaggcgcccgccaccatgcccagctaatttttgtatttttagtagagatgggctttcaccatgctggctaggctggtctcgaactcctgacctcaggtaatccaccctccttgacctcccaaagtgctgggattacaggtgtgagccaccgcacccagccaagtgttcattttctaactcatctgtgctgttgtggtgcaatgcctccatctccttttcagcaaacaaatcttatgtcagaattcaaataaataatcactaagatgcatatagtgcttgccatgtgccagcttacatgcattgccttacttaatccttataacaacactgtgaggtaggtaatattataatcaccattttaaagagaaggaaatggaggcacagagaaattgagtaacttgcctgcggtctcaaagtgccatggcaccagctgagatatgaacccatactctgaattcatgcttttagtaacttttaactatacagtgatgttgcttttcttgttgttattttgccattagactgtaccttgagaccagtactctttcagtttggtactcccagaacttaacaatgtgtatgatatatagttgacaatgagtaaatatttgttgagtgaatcagtctacctataaaattatctatttatacggactcaattttctcttatcttgctggcatactctcagaatttttggatgaaatgcatttccgtttggaattctttgaatcagggtttacatttcacatgcttctttctgaaagatttgctctgtttggtattgcatactgcattctttcagaaataaagaacaaaagttatacttggaaatatttattatctcaattagcacatcctctttctaaattcactgataatactgtcatgtacaatgttctcgaaaatttctcttcatctcccaagcgatcttcccttttctactctagttagtaattatgcttttataaatataatgtaccttttcttctcaatattttatttacttatttttgtgttttttttgtttgattgtttgtttttgtttttgtttgagacggagtcttgctctgtcaccaggctggagtgcaatggcgtgatctcagttcactgcaacctctccctcccagattcaagcaatcctcctgcatcagcctcccaagtagctgggactacaggcacgcgccaccatacctggctaatttttgtttttttttttagtagagacggggtttcaccatgttgggcaggatggtctcgatctcttgacctcgtgatccgcctgccttggcctcccaaagtgctgggattacaggggtgtgccactgtgcccagcctattttattttactttttaagagacagtgtctcgctgtatcacccaggctgatctcaaactgctgggctcaagggatcctccagcatcagcttcctcggtagctggaactactagtcttctcaattatttttgtttatttctacttaatcaattgttagtatgaattttgtaatcatatttctttttaaaatgtatcaacctctctgacctaatttattgacctacaagtctaaaggaaagcaagctttgatcaccacacagacatagattctgtattgtgatgcttatagaaggaaggaaaattggcatctctgttacctgaaagtagaccaacttgccttgagactgtttgcctcctacttgatggaggtagagaggagagtcatgctgccaaagatccatcttgagggaagtgacaggctcaagttggtcgcttctgtttgcagtgtttttagtaggcactttgctagaaacaggagacaatggaccataacctctgtgagaaggaaccactatcactagcttgatgggaccaacatagtcatgtaaggccactggctggagagaagggcctgaggaggactaggagaggtccagctccatatgaaaaaaaaccaaaagcccataactgggcagacttcttgttatgtgctttttgaaaatccacggcaaatccatttgtctctgaactaccgtgcttcctttcaactctcattcttcctatttcttgaatcccaagtgatttcatgtgtttcctgctttagaggttttgcttcactggactcaggctttatttttgtgtgtgttccatgcagatgggtggtctcttgcaattgtatcatcagattaagacacgcagctgtaagtgcttccactccagcccagagcatagctgagacaatgtggaatttaaagaagacttaagtgtttggttaagaggaaggaaatggtgccagattcattcattcactcactgatcaaacattttatgtgcctcctatgaacatcttgctaggcatcccaaagatgggatggtcctgtctctgctcttgggaagcttacagtgctatagggagacaggcatggaacagacactagaatataacaagctgattgcttcagtagagacatatacaaagtgcagtggaaatacaaagaaggagatcctaagcctgcccagaaattctaggaaagcttccccacagctgaaacttaagagataagcaaggccaggcatgacagctgacgcctaacatctcaacactttggaaggccaaggcaagaggatcacttgagcccaggagtttcagcccagcccagggaacatagcaagaccccatctctacaaaagaaaatttgaaaaatcagccagtcatgatggtatgtgcctgtagtcccagctacttgggaggctgaggcaggaggatcacttgagcccagaaagttgaggctgcagtgagctatgatgatgccactgcactctggactaagtgacacagaaagactctgtatccaaaaaaacccaaacaaacaaacaaaaaaaaagaagaatttactaggtggacaagtagtggagaaggtgtttcagacagagggaataacttgtagagatggggaaacaagaacacagcatgtttgaggagctgtaggagagtcagttctgtgtgtctggagctgaggatgagaggcgggagtcagctggaagcagggctgcaggggtggccaagggccgcctcaggaagagcttggtccaccagcccattgatactgtaagcagtgtggagtccccaaggaactctgagccagggagtgatagacttagacatatatatatatatatatatatatatatttttttttttttttttttttttttgagacagagtcttgctgtgtcgcccaggctggagtgcagtggcgcaatcttggctcactgcaagctccgcctcccgggttcatgccattctcctgcctcagcctcctgtagctgggactacaggtgcctgccaccatgcctggctaattttttttgtatttttggtagagacggggtttcaccgtgttagccaggatggtctcgatctcctgatctcatgatctgcccacctcggcctcccaaagtgctgggattacaggcgtgagccaccgtgcccggccagatattttttaagttttgttttttactgacacaaagtaattgtgcttatttatgggatacagtgtgatgtttcaacacatgtagacattgtgtaatgatcaaatcagagtaattagcatatctatcacctcattgatcatttctttgtggtgagcacatttagaatcctttcttctagctactttgaaatatacaataatacattattgttaactatagtcaccctgctgtgcaatagaacactagaacttattcctcctatctcactgtaactttgtacctattgaccaacctctcctcatctcccctcaccactccctccccagcctctggtagccattattctcctctctacttctatgagatccccttttttcagattccgcatatgagtgagatcatgagatatttgtctttctgtgcttggattatttgacttaacacaatgtcctttaggttcatccatgttgtcacaaatgaaaagatttcactcttttttgggctgaatagtattctattgtgcatatatatatatcacatttttaaatccattcatccattgatggacacttaggttgattgtatatattggctgcagtgcacacgggagtacagatatctctttgacatactgatttcatttcctttgtggtttttttgttttgttttgttttgttttgtttttgagatagtctcactctgtcactcaggttggagtgcagtggcactatctgggctcactgcaacctctgcctcctgggttcaggcagttctcatgcttcagcctcccaagtagctgggatcacaggtgtgcaccaccatgtccagctaatttttgtatttttagtagagacgaggtttcgccatgttggccaggctggccttgaactcctggcctcaagtgatccgcctgccttggcctcccaaagtgctgggattgcaggcatgaacctctgtgcctggcttgatttcatttcctttggatatataccaagtagtgggattgccagaacatatgatagttctattattaattttttgaggaacctcgctaatgttttccataatggctgtactaattgtaatttccatcaacagtctataagagttcccctttctgcacatcctcgcctgcatttgttactttttgctttttgataatagccattctaactggcgtgaggcaatagctcattgcagttttgatttgcagttccctggtgttaatgatgttgagtatttcttcatgtacttgttggccgtatacatgtatgtcttcttttgagaaatatctattcaggtcttttgcccatctgattatttgtttttctgctattgagttgtttgagttccttgtatactctggatattgaacccttgtcacgtaagcatagtttgtaaatattttctcccattccataggtggtctcttcactctgctgtttcctttgctgtacagaagctttttaggttgatgtaataccattcgtgcattttttttcttttgttgcctgtgttttcgaggtaccatccaaaaaaatctttgcccaaaccaatgtcctaaagtgtttcgtctattctttattcaaatagtttcatatttctggctcttacatttaagtccttaatccattttgagttgatttttgtatatggtgagagataggaatctagttccattcttctgcatgtagctatccaggtttcccagcaccatttattgaagagaatgttctttccccaatgtgtgttcttggtgcctttttcaaaaatcagctcgctataaatgtgtgggcttatttctggtttctctattctgttccactggtctgtgtgtctgttttttatagacagactcagaacactgcagcaaaggtgagtacgagaaacagtgcttgaactaagccaggggcagtggggatggagaggaggcagatgggcagttataagagatgattagactctatcaatgactattaaagttctcacattggcttctttctattctagtatagtatttagtagtagattttttggctagaaatacctgaaactagatagccttataacacatacaattaaaactaacatggaaacggcatgccaatattcaattagagttcttctttttgcaattcaatttgaaaataatctgtatgctatcagtaatttaagacccattattactgtgataatagtaataggtaacactgctctagggaactatgctgtaatgtggcagagataatatacagcacattaggaactcaacaacacttattttttaaaaatctagagacattaaccatcaccatatgatttatgttttcttaaagaaagaatgaatccataatacaaacccattgatattgccttgaaatgatctagattgagaagtgtgattttctgataattatggacaacatgatcaatatttataatagaaaaaataatgtcataaatataaaaattggcactattaacttatgtcaagatgcttttttgtcattatcatcagtgattacttgctcagcatctgcccctacccaggcacatgaagaacggaaggagtcgcagacccaggcaggaggtgtaacatacagaaaggtcctgaggtaggaagggatttggcttgtttgcagagctaagtgaaagcagtgtggctgagggaaaggaaatgagcagagcaggggcatgaggtggtcctggagtggtagacaggggtttctttaattaacagtaaatgttctttcaaattttggtcatagctgggtgtagtggcacttgcctatagtcccagctactcaggaggctgaagcaggagtattgcttcagcccaggaggtcgaggctgcagtaagttttgatggtgccactgcattctagcttgggggacagagtgagaccctttctctaaaaaaatttttctttctttaattctcatctttctgtgatttaatttctcagttttattagacactgttgttattcccattacactccacacttgactacatcacctggttctcttacaatctttttgaccttctttctttagtctccttcatggattcatcttcttctttccactccttaaacactgatgttctgctatgttcttcctgggagtacatttctcctcatgcccctatgccctccttgaggatcttggccacattcacacctccatgagaatgactcccccatctgcaggtccggtaatcatttctctcccaatcctttggcctgaatatcccacagattctaactcaatctgataaaacgaaaaccatctttctctcaaaacctgttatttctcctatattacctatctttttagaggtgggacctccatcctcccaaagccagattttaaaaaaaaaattttaattttttttttttaagacagggtctcactttgtcacccaggctggagtgcagtggtacaatctcggctcactgcaggcttgacctcccgggctcaagtgatcctcccacctcagccccccaggtagctgggactacatgcgcatgccaccatgcctggctaaattttttttttctgtatttttgtagagatggggttgtgtcacgttggccaagctgctcttgaactcctgagctcaagtgatctgcccacctcagcctcccaaaatgctaggattacaggcgtaagccaccacacctggccaatttttaatttttttattccaaagccagaacttttaagtcaattcttatcctcccatccctccaccgaggtccccattttccacaataatcaatcaccaagttctttcggttttagctactaaacattctttaatatgtcctttccatgcttgttctagcctctgacctagttcaagaactcctcatctcttcctttaactactaaaatacctcctatttccctccctgcccccagtccttctccttttcagtctgtcccccagagaacaactcaaataatctacctaaaatggaaggctgactatgactatgactcccctacacatcacccattggttcaagtccaatctccttgacacagtatgacattccctccatgatatcttttttatatagtgtattctagcaggactaagctacatcaagttccttgaacaaggatacattcacatgcttctgtgttgggcaggctgaattaagagatcctttcctctcctcacctctatcactatgcctgccccatcacatctaaattccccacacccacccttccaaattgggctgcagaaaataggtcttactcacatttgttaatcctagagcctagcatttttttccttcattcaatgagcaattaatctagtgcctactacttcccagggttctgggaaaacaacgtttcagtcttcatggatctgatattctagtgaggggactccaggacctacataacaggcgctcaagatcttgtactcataataaaaaattctgaaaatcaagcaaatgaaagagtctttttaaaccactgtctaagcacactgtctgggacactgccgtgactcacttttcctttaaacaacaaatatggcggtgactaaggcaacttaagtaacagactgaactgccctcaccatggatcctgtggtctttagcaaatgataatccaattaactagcaggaaatattttcccacatacatggagatataacctcacattcaaataatcctctggagcaggaagggaatgaataatagcccatttaagtgaacattttgaaaagctgtagaagattaaagatttctaaagataccttaagatattatcacattagtaagctatttctcccacttagaaaccctatcctgtttatattagaagaggcaaattgacatatttcctctttccctaatatgtacttggtaggtaacttcctaaacaacttttattcatggatgatacaataaatgattcactattttccacaaaaggaataactgaggagagtaagattattataagaaacacaaatcttgaaataactgtgttctcctctttgcttcccccatttaagttagctctctccaataaacatctttctggatttctaaatgtctggatttttgcctttgctgatcaacttcttcatgagttttcatgatttttcagaacacagtgtccctttagcctctccaaccccaaagagctcttctacttttgaggtgtgaatttcaattagtttcctgagcaacatctctataaagctgtcttgcaagtgaatcaaactaaacatgttcgttttcccaacctgcagcaaacctgctccctgactgtgtaagggacacagctcaggaaggcacaccatcctttatgcagatgctcaagccaaaaatctggtgccatccttgattcactccctctcttccttatcctcacattcagttgagctctatctcattgtttcttcttcctcagtgtctcccaactgtgctgactttgctacatgcttactgccctctccctaacacaggcgttcataacttttcacctggatgactacttgataattggtcactatgcatctgtgattcccatatctgtctagcagatagaagtgagcttttcggaatataaatctgaccatgttactgttctaactgacaatactgaatgtccttccacggtccaaagagcagagttcaaattccttaatgtggcctctgggccctcagtgacctgacccctgtctacctctcaaacatcatctctcaccatacttctcgccaataagccatacccaaatgtgtaggtttcttgatatctcacacttttaaacctccatgcctttgtgcaggctgcttctttggctcacagaacacctttcttctctgggaaaagaatctctgagctaggttagctttcccctctctgtttttcacactcatcatactttgtaaccacttgccctactcctgtcttcccactagaatgtaagtactaggaagaggaatcatgtctgttttgttcattccagtattctcagcactgagcacaatgtagtcagagtaaatacttgttaactaaatgtgtagtgtgattctaactgaaaattcaccattaagaattgagaatgaacataattattagaaaacatgggaaattttctcccaaatggcacaactggtcacatttgatctttggtgggtatctgtaacattccagagtttaaatcctgaatgttacgtctgtagtcaaatttgcacttactcagacctataatcaatcaggctggtgtttagctgcccaagttgacatccgggctgactcattttaacttcactgtttgaggttagcttcctcagctgttgtagcactgtaattgtcaatcatttgccttttagttcagagtttaactgacttggaggaagaaaacaacagaagacttatttttttcaatcttttagcagaaaacaattagtatacttccccatagatatccatttacaattctcttaaattacatatatgcttcagaagaaaataaaaacagagactagaactcgaggccatactcctaagttttttgttttttgttttcttgagacaggatcttactctgttgcccaggtttcccaggctggagtacagtggtacaatcacagctcactgcagcctcaaccttctgggctcaagccatactcccacctgtcagcctcctgagtagctgggtctataggtgcacatcaccacacccggctaatttttgtatgttttgtagagatggggtttcatcatgttacccaggctggtctcaaattcttgggctcaagtgacccgcctgcctcagtctcccaaagtgctgggattacaggcatgagccatcgtgcctggcctatattcctaagtttttaacttgtcctctgtagataaaattttaatatacagtctttaaaaataaaacctgagctttcctcaaatgctaaaaactaaataaagcattttaacctttactccattcagtcaacaaatattcccccaggcacttcagccttgtggtaagtgctgtgggggaattatattttgatgtgttttataatgtgctttgattctctacttcttgtcactctgtgacccttcagacaacagctggcgattctgctcctatgtgtcaggaaaaggttcttacaaaagaacacaggataaaaatcctgggcctttaagcttcaaaagcccaagccctgaaagacttggggcataacatttttcaaaaccatgtaatcagttggaacattttttccacccccagattaggaaaagaatctatgtcaaaaggaaaggagcaaatatgagaaaaggggagagaagaggtggaggggaagaagatgagaagggagaggaggaaaggagaggacaggggaaaagaggaggggaggggagagccagagggaagcaaatgctgagaaattcatcatatggggggtctgttctagaccttctcactttctatccagctagagagaaagttggaacccccgggtaggcttgggggcctaagtagatgggaacccattccacctttcccagtagggttcataaaagcaataagacagagtgttcctgtgctcgtcattgtatcagttaagagtcaacgggaaaagcagaaacaaccctgagcatgcaaaactgaggagatttaattttaatgggggaatggctacataggtggtagagaaactgagaagccaaatgggacagtgacaaaatctagagcttagcagcagtaggaagccactactgtccctatgctggaaggacaatgggaagatatgatgttattgaagcccagaggccgacttcattcagggaagctggaaccacagcaggcctgtggttcagaggggagtagaacactaaggaaatgcagctgatgatgatgatgcaaagaaaggtagaggaaaaccctggaatgtcccttctactggccctgtaatcactcagaaatgtctcacaagcaccaaccctaacatggaatctagttgacttgtgtgagtcaccctgtagcagagcaaggggagggtgagtcatgagtttgagggcaaacacattcatgatgtgggagcaagaaaatgtctccagcaggtgtctaggactgtggacctaagacagcctcacaggatctccatgacccaggaagacccagaggagcccagagcaaggcagacacgacagggaaacctgaagacttgaaggggccttggagttggaacaaggaagagacatcagggatccacctggacgggaaactaaacaccaaatgggccctcgtacatctcagtgaattccagcttggacagaagacaacattgagaagaccagacactgaccctgccataatgagttgactccatggtactgcttcctacccacaatctcacatcactcatggacgatatggaagggaagaggaggtcatctagcagaaaggaggctgaatccaagttcattcatagataaagaaaggaaagaacctagaccaatgaacagatctagtccttcatttaaaagaccccaccgaatgttgacgaaggataaacacataacagatgtctgcaatgcagtgagaaatagaaacggttcatgttaaaggatacactggggctggagatgcaagcagagaaattccagtgcttgcctgcaaggtagggcttctcagagaaggccctcatagacagttgatatttcagggatgaatagggatttagcaagcagatggaggagggatccttacctccctatatcttcctatatccctcctatataggaaggatataggatataagatattgtcttcctatatccctccaaatgcatgattttcaagagaagtccatatattccttgtataactatagcccatagttctttcagaaacatggcaaatctctcagggttatcctccttttgattagtaaatggggcagtcccagagggataagatggatgtggcctgagtctcaaccctgatgaatacaatcagcagcttgcaggaaatgaattccatatccttttgtagatttgttgaggccatttctagagtttagtcttgaactaaagacttagatctcaaggcattcgggtagtctcataaaatgtgcaatccgtaagaaaaatatagttaagccatctaacatatattatctccatactgaccaaacttctgtaatgaaacaaatctcaaattatcatgacatactcttatctgtcatgactttccccaaaatactgtattttgctattttttaaacagagaaacatgactgttgattcaaagaaacttttctatcacccttctagaaacaatatccctaaacttaacttttataatagaataacaaataaaacatattattgttctctccattatttacaaaatagcaaataattgtattatagaaaacaataaaagtcattgtactgttttgaatttttttacctcattagagatgtctgttccagagagatctattgataccaaggaaaagatgtttacaatatatccaattccttgggcagtcaaatgttcacaatttcgtaaactcaagtagtttaaattagggcagctaaaagaaagtagcatggattaattttagctgtcaatcatattgtcagtaagcaatttcttcatataaaaactatcttgggaaaacaaatggtattgaagcaaagattttcctttactcaacataaaagtaagactaaaagtagaaagtaatttgacattacaaagttgcatgaaagggcagtagattattatatgactttctttctgtaatttagtttcgtattacaatttctaataaggaaaaaatatgtcacatatcaaaaactatcatgtaagtaccatagtgaatgaccactaaaagtgcaagttaagaaccctacttatcccttacaagtttgctacaggaattgtacaagacctctgacaagaggggagtcaagaataaaccagccagaacaccccttgggaaatgctggagtaaagataatctcctggaaaagggagattagagaaaatctccttgaaaaagtacagggaagccacccatatctagatattcatcatttcaggaacgactccctcagatgtaatttaaatataataatataatttaaaaattggtccaatctatgacttcaatgtctttcacatggtttcactgaacatttaaccagcttctgggcatctctgatgttcccccaaatgtcatgaaatctttgcttttaggtgtctcatgtctcctattatcaaatatacaatactaatgatatgatgtaaaagactgttttatcataccgctcagatagtttcataacagaggcatcacttagccgcacacagttgcttaaatttagctctcttatcctcatgcttgcaggaccatcaagaaattgctttagtcccatatcaccaattctgtaggaaagagagaaaaattttacatgtgattctatatataaacatatagaatagtattaaagtaatagctaccatacccaatatatttctaaaatagcaaggtaatatctatatactggtattttgtcaatattttaaaaccaaatttgattatatagattttaatgtaataaaatgtataaatgagaggaatgggagaagtattaattaaaatgttatttctgttcctttgttcataatttttaataagacagatggccctcaaggtctttttctcttgggttaaaaagtgatcaagttaagtagtccctgataccatttcctgcaaaagaaaaagatcaaaacttaggagagtgagaaccaagactaagagtcaaactactgccatgattttggaggaattttcactaaatacaaggtcaatttgctggataggaaacccaatatgagccctttggcttctttccttctgaatcagagaaaacctgatgctggaagaagaccttgacctcagccttcccaaactatcctaatcagaaacttcttctgtgtgtcagtgccataaccctaccatgttgatcttgctttataaatggctggatgtctgtttggcccatcagttccctgtcttccattgggatcttcatttctaattccaattgagaaccaccagatccttctaagaagcatttcagcaaataaagcaggacaggagtttccaccattgcaatcctaagaggcagtttcacaacagctctacaggtgggcgtacagatgggaagaacactgggagcaaaacatactgattgctgacatccgtttacaccctccgtttgttcagatttgcaaagaactgagcagttaaggcaaaagatatcctgtttcagctgaatgagccatagtaggtggatgcgatgcctgtgtgcccatcaaccttccacctataagagggggagtgtgccagcacctaggaaagcagttaaggatgtgtgtgtgtgtgtgtgtgtgtgtgtgtgtgtagaaattcatattatagtcaagaaaggattaaaagtgaatggaaaagattattgaggtaatgatccaaattaattggttaatacatttagggccaaacctggatatcaaaagtatccatgctgtttttttgtttgtttgtttgttttttaatacacaagctggggtttcatccctaaagattcagactcaatagctctgaagtggggcttgggcatctatagttttttttgtatgtttgtttgtttgtttttgagaccaagtctctctctgtcgcccaggctggagtgcagtggcacgatctcagctcactacaagctctgcctcctgggttcacaccattctcctgcctcagcctcccgagtagctaggactacaggcgactgccaccatgcctggctaattctgtgtatttttagtagagacggggtttcaccatgttagccaggatggtctcgatctcctgacctcgtgatccgcccacctgggcctcccaaagtgctgggattacaggcgtgagccaccacgcccgacgggcatctatagttttattcagctcctcaggtgattctgacaccttaggatttttacttttaaattcttttaaatatgtatttttaatttatctttttgttgctgattcccattgctttgtagagagagaataccatttgttgataaaaatagtttgaaagttgctggaacttgcttttaaattttgtccatgcatgattttttaaaggattgatgtgtgtttgagaaaaacaaaaattctttaactacccaacttactattttaggtttaactcttatatgtacatattaaaatcttaaaactctgaaattaagcttaatctttttaccctatatgttatactttttcatcctccctctgttgtcatttcttcagaatgatctcccagctctatacttctctcctctgtgagttctaatctgctgatcagcattccattgtttatttcaataactatattacatcatttgtttctaaaagttaggtttttttcccagataaatctaattgttttattatgtttggttgtctgctcatatttctgatcccattttttatttcttcaaacatttcatacatgtttacttaacaatccatgtctgacaattcctgtatctgaattacctgaaggtcaaatgtatcttgctgtttctgtgactctttctcatggtgacttatatctttgtgcattttgacaatctttgactttgagcacctatttatttgatcttaatctctagcctgagaagctttgtgctaacttcttccaggagctcaggaactacctacctgagaccactctgcccccttaaagaggtacaaaccctacagaagtctcaggttctgcctccctactttgagtcttgctcagagctgattctctcaaaggcaattgttgtcataaaatttgtgctcagagctgctcaaccttttgtgtttgctggctattcactattcatctcaaggaatttgttcattgagagagtagaaaagaatgaggggattcaaggctactggatatttctcttactctttgtgagctcagcagtatattgaaaatatatttaatcacggatctgaatatttttggcagagccctttgaagtgtcttgtcacctctacttctggaggcagaaaacttccatttaagattaattaggcaaggcgcagtggctcacgcctgtaatcccagcactttgggaggccgaggcaggtgggtcacctgaggtcaggagttcaagaccagcctggccaacatggtgagaccctatctctacaaaaatacaaaaattagccagggatgatggtgggtgcctgtctacttgggaggctggggcaggagaatcatttgaacccaacaggcagaggttgcagtgagccaagattgcaccactgcactccagcctgggtgacagagtgagactccatctcaaaaaaaaaaaaaaaaaaaaagaataattaacccgcagaagcctgcacgaaatgcaagaatgaaattcagttttatttcacatattcatacagatagaattagttgatacacacttgtgtatgtagtgtgtgtgtgtgtggggggggtgggtgtctcactgttatcattactatgtaacaaattgatccaaactttgtggcttaaatggcaaacatttattatctcccagtttctggacctcagggatttagaagtgaactagagtggttctagctcagggtctctcatgagtgtgtagtcaagatgccagctggagcttcagtcatctgaaggtttgactggggctgtagggtctgcttccaggctcactcacatggctgttggcgggaggctttaattcttcactggcccttggctggagccctcatttcctaatccaggtttttcccattccaaacccttatatctcctccagctcccaatgacccatgctgcctccccattttaataacaggcaacataggttgagattctgtgtagtgggccagtgcagtggctcatgcctataatcccagcattttgggaggccaaggtggaaggatcacctgaagccaggactttgagacctgcctgggcaatctagtgagaccccgactctagaaaaatttaaaaactagctggatatgatggagtgtgccttgtagttctagctacttgggaggctgaggcaggaggaccacttgagcccaggagttcaaggttacagtaactgtgcaactgtacttcagcctgggcaatagagcaagaccttgtctctaaaaaataaaaataaataaataaaagattttgtgtagcttagattattatgctgacttgtgctttcccaaatattagccaacttcaatgtggatcaagtactattttgtggatcaaatgctattttgttattatctggccctataagattataagaattctacataggtaagagtctgagctacccactggggaacaggtttcagcaagaaacctcttgatccttggccgggtgcagaggctcacacttgtattcccagcactttgggaggctgaggcaggtggatcacttgaggtcaggaattcaagaacagcctggccaaagtggtaaaaccctctctctactaaaaatacaaaaattagtcaggtgggctggcacacacctgtaatctcagctactcaggaggctgaggctagagaatcacttgagcatgggaggcagaggttgcagtgagctgagatcgtgccactgccctccagcctgggcaacagagcgagactctgtctcaaaaacaaaacaaaacaaaacaaaacaaaacaaaaaaacagaatttgctcctgagaataccaggagagtagtccaatagtggcccagctaaagaaaggatttcagtaagaacccaccctctgtccatttgtcagaaattcttcacagaggaaaaatctatccagtacccaagaggaaaaccttcaatgagattggttcttcataagcaagtcagaaagtccatgtgggaaaagatcatgttaactgaactagctatggaaaccctcaataggaaaggtagcctgtaagtattcctgtgagtttccttaattttacaagggtccataattcctcacatcctgagcttcccctacaccccatataatcaacctgggttgggagcccctctttcttataactacagaactctgcacttacctctactttaacacatgaactcttgactttcatgtttaccccacaaaccataagttccttaggagagaacctggcacatactagataatcaacgtttcttgaatatattactgaatgactcattaccttacacaatttgccaaattcaacacagtcagttgcttcaaaggtgaaagggatctgaggctgctgtctgttattcccttgcagtcagccatataaatgtgactgagatttggataattcttgtctataaatttgaaggatgcatcagtaacccttttatttcctgtttttaaaaaacagaagaaaagacaagtattgtatttagaatgccacaagagtaaaagtaaacaataatgctgaaccacatttttaatataacagaccttcaaatcggatctttctgagtttacaagcagaaagagctctgaaagtacaatcggagatatgcggtgcaccagtgaaaaccagcgatgtaatacgagagcatttttcaactaaagcctttagaagaaaaaaatgattaaattaatcaagtgtacagaacaggtttagcaaggtaatgaagtcactttttccttcaatatattagagacagacatgttaactgttaattttcctaatttcaaagacaactggatttttccatacattttaatacacctacatttgactaatgtggaggaatcagaattaaatcacgtactaagagtatgggaaaatatgagaaatggactactgaaaaaaattactacatttggcagcttagcatggagaactaaactcaaagtttgtgcttaggctgtaacatcactaaaaaaaatcctaactgtgaaacaaggtttcttaggatatttaaggattcacatgttttcaagggtatgtgcatgtgtggaaacttttcaatgattttattactattttaaaataactaaaatgaaaagtccattcatatttttcagtaattcaagccattagaacatatatctatcttatgggacagaaaagtaaaggtacttcccaactacctacttttacacagttgtccgtcagagttggcatgtcattaatggtaagatgcataattccagtgcagctgtttgcaatgtacctgaagccttggactgaaatctgaattgtacagagtagaaaataatgggagaatgcattagcatgataaaaatccaagggagtaataaccaaagatacaccataattttgttactatgttttaaaattaaccataaaatgtggcagacacaagagggaaagaatctagtcttgatttcttttttttatttaattttttatcgaggtaaaatttatataacataaaataagccatgtaagccagatgcagcagtgcatgcctgtagtctcagcaacttgggaggctgagataggaggatcacctcagccaggagttcaaggccagcctgggcaacacagcaagaccctgtctctttaaaaaaatttttttaattaaaaaaaattaaccacttacataagttatttaatcattcataatgttgtgcaaccagcacctaaatgtagttccaaaacattttcatcacccaaaaggaaatcctgtacccattaagcaattgctgcctatactcctttcctcctggcccctggcatcattaatcggtgtcctgtctccataaatttacctattctgaatatttcatataaatggaattatacaatatgtggccttttgttcctggcttctttcacttagtgtaatgtttttgaggttcatgcacattgtagcatgcatgaacacctcaatcgtttttatgactgaataatatcctattcaatggaaaaactacgttttaaaaatccattaatctgttaatgggtatgtggattgtttccatcttttggatattgaatatctacacgcatgtacatctatttgtttgaatatcaggtttcaattcttttgggtatatatttaggagaagaattgctggatcatatggcaattctatgcttaatttttaagaaccaccaaaatgttttcttcaggtgctgcaccattttacctacccaccagaaatctataagtgttccaatttctccacatcaccaacacttatttcccattaaaacaaatttccttgtgggcttgaagtggtactccattgtgattttcatttgcatccccttaatgaataatgatatgagtatcttttcatgtacttgctagccattggtatgtcttctttgggaaaatgtctagtcaagttatttgcctttttttttttagttgggttgtttgtctttttgttgttgaattgtaagaattcttcatatattctggataccaagtccttattagatgtacgactcaaaattattttccattctgtaggttgtcttctcattttttaaaatcatgtacttcgatgcataaacacttttaagtttgatgaagttcagtttatctattttttcttttgttgttcatgcttttggtgtcatatttaagaatgtattgccaaatccaaggtcatgaagatttacctcctattttttcttcaaaagggtttattattttggctcttatatttaggttattgaccattttgtgttaatttttatacatagtgtgaggtaggggtccaacttcacttttttttcatgtggatatacagttgccccagtgccagttgttgaagaaagtattcttttccccattgaatggtctcagcacccttttcaaaagacaattggccataaatgtatagatttatttctggactgtcaattctactccattgttctatatgtctatccttatgccagtgccatactgtttcaattactgtagctttgtagtaccgatttctttcttttcaactatcattatccacattaatggaaagaccagtggcagagagtgtccgaaataatgactgattcaaagatcaaaatatttgcctataatgaattaccttaagataatttgttatttagactgcatttcctgtaacaaatggacacagataggaaatcagattgtgttcagattcagtaaagggaaattgagatgctgcccagaagcagacagaaggggaactcccctgaagggtcatctccagaagagtatgacagggacaatgaggagcagcagctacaatggacctctagggagacctttggagacttcatttgcgccacctctcactaaaggtgacttccaaggttctgtcatcagagcctccacctattcagaaaagactagccaaaagttagggaactgagtgtcatagccccaggacaaccagagctcaactcaaatgtcacttccttaggaagtgttcctgacccttagattagaccagtttcttgttatatacttacatcaccatgtaattatcataactacaattatattcattttatgattgattagttattaaatgaatcccctgtatacagctcccagcatggtgcctataacaactgatgagataattgagtaatattattacatgaataaatggaggaatgtatgaatggcttctgagaaccatgtctattcagtaggttccccttctcagcagacactaataatatgagcacccagacaaaagccaaaggaatttttatagctattgaaataaaaagaaaagagaaaaaatgctaagggaagcccttgaaaccaggggctgagcatgcaggcctgatttgctacagaagccaggcctttgggttggattatatttggacaatttttctacatttctagtatttttctattgtgctacagaagccaggcctttgggtgggattatacttggataatttttctaaaaagactttgggaaatatgtttctaaagcctgaacaaatttatggcaattcgtatgatggggtgcaatacagttacaagttaatgttttaggagaataactgagctcatgatattatttcatgaagaaaaagttaattatataaggccttgctatacaaaatgtggtccatagaccagcagcataggcatcacctgggagcttgttcaaagtacagaatcttagcccaccactactgacttagaggctgcacttgaacaagacaggtgatttacacacagacatgacagtttgaaaagtgctaactgggaggaaatgaagaacaaaaacaaagtatatcagtcagggttctccagagaaacagaaccaataggatatacttacatccaagtatatatacatacatacacacacacacacacacacacacaaacatccaagtgtgtgtatgtgtgtgtatggagagagaaagagacagagtgagaaatgtattttaaggaattggtcatgtgattgtgggggctggcaaatctgaaattggtataccaggctggtagtctagaaactcagaatttctacattgcaagtcttgcagcagaattgtttcctcttcaggaaacctcagtcttggagacctgtctttattcttaacatcttcaactgaatgaagttcacccacattatagaggggagtccactttactcaaagtctactgatttaaatgtttatcacatctcaaaaataaaaacaaaacaaacctttgcaacaacatttacactggtgtttgaccaaacaactaggcactatagcctaaccaaagtgacataaaattaaccatcacagaaggaaatacaccaaatgctaatagtgattatctctgaagagtggatagttttcaaattttctacagtgaccatgtatagtcagaaaaaaagagaaacagaaaaaggcatctttggggaaaagatagcgtaaggaagcccttggacagtttttgaatcatctcctaccatagacctcttctttcagggaaacactaactaataaatggcccacgactctttataactcttcctgcaatccgtgtgtgccttactttccttcaaagagatgttcaggtactctttttttgaatttcctactgtgttggacaactatgaggggatgaatgaattaaatttaggagtaagataaagtctgggaaagagtgcagagtttggcaacagacaagactgaaaagaattccaggctgggtgcagtggctcacgcctgtaatcccagcactttgggaggccaaggtgggcagatcacgaggtcaggagattgagaccatcctggctaatacggtgaaaccccatctcaactaaaaatacaaaaaaattagccaggcatggtggcacacgcctatagtcccagctactcaggaggctgaggcaggagaatcgccgggaggcggaacttgcagtgagctgagattgctccactgcacttcttcagcctgggcaacagagcgagactctgtctcaaaataaaagaaaagaaaaagattccaggtggaaggtaagcacaagtggaggcaaagcagtgggagtgctggtcttggctgaagtggcaggatcactcttgggatgaataagaaaagttgagtaggtaaggaaggagggaaagctagtagaagactggtaaggcaagaatgaggtggtttttttgtttgtttttgtttttttttgtactgctatgaattcttgagtaaactttttataagtagcccagagcaaagtccaggggagaggaatgagcctttcaaaacatgaacagaggaggagagaagaatgctgggtttggagttagctgggctggttttgagtctggctctacctctttcttgcttataacaaaaagtagctcaacctctcgactcttagtttcctcatctggaaaatgagcataataatacccattttaggaaattcttgagaaaataaaatgaggcaatgtatataaaagtgattagctagcataatgtctggcatgtaatattgttatcacttttcctgttattgttcttctgggcacattttgctcccatgggaaagaatcaagaagcaggagtagggggtcttgagaactcattgtggtgcagccctcttactgcaaacaaagaaatgggattcagagaagttgtgtgatcggagaacaggttctttatctattcctcacaacgtggccccagtgctgaacatagtgtctgacacagagtgggtgctccagaaatgttgaatgaatgaatgaatggattatcttgagtcacatagcaatggcagagccagggctagaggccacctcttcctattatgacacacaaccccaggtttgagaactgttttttgtttgtttttaatttttattattattattatactttaagttctagggtacatgtgcacaacgtgcaggtttgttaaataggtatacatgtgccatgttggtttgctgcacccaacaactcgtcatttacattaggtatttctcctaatgctatccctcccccagtcccccaccctctgacaggcccccgtgtgtgatgttccctgccttgtgtccaggtgttctcattgttcaattcccacctatgagtgagaacatgcagtgtttggttttttgtccttgtgatagtttgctgagaatgatgatttccagcttcattcatgtccctgcaaaggacaagagctcatcctttgttgttttttatgacaattctaaattccccccattccagaccttagttcataaccctaacattaatatctctaataatggttttcataaaacatacaatcttttctctcttgctgtctttgtaacacgttcatgacaagatttcctgaacaagagggaaaacgatagcaaaaagcagccacagctgggtgatccttacaacacagcccaaaacttgatgctatcaaccaataagattagtatccagaaagtggggggtggggggtagggctctgagaaggactctttagctttgtcctggcatgaagtacttagtttcctacacagtttacattagaatatccaaaaagatatttggctaatattttatgactcacatattcctcccagaatcttttaggccaagcaaccattagttgtccttcctcttcctaaaataatagagatataagtctgaaattaaaaattcctctctaaaggaaaaagcaaaatatgttaccaagttaaaattccaggtctcatcacagctgatatctgtgcattttctgtgtaggatttttacacctgagatctgattcccgtttggttgtaaagtgattttggcttccattttgacaccaactggagccctgccaccctgtcctttgctggttaagcccccactgattgggaagttgaggaacttggcctcaccagtggtgttccaaccacaagtcccagcagacagctactgctgctgatgggggcagaaaagctttggtgatcacaggaaaattctctccagctgcctctgggtgggtctcaacccatcatcatgagaagacagacctgtctgtaaaggaattgagttgtcagtgagccacatacttactaaagaccaaagtgcaaagcacaaaggactagctcagatccctctgccgctctaaggtagtaaaaagaaggaagagacttagtgacagggatgataacatcatatgaagcttccacttcccactcctccaaaactgcctgtgagtcagctagctcagcagcacagaaaagacatatatgcagagccagaccctctaaggcagccagaaatatccatctgagatagacatggcccatgctgtgtttctgtaccacctccagctgtttctcacattctcacagcactgcatccaatgactaataggtagtgtgatgactttagtaatatccatatatttttatgtcctcttagtgaactcaaaggagcctgacttagcaagtagaatgaactgttggagagaaaaacaaagctttccttcaaaactattatggaacattgttttattgcattcaaatgcaccacaagcatctttaatagcaacacttcctagggactgtgctacgagggtttgacagactctcaaataccatgtcctctatagggacaggaagagaggtctggtaattgtctttctcgaggtcctgccaatccctctttagatgatcctgtattgtctaggtctatatattgttcacagccatccccatctctatggtctgaaatcctatccattcactacgcacttcttgctggtagtcctccctgatcacctcaggtagacatgtttctaactcttacatctgagcaccaaagcctgtggtctacactctccctgcattttatatcctctgccttatatgacagttacctgcacacatgtctagtttccctcccaagaagcatggacagcatcttagccataactgtatcgtttacagtacagcacagtgcctggtgcagagtgtttgttaatagaccaagtagttgttgaatgaattgtttgtagaatataaattagaattagtagtttcaacgggatggcagtcaatatggtcagttgttaaacattgccatatttatataaaaacactggacaaccaaacattaaaaaaaaattaattttccagtgtgagtgaggaaccaggacacaagctgagtgaagcctacagatgccaggaaggcttgcatgcttgccaactctgtgtgcatttactgcacaatgactcagagctgggatctgtcagaagcaggctgatccatcctaaactttgccattctagaatacactaattggttcttttcctcaaccagtggccaaattgttcatagtttcccttgtattactgagaaaatcacaaccataatacttttttcttacaacacaatgatccacagagctacttggtttgtctagatttattgaactagatggtggctttacagctacagttctaaccacatgctcacccaggtccaagaccaaaatagagttttgtaagcagttcatgaaattctgtgtcatttcacaagatagggagaagagaataagaaaccaaaataagtatgtttccagaaagaataaaattttttcaaacccttttttcaggaataggaaacacgatcttagtcccctgagactcatcactttgtcatctgattcttcaagatctaaaaatttttgccagatgtttcatttttaccacttaatataataaacatccttatacattttgcctacaaagagattatattaagctgtggatgttaaacaataggtgtttgttactttctttaatttttaattttcactatgaacataactgttatgttccaatgaataattttaacaaccatttaaatttatataagtccgatttacaagatatataaaaatgttttcataaattctacaattttttttcaacacaggttgaagtctggttcagaaaggacacaaaccattcctctaacagggaaactgaggcacaataactgacccagaaaagcaggaattgcactgtgatttttttgactcataactacttttccactagaactcctccttattaaatgatacttaaaaccacatattttttcaaatacaaaatgcaacaatttttttaaccatatgtagtatagcactttagtttcacaaatgatattcttatattaaaaaccaaggtagtacatactcaaaatgtgtcacttcctcatttttaccacattagcattatctatgttcttgaggatattaatgtctatcatttctctagaatattacacaataatgtgctactgcatatctcttcccaacttcctgttggtagcttaaaataggccatggtgagagtatttacaccatagaattcagccaacactaaaaagtcaggcttttcctgccctttattattccatacaataaaggaaaatggaatcagccaaatataagtgcatcacagttttgaatttaactgtttccaattcattttgatacataatctggtcattcacaactggtttagctggtcacaaaactcttgttgttccaattaacgtttattgacagacttccaaatctataccttcactcccagctctcttccaaggaccagacttctacttccaatttgttcttgtcatttgtacccagatgtatcacagcaacctgaaatttggcctttccaaaataagattcactattcttttttctccaatcttgctccttttttggttatcttgtctagttaccatttagaaacacaaaatcctaaagctgaaaaagaccttagaggttatttagcccagcctagccattctacaggtgaaggaatcgaggcagaaaaaccaagtaactccaaggttacacaactggttagtagcataacaagaaatagatcccaggtctcctaacttcaagaaaggagaggctgggcgcggtggctcgcgcctgtaatcccagcactttgggaggccgagacgggcggatcacaaggtcaggagattgagaccatcctggctaacacagtgaaaccccatctctactaaaaatacaaaaaaaattagccaggtgtggtggcggggacctgtagtcccagctgctggggaggctgaggcaggagaatggtgtgaacctgggaggtggagcttgcagtgagccgagatcacaccactgcactccagcctgggtgacagagcaagactctgtctcaaaaaaaaaaaaaaaaagaaagaaaggagaaggatgaggagggaatgggggagggggagaagaaggggaagggaaaggcgaagggagagaagagaggcggagaggaagaaagaaaaagaaagagaggaaggaagggagggaggggaaagaaagagagagagagacagagaaagagaaagaaagaaagaaagaaagagagaaagaaagaaagaaagaggaaagaaagaaagaggaaagaaaagaaagaggaaagaaaagaaaagaaagagacaaagaaattcctcccctgactcttgctttgcttatgcaatctccattcaatttggctagtacattcatccctggacatgcctgtgtggctttctccaacctccaacacaaatcccaggggtgaacaagtaagaccttccatgatctctgcttctctgaaaggagaaggttggaatttatgtaacctagagagaactgaaatgaccttggaatcttccagtttgcagtttgtacagcctacctttaagtttcgtgggctctagagagatttaacagtacaagaactgataagccattattactgcattgagtattataatcatttgaacattcctagaatactgtcccttttcattttttgttgatttgtgtatagtgattaaaatataattggtgaaaaaatagagtgcacatggtgactcatgcctgtaatcctggcactttgggaggctgaggtgggaggattgcttgagcccatgagttttagactggcctggacaacatattgagacccgtctctagaaaaaaaatttgaaaagaattaaccaggcttggtagcatgcgcctgtaatgccaactacttgggaggcttgaggcaggaggatcccttgagcccaggagtttgaggctacagtgagctatgatcacaccactgtactacagcctgggtcacagagaaagactttgtctcttaaaaaaaaaaaaaaagagagagagagagagaaaatactttcattttatatttcatagcttcctaggcacttttctttctgtaaatttaaagaaatatcagacttgaccttaccaagaaaagagatcatcaagccttgctctagcaagttaccaacttcccactacgtaacaggcatcctgagcttccacctgaagcacctggggaggcatgccctgaaattggccacagtctcattcattcatttgtcaagcttatcaaagtcctactatgagccaggtattgtattatttgctaaggatacagatacacaattatataaggcaccatccctgttttcaaagagcttaccttgggaaggagagcagacaagcaagcagataattgaatatgtagagaatgcttagtgaaaagtacaatgataaaagtatacacaagagggatactaacccagcttggaatagggcaaggaacggcttagtgaggcccttctagagaaggctgtgattgaacagaaccttgaaggataagtgcaagttaatgtggtgaatggaggaaagggacagtagcaggatgtccaggcagagggcaaaaggtgagcctagtgaaacaactgaggctggaaatgaagaacaggggaggcaccgaagcagaaacccctatggcaagctcccctactgtctggtttcactatcctaaatgtaaacatataaatctgaaacacggtccaaactcctcacttttcatccagcttcttctccaactccacattcagagttgttggtttctaggcatttgggcttgaacctgagcttgagtgggcctcagccttgcttcccagcatgtctggttgttccatgcctggcttcctgcagagggccataacccatcgttgcacacagttgaagatacatgaatctgtagggaaagtggctaccccatgataatgtcaatgggagaattgttggagttacacataaacagagcagaggataaagggaaagtaaaaccaggaatcatcaccctcccaattggcactttctcatgtacaagtaggatagctttgttctccccattaaaactctttctcctactcatattttccattctgagactccaagagaaacacggacatattttagagagctctgaaatgaactgggaactaatgtgaatctccttggagcattttagctagtacattttatccattcattcatgggaatatttaaggaaagacttagaggaagttaaccacgaagatatctgtagaaagattccagacaggggaacagccagtgtgaaaccctgcagcatgagcctgcttatgtttttgaagaatagaaaagaagccagagtggctggagtagagttggcaagaaggagaacaagaaatactgtcaaaggggcaactggaagatgagacagatttctcagggccttgtaggtccttccaaggcttttcttttattaaatgaataagaaggcttgccaggtacttaagcagaggaaggacattgacttgggtttttaaaggatgcctctagatattatgttgaaagtagacttgcaggaggcaggggtgaaagcagaaaggccagttaggaggctattggaataaccaggcaagagatcatggtaacttggactggggtggtggctgtggagatggtggttggatcctgattagattctgcaggaatagtcaactgcacttcctaacagagtggatgtggagtgagagaaaagagtcaagggtaatgtcttagtttgctagacatgctgtaataaagtaccacaaactggatggcttcaacaacagaaatgtattctctggttctggaggcacaaagtctgagatcaaggtgttggcaaagttggttccctctgagggctgtgaggaaggatttgtcccaggcccctctccttggcttacagttagccatttcaggttcacatagcattctccctgtatgcttgtgtctgtgtccaaatttccttcttgcaaaagaacagccatcatactggattaggttccaccctaaatgacctcatctgaattaattacatctgcaattaccctatttccaaataaggtcatattctgaggtactattgggtgttaggacttcaacatataaatgttgttcattccatcaatgaacaatggattccatcaatccataatagatggtgcctagatttttggcctaagcatctataaagatggagctgccattaactgagatggggagggctgtagtggagcaaggagcaggaattttttttttttaagatacaagagtctaaattttgagagaaatgtctgggttggagatatataaatcatatacatgagatacatatacttttaaatacatatattttatatatatgtatatgtgtgtatctatatgaggaaatatggtatatgtgtgtatatatatgattttatatatatatgagtgcttgttattgtaggtgatataaagccatgagacaagatgagatcatcaagggagtaggtatagctggagaagggaaatggatcaaggactgaaccctggggccctctgtgcttaagggattgagagatgaagaggtaacttaaagaggcactttaacaaatactattaaaagtaggaaaagagaaaaataaaatctatagcacgatataatttatgagaacacaagaatgcatagagatttaaggaaacataaattagaggggttgcttgtgtagggggaggggaatataaatgggaaatacgaacaaaaggaaataaaattaaacaagagaggggccctgcacagactgattatggaagtttgccatgaactgaggagtataattaaatctgctcttggtatctgagttccaaaataaacaaaataaatccaatgtgaaataaaatagaaatccctggttatgttttttcccttgagttctttttctttcctgcacaatattgcagaggaaacacagtatttttaaacttcttaacttcttttagtgagaatagtcaccataggaattccttattgagatctgacactttgatcaaagaatatttgaaaaaaggagaattgagtgaaacttagttactgtggaagtgaatataagatgactttaatacttattgctagtttctgagaaggaatgaatatttatcagcataaaaacccactccaagtttgaatgctgttctcccactccttttgtaatatacttataacattgctataaaaattaattacatgggtaaaaatagggagtaagtatggggcgccacagcatcagctttcctgcagaaaccacatctctaagttttctaaatcataaaagtgtcattaggattggcacaaccaatttgtaaaactaacaatatcaactaaagccaaacaaacacacctgacaacccagccactcgactcctatacacacacacacatacatatatatgtgtatatatacacccatgtatatattgtgtgtatacatatatatccatgtatatataaatacacaaacatatatatatcaaacaaaaatgtctgctgtgttcaccaaaagcaacgtacatgaatgttcatagaactttgtatacttttcttttcttctctctttttgagacaggatctcattctgtcacccaggctgcagtgcagtggcgcaatcatggctcaccgcagcctcagactacaggcatgtgccaccatgcccagctaactttttttattatttgtagagacagggtctcccctatgttgctcaggctggtcttggactcctgggtctcaatcctcccacctcagtctcccgaagtgtggggattacaagcatgagccaccgtgcctggccacttttctgtattatattttggccaaacttaccccaaaaaagtcattagggaagtttctttgttcactaggtcccaactgtcagtgccagcaaagtgggaagtagatttcatctggcatcctggatgttaaggattgctctgcggtcaatcacaagcatgttgaaagcaacaaattcagatacatcgtcaaacatgagcatgtgactaatggtgagaaaccttcacaactttctctcttgcacttcagtgattttctcgagtaaggctctccctaaagcacatctggaagtattcttttatttttatttatttaatttaatttaattaattatttatttattttgagacagagtctcactctgccgcccaggctgaagtgcagtggcacaatctcggcttactgcaacctccatcttcgggttcaagcgattctcctgcctcagcctcctgggtagctgggattacagacttgcgccgccatacttggctaactgttgaattttagtagagacagggtttcaccattttggccaggctggtctcaaactcctgacctcaagtgatctgtccactggcctcccaaagtgctggaattataggcgtgagccaccgtgcccagtctggaagtattcttttaaaccccaaatgaaagctaaatagaaattacagactcaacagagttgtatcagtttctttcaattgcaatgatggagacccaacataagctagcttagctagaatgggaatgaatggtgtcttcaatcgcaagtccagttaaacaacatatcatctctcttcaaacatatcatctctccctcttggtaggcttctttgtgaagatttcattctctctcccacagcaaacaaatttcttctgtgctgctggagaagagaaccacaaagtggcctagacctatacgctccaggccctgcaaactcagggagcacagaatctatatttcccaatgttaagtatccagaagattctgaatggttttgttagggttacatgcccttcctggacaaatcttaacccctgaagatggaatttatgattgaccaggcctggatcaaatgactagtagccatgggaaaatactaataccagtacaatgtaagtacatttgcaagttatgatattcattagaaaatcagtcatgttaattaaagaacctacagtgtgtatctaatccccaaagaggctgggcacggtggctcatgactgtaatcccagcactttgggaggacgaggtgggcaacctgaggttgggaattcgagactggcctggccaataaaatacaaaaattagctgggcgtggtggtgcatgcctgtaatcccagctactcaggaggctgaggcaggagaattgcctgaacccaggaggtggaggctgcagtgaaccgagatcacaccactgtactccagcctgggtgacagagtgagactccatctcaaaaaaataaaataaaataataaaataatcccaaaataattcagaatacttctaaaacatatgtaattgattttcactttttattgcagctcttcatcatcatttattttttctaagaaatatagttaaacttctttcataatatcatataaatacatttttcctgtttttggacaacagcagtgggcattaaagtttagtccatgacatattttgtttacgttaatccagagctcctaaaggacagggaggctgttttattcatcgcagtgcccagtatgcatcaggcactcaacaaatgccagcaaaaagcatttaggtgtaagctcctattctcaaggctttttgttttattgagaccttttttcttggtcacatatattaacatataacttcctaatacaacattccaaatttataaaaagaaaatagattctagtttccaagagagaacctcttcgaggtgaaaaccttaaacatctatgaattgtcaattttccttctatgaagctatttttgtactacacccagagctgaagaggtagatagagcctcctcaaaagacttaataagtcactcagaagcagtaacattcaaacttcaccggttcttcatgaagctacagcagcagcaattactaagatatctgtgcttcacgacgaacccatttcttactctcactgggcctaaaggggctcaatttcaaactccacaatttctagtgcctgaaacagtgcctgacacttagaggtaaatactactgaattattaaatgaacagatggaaatgaaaaagggatgaatgaaagaaactaacattgttttgcataatgatgtgaaatactaacttcattgtgttttgaggcttacaaattaagaagtgattaggaaaggaattcaattctttacacatttagaaactcaaatacttactgaggccaggcaggcaatgcgattaagtggtagcagtccaggtgtgaatgcttgtgctgaccttactgagtggaggagaggttggcaaacagtggtccatctcgagggagggaggctgacttagctccagcccattgtggccatatggaaatgcaggtccaattctgctagttcttcccatttttaaagagaagcttgaaatctagaatgttttgtgaaaactccaaaattttacatattggcttgaaatttaaagacagattatgtgtgttttgcagtatttattttatttttaatttttgtgggtacatagtaggtgtatatatttatgggttacatgaaatgttttgatacaggcatgcaatgtgaaataagcacactatggagactgtggtatccatccccttaagcatttatactttgagttacaaacaacccaattacactcaagttcttttaaaatgtacaattaagtattattgactatagttaccttgttatgctatcaaatagtatatcttattctttctattttttttataacccattaaccatttccacctcaacctcaaagccccattatccttcccagcctctggtaatcatccttctactctctatgcccatgagttcaattgttttgatttttattagatcccacaaataagtgagaatatgcaatttttttaaatacatctcacaaataagtgatgggggatgtttttctttctgtgcctgacataatgatctccagttccatccctgttgttgcaaatgactggatctcatgcttttttatggctgaatagtactgcattgtctatatgtaccacattttctttttccagtcatctgctgatagacacttaggttgcttgcaagtcttagctgttgtgaacagtgctgcaacagacataggagtgcagatttctctttgatatactgatttcctttcttttgggtatatacccagcagtggaattgctgtatcatatgatagctcaatttttagttttttgaggaacctccaaactgttctccatagtggttgtactaatttacattcccaccagcagtgtactatggttctcttttctccacatcctcaccagcatttgttattacttaacttttggagaaaagccattttaacgggggtaagatgatatctcattgtagttttgatttgcatttctctgatgatcaataatgttgagcaccttttcatatgcctgtttgccatttgtatgttttctttgagaaatgtctattgcatcatttgcccattttttgatagaactattagaatttttcctataaagttgtttgagctccttatatattttgttttttaattccttgtcagatgggtagtttgcaaatattttctcccattctgtgggttgtctcttcactttgttgattgtatcctttgctgtgcagaagcttttcgacttcatgtgatctcatttgtccatgtttgctttggttgcctgtacttgtggggtattgctcaagaaatctttgcccagatcaatgtcctggagattttctccaatgttctcttgtagtagtttcaaagtttgaggtcttagatttaaatatttaatccattttgatttgatttttgcatacattatgtatatagtgttattcttctccatatggatatccagttttcccagcaccacttattgaagagactgtcttttcctcagtgtgtgtccttggcacctttgctgaaaatgagtccactgtcggtgtatagatttgtttctgggttctctattctgttctattggtctatgtgtctgcttttatgtcagtgccatgttgttttggttactttacttctgctaatttgaagttaggtaatgtgattcttctagttttgttctttttgcttaggatagctttggctattctgggtctttagtcgttccatataaattttaggattttttttttctatttctgtgaagaatgtcactggtattttgatagggatttcattgaatctgtagattgctttgggtagtatggacattttaacaatatcaattcttccaatccatgaacacagaatgtttttccaatttttggtgtcctctttaatttattcatcagtgtttcatagttttcattatagacctcttttacttttttggttaattcctagttatttaacttaatgtatggttgttgtaagtgggtttacatttttatttctttttcatattgttcactgttggcatatagaaatgctactaattttcgtaggtcaattttttatcctgtgactttactgaatttatcagttctaatagttttcttgtgtagaccttaggtttttccaaatataagatcgtatcatctgcaaacaaggataatttgacttcttccttttcaatttggatgctctttatatctttctcttgtctgattgctctagctaggactttcagtactatgttgaataacagtagtgacagtggacatccttatcatgttccagatcttaagaagaaaggctttcagtttttccctattcagtatgatactagctgtgggcctgtcatacattgtttttattatgttgaggtatgtttcttctatccctagttttttgagggtttttcttatgaagggatattgaattttttttaattttttttctctcctgctccataatgctacgttgagatgttgaatttgatcaaatgctttccagcatcaactgaaatgattatatggtttttatccttcattctgttgatgctatgtgtcacattgatttatttgcatatgttgaaccatccttgcatcccagggataaatcccacttggtcatgttgaatgatctttctaatgtattgttgaattcagtttgctagtagttttttgaggatttttgcatcaatattcatcagagatattggcctgtagttttcttttcttttctttttttttttttttttttttttgctgtatctttgtctggttttggcatcagggtaatactggcctcatagaattagtttggaagtactctttcttcctctacttttcagaatagtttgagtaggattggtattagttcttctttaaatgtttggtagaattcagcagtgaaaccatcaggtcccaagcttttctttactgggagactttttattacagcttcaatatcattacttattattggtctgttcagattttggatttcttccctgtttaatcttggtagcttgtatgtgtctaggaatttgtccctttcttccagattttcaaatttgttagcatatagctgatcatagcagccactaatgatcctttgaattctgcagtaacagttgtaatgtctcagttttcattctgattttatttatttggatcttctctcttttattctttttctttttttttatactttaatttctagggtacatgtgcacaacgtgcaggtttgttacatatgtatgcatgtgccatgttggtgttattttttttcttaatcttgctaaacatttgtcaactttgtttaacttttcaaaaacccactttttgtttcattgatctttttttgttgtcatttcattgatctttttgtattggttttttcatttcagtttcatttacttctcctctgatctttatttcttttcttctaataattttgggtttggtttgctcttgcttctctagttctttaagatgcatcatcagattgtttatttatagtttttcctcttttttgatgtaggcacttatagctataaacttccctgagtattgcttttgctgtatcccataggttttggtatgttgtgtttccattatcatttgtttcaagaaatttttcaatttccttcttaatttcttcattggcccactggtcattcaggagcatattgtttaacttccacatatttgtatcgtttccaaaattctacttgctattaatttctagttttattccattgtagtcagagaggatgcttgatattatttcagtttttttgaatgttttaagatttgttttgtgaactaacatatgatctatccttgagaatgatccatgtcctgaggaaaagaatgtgtattctgcagctcttggatgaagtgttctgtaaatatctatcagatccattttgtctatagtgcagattaagtctgatgtgtctttgttgcttttctgtctggaagatctgtccaatgctgaaagtggggtgttgaagtttccagctactattgtattggggtccatctctctccagcactaataatatttgctttacatatctgggtgctccagtgttgggtgcatatatatttaaaattgttatatcttcttgctgaattggcttctttatcattacatagtgaccttctttgtctgttcttatagttttggtcttaaaacctattttgtctgatataagtatagtgactcccattcttttttggttttcattggcatggaatatctttctccattcttttattttcagtccatgtgtgtctttatagatgaagtctgtttcttgtaggcaagagatcaatgtatcttgttttttcatccattcagccattctatatcttttcattggagagtttagtccatttacattcaatattattattgataagtaaggacctacttattcctgctattttgttatctgtcttctggttgttttgtggtctttttcttctttctttccttcctgtcttcttcaactgaaggcaattttctctggtgatattatttaatttcttgctttttagttttttgtgtatctactgtatgatttttggcttgaagttaccataaggcttgcaaatactaacctataaacccattgttttaacctgataacaacactgtttgcataaacaaacaaataaacatacaaaaactaataaaaattctatgtgtattagtccgttttcatgctgctcataaagacgtacctgagactgggaagaaaaagaggtttaattggacttacagttccacatggctggggaggcctcagaatcatggcgggaggcaaaaggcacttcttatatggcggcagcaagaaaaaaacgagaaagatgcaaaagcggaagcccctgataaaaccatcagatcttgtgagacttattcactatcatgagaacagcatgggaaagacctgcccccatgattcaattacctcccacaacacatgggaattcaagatgagatttgggcagggacacagccaaaccatatcactatgctttaactttgtccccctgccccactttttaactttttgatgcttctatttatatctcattgtactgattatgtcttgaaaagttgttgtagttatttttaattggttcatcatttagtcttcctacttaggataagagtagtttacacaccacagttattgtgttataaaattctgtgcttttctgtgtacttactattactggtgagttttgcaacttcaggtgattatttattgcttgcttttctttccgattgaagtactccctttagcatttcttgtaggacaggacagttgatgaagtccctcagcttttgtctaggaaagtatttatttctccctcatgtttgaaggatatttttaccagacatactattctagggtaaaagtttttttccttcagcattttaaaaatggcatgtcattctcttctagcatgtaaggtttacactgaaaagtttgctgccaaatgtattggagctccattgtatgttatttgtttcttttctcttggtgcctttaggatcctctctttgtccttgacctttgggagcttgattattaaatgccttgaagtagtcttctttgggttagatctgcttgatgttctataaccttcttgtacttggatatttacatctttctctaggtttctggaggttctctggtattatccctttggtttttgtttgtttgtttgattgggttttttttgtttgtttgtttttgttttttttggttttttgagactgagtctcgctctgttgcccaggctggagtgcagtggcacaaacttggctcactgcaacctccacctcccgggttcaaacaattctcttgcctctgcttcctgagtagctgggattacaggcacccaccaccacgtctggctaatttttatatttttagtaaagacagggtttcaccatgttggccaggctgtgttatttccctttgaaaaaactttctacttctatctctttgtctacctcctccttaaggccaacaattcttagatttgcccttttgaaattattttctagatcccgtaggtgtgcttcattgtttttcattctttttttttattattatactttaagttctagggtacatgtgcaccatgtgcaggtttgttacatatgtatacatgtgccatgttggtgtgctgcacccattaactcatcatttacattaggtatatctcctaatgctatctctcccccattcccgcccccccacaacaggccccggtgtgtgatgttccccaccctgtgtccaagtgttcttactgttcaactcccacctatgagggagaacatgcgatgtttggttttctgtccttgcgatagtttgctgagaatgatggttcccagcttcatccatgtccctacaaaggacatgaactcatccctttttatggctgcatagtattccatggtgtatatgtgccacattttcttaatccagtctatcattgatggacatttgggttggttccaagtctttgctattgtgaagggtgccgcaataaacaagacatttatgcagccaacagacacataaaaaaatgctcatcatcactggccatcagagaaatacaaatcaaaaccacaatgtgataccgtctcacaccagttagaatgatgatcattaaaaagtcaggaaataataggtgctggagaggatgtggaggaataggaacacttttacattgtcggtgggactgtaaactagttcaaccattgtggaagacagtgtggcgattcctgaaggatctagaactagaaaaaccatttgacccagccatcccattactgggtatatacccaaatgattataaatcatgctgctataaagactcattcttttttattttgtctcctctgactgcatattttcaaacagtctttaagctcactaattcttctgtttgatcagttctgctattaaaggactctgatgcattcttcaatataccaattgcatttttcagctccagaatttgtttctttttaattatttcaatctctttgttaaatttatctgatagaattctgaatttcttctctgtgttatcttgaattaatttgaatttcctcaacatagctattttgaattctctgtctgaaagattacatatctctgtttctccaggattgccccttggtgccttatttagttcatttggtaaggtcatgttttcctggatggtattgatgccagtattcttcggtgtctgggcattgaagagttaggtatttattgtagtcttcactgcctgggcttatttgtagccatccttcttgggaaggccttccagatatttgaaaggacttgagtgttgtaatctaagctgtatctgctttagggggcaccccaagcccagtaatgctgtggttctcgcacacttgtcaaggtaccaccctgttggtctgggacaagatctggaagaattctttggattaccaggcagaggctcttgttctcttcccttctgtttcccaaacagagtctctctgttctgaaccacccaaaactggtggtagagtgaaacaagcacccctgtggcctccaccactatgattgcactgggtcagacctgtagctatcacagcactgggtcttgcccaaggcctgctgtaaccacttcctggctactgccattgttcactcaaggccctggggctctacaatcagcaggtggcaaggccagccaggcctgtgtcctcctcttcagggtggtgaggtcccccagaccccaggtgagtccttaggtgccctctgggaatcagggattagagtcaaaaaccttagaagtctacttggtgttctattgcactgcggctgagctggcatgcaaactataggatgcagtccttcccactcttctgcccctttccaaaggcagaggaaccttaccctgtagccaccgccaccccaggccatgagtagtattgccaggctaccaatgatgttctcttatggcccaagggcttttaagtcagcttgtggtgaatgctgcctcacctgggactcatccttcagggcagtgggttcccctctggcccaaggcaggtccagaattgccatacaagagtcaagtcctggaatcgcggaccccaagaacctgcctcggtgctctaccctcctgtggccgtgctggtatctaaggtgtaagactgtccccactgcttttccctcgcaagcaagagttttgccccatagctaccctagctggtaatatgctgagtctcacctgaagcctgcaagtcacagaggctcacccaaggccctcaatgtagtagctgggtattgctgctagttattcagggcccaagggctcttcagttaacaggtgatgaatgttgccaggactgggtcccttccttcaaggcagcaggttcccttctggcccagagtgtgtctagaaatgtaacttgggagctagaacctggaacgagggccttatgactctaactggtgccctatcctgccgtggctgagctggtatccaagatgcaagacaaagtcctccctactcgtccttctcctctcctcaagggaaaggaaggggtctcttttggatcgatgagctgtgaggcttggggctggttgaggggcaatgccagtactcccttggctgctccagctggtgtctcagtatgtcatgtacccctcagtccactgtctctgtgcctagttgagcactaggatttgcctaagggttacagtccttatggcctagactgcctttcaagtttacctggaggcacagcgcactgtagccctcagtggtgaggtttgtagaactcaagttctgactgctgggactggcaattcccctgtgtctaggcctgggttaaatgctccctccgtgggtgggcatcagctgagtttggtccagttttcctctctgatccaacaggacagcactaagttcaatgcctcacaattggtgtattttcccttccccagcacccagagaggctctctgcaccatgttggaggggtggcactggcgattcaggactattgtttctatctcttcaatgactctttcagtcatatgaagttaaaaccaggtacgatgactgctcatctgatttttggttcttatgaaggtgttttttctttttctttcttttttttttctttgtgtgttggggggagggggtctttattcacatggagtgctgtatgcgatgcctgggaaaagctctcagcctggtgtgtgcttcagcgtggctcgggctccaatctctgttttccagtttgtcacgggctctcaactgtaaatagcctatgccctgctggatgccaccttcttagacaccacgtgaatccccatgcactgctcctcttaccccttaccaccaccaagcagctattagacacctgaggtctctgtcctgttagtaccatggggcagaaaggtatgataccttttttcacccataagggtgacagccaacactcctaacaaaatacaggcgtgcaagagaaaagcattaacaaatttacttaattatttgaggcaaggtctcactctgtctcccaggctggaacgcagtggtgggatcacagctcgctgcagcctcaatctcccaaactcagtcaatcctcccacctcagcctcccaggcagctgggaccagaggcatgcaccaccatgcctggccaattttttgcatttctggtagagacgtgggtcccaccatgttgcctaggctggtcttgaactcctggcctcaagtaatccttctgcctcagcctcccaaaatgccaggactacaggcatgagccaccgcgcccagcctaaaagcatacaaaggtgttttttctctgtagatagttgttaacttggtgtccttgggtggggaacaatgggtggagccttctgttccaccatcttgcttcacctcctccaattatgtgtgttttgtatgcatatctgggcagtaggtcatagatttgaagcctctcatttcaactttactgtgtctgagaatatttatccttaggacacttgtgtatacatttgtgtgttgttgctacaataattgcctcatggtaactgagaaattgataagaagaaggaggtaagtcataccatgaggagggtttaagcacaacggcgagttagaaaagtactgaaggatttatagttaaggggcaggcttatcagtgggatatgtcaagcacattaagttgttcctgagtttgcaaatatttttctctgtgattgggccattggcatttgctaattggtgcccatcaaagttaggcttctacccacccacaggaactgagagatatcttctttgatgattatatatcaaagggatagatcccaggtccttgaggaagactttcctgagttgtaaaactgtcaagaagcttttgttaaaaagacatctcaaagtaggcagagaaagaacttataattccaagttttctaaaacaaatgctctaagaaacaagaaaacaagaagtcagggcctagagtcagtaagaagctggtctaaaattcagtcatgctgaggagaacgtcaatgccatctcagtcataaagttatggtagatgttgatgtttaaaaagctacacatcagcagatcagttttaaacaaatatgaatgttagatgtttacagccctaacttagaatcctcccctccttgccccaactccctccagaccacccagggcatcaggataccacaagatgtcagtggaggtgactaggtaagaattctatccattcaagaaccctgggggagaaacccatgctgcccctgtatttcccactatcccagggaactctgcctgccccagtatctagcaacagatgcttaaaactgtactagtaccatgtgctttcatcagctgtgcaaacttgggcaacttattcaaccaccctgagccttggtctcttcatttgtaaataagcatagtaaatacataccaccacagcactgtatcagaagtaaatctgatctgtgtatagcactcaacacaatgcttggcatatggtaatgactcaagaaatgataactatcaatatttcagccagttctcacctatgctattattctcatagaataatgaacatactatgacaccaaattaataaaatacacagagaggcagaagaaaataagttaaaagaattatggcttaaatcttttgaaattaaagcagaagaaactatcaatgaggcagtagctacatccaaagcgccatgccctatcctctgcaacttgatccaattttctgcccaactttccaagtcctgttccctcaaacttaaaatattttcccacgcagatctcaaatcttcatgttattcagcccaacggtgtaatgcaattttttaaattatgagtttttgttgtattttcttttcctatttatcacttatagcattttacccccccccccccaaaaaaaaacccatgtgggagttaattgacttttcaggaatcccatgcaaaattctccctcaaaacattctctttgtttgtgtcttggtagcaactccagagttttcaggacttggactctgctttagacttgtgctcagactgtctccacaaaagtggtccgtttcctcatccaatgagctctgcctgtttgtctgtgtgacactccagtggaaggaagccaagagcctataatagcgatcctggggaaaatttcagcagctggggccatgtaatttaaaacctctgaaaagtgtgctgcggtccgtgcacagcattagtataacgtgagggctgaatgcagcccattctctggagaacttcctcacacaccgcagcaaagagaagactgaaagacaaacctgggtgcagccagagaggtccagatagatgagcttgtggcatccattccccaagttcaggtactgtaagcctttgtctgtgaaccgtctgcaataagccaaactaagattctgtaagttgtggaagtgcctgaaaagacaaaagagaggaaggaaagtattatacttccgttgttctctcaaatctttcttaagccactatgacaaagaaaactgtaaattcaactcttcttcttgcagatgttcaacatttaactttactgttaactctctacctgttaattaaaggagactacagtgttatataaggtaacacacaatacatttaataccttgtaatacatttcaagtgaaagtattaatagttcaataatatttgcctagatatttaagaaagttgactgggataaagcttttttggtgtgtgtgaggtgggggaggcaatcatattgtttggaagtgaaaccaaatttgcagagtgtattgttgcttttaggttttatctctggagtaccaaaataatgtgcaaaatatataaaaggacaaatcctttgtaaacatttaaatggagactgttacaggagagtgaggatttgggacagaaggcaaaactgaatatgaccatgctcttaaaatagatctgataagcaaatgagtttaaaaaataggtttaaatatgcatgagtttgtgacagtttcattattatagttaaagaaagactaattgatatgcagagtttaagcatggattaagaagaccagtttgcaaataagcaggcaacacatgagaagaatcaaaagcaacatcagagactataaatctcgctggagttgaaacagattaaatatggtattaccacaatgaccaaaatgacagcttccagaaaaaagtagggtagttaggatgagcctgtactaccatacgagggctcgcagtttgaggacactccgtggacaatttcccaagccctccaaagcctggaacttttttttgagacgaagtttcgctcttgttgcccagctggagtacaatggtgagatcttggctcactgcaacctcctccccactcccccaacccctggttcaagcgattctcctgcctcagcctcccaagtggctgggattacaggcgcgtgccaacatgtccagctaatttttgtatttttagtagagacagggtttcaccatgttggccaggctggcctcgaactcctgacctcaggtgatccacccgccttggcctcccaaagtgctcggaacaggcatgagccaccgtgcccagaaagcctggcactttttaagaggtcaaggattcccactactatctgctcttctaatggaattagcaatcatgctcttagtttgtgatatgcaacagcttaatagcaaattagaaagcaaaaagaatgaaaagtgaggagaaaatgcttctctgcctctcaaaatcacacaggtgaataaagtttacctcccataaatgggaaataagatatacaagcactgaccattaatcagattttgaaaaacacatctatatgatataatgatttgcatgccatagcgaattacttgattcagaacacacatcccgatctgggaagggctgtgtacgtgagattcgacagagcgagggggaaggctttggactcaccagtgactaggtgggcagggcctgaaggagaaagcagtgctaatatcccaaagacacgccccctctcttggggctgtcgagtggactgagctgtgctaaagttttggaaatgcgttatcttcctctccctggggtacaccctgtgattcaactgagtacaattttcttggggtggggagaggcacaccagggtgtcatttctagcaatcctttagctttataatctgtagaaaggagttgtgaggcaggccgcgtgacacagtgcaaaatacacaaggtttttgaatccggccaaatgagatgtaaatccaagccctgacacttactgcaacctccctaatctctcagagattgttttctcatttgttaagtggagattaaaatattttttttttttttttttttacactgatcaactgtggggcctccagctttcctgaacctcagttttctcatctggaacatggatgtaatctggtctgcttgttccctttaaagatgtgacaattaaatgagaatacagaagtaacagtattatcttgagggtgattttaacaatcaaaatcggcagggacatagtagaagatttaaaactatatgtaatattattgctactactatgtgaaatgatagtaacacattaactatttttatggactttgtattattcttccatttaatgaaatggatacttatctccaagagtggtgcatacaataattccaagagtttgaaggatttcacattgaatgtatacctcgatctacacctagtattcaatttctttaaatccatgtgatcagttaacaaatatcaaaaatgagaactgagctaggagtgcttaactttttttaatgtcacagacacctttggcttttggcagtcagctgaggtctctggcccctttcttggcataaagtttttaaatgcataaaataaaatatataagattacaaaaacagccaattatattgaaatacataattaccaaataaaaaaacatttatgagtagaatagtaatatatgtgcttctttattaacatattaagtaagattttgtggcagttctaataactgctgtgattgtgaactatcagtgatattttgaaatacttataacaattgaaatgtgataagaatatatttgtgatttatatgagtaaaaatgtcccagagactgctaatacttctgtagtttttacctacatttcaattacagttaataaaagtagagatgagtttcttctttttttttttttgtttgagacggagtctcactctgttacccaggctggagtgcaatggcatgatctcggctcactgcaacctccacctcccaggctcaagtgattctcctgcctcagcttcccaagtagctgggattacaggcacccaccacgacgcctggctaattttttttgtatttttattagagacagggttttaccatgttggccagactggtctcaaactcttgacctcaggtgatccgcccacctcggcctcccaaagtgctgggattataggcattaaccagtgcaactagccgagatgagttttttatatcccccattaaaattcatggagctcctgaattctatccctgatcctcttgggggaatccactgctccccagctaagaacctctggtttagataaaagaggctgttcattagactaagtgactcctggattgaaaatctctggatagctcttttcacagtggaacctcatggaaccatcagtttgaaggcaaagctcaggaatcttgggtggccctgtaggcctttctagggatttacagttctgcagacttaaagctgctagggacgggaaaagtgtcagttgacagcaaaatcacaggtggcaaattttgtgcaatactcatactctttattctgaattttggcaaagacgcgtgtcccctacatgagtaagatctgattcatcattttcccagcccagagaacacttggtaattctaattctgctttgaggcaatgtttacagcttgtttttatctttttctaattatttgataactgtttcttatgggggggggtgtgagtcctctctttgtgatttatttatttatttttctgctaccactataatctttagagaaattacaattcttatagaaactacaaagatttttttttctcctttcttttgggtttttttccattaaagaattgaagtcatttgtgttaaatttctaacacctgaaggacttactactaagatgaatggaaaagtatgtatttaaataaaaaattctctgaaaaaaatcaccaagacaaggcctactctgtaaaagagggaatttgcatgtggattcttttgagttgagtgttgggctctctggtttcacagaggcatttcaagtaatagaattctgcagaaaacctaaatggagtgatctggccttctatttacagggtagaccttgaagttgtccagtcaagacaacagcttactttgtctgccccactttgataggcactggtgagactatagatcatgatagttcctgataataagaaatttccaagccaattgaaaggtcaattcatctatataaaaaacaattggatactactccactatagcatttaagactcaattaaagagcaaagatcataatagctttactcagcactgtatgcccagaacaccttgcacatactagttgatcaatacatggtgaacaagtgaaagaaggttgttattataattcaggaaaaggaaaaatcactgcagacttctggtagatggcgagacttaaggtgtgaaggctgtagattagccatgagaaggagaaaggcactgcagctatagagaatgtgaagcatgcagcaatcagatgactggagttaagggcttctcttgggaaacctaggcagagaagtttggttggagaatgtcaacgaagagtaagggaagaacctagaccttaagcatgtcaaagacatgataggaagattgttccaggatgacacttcttgtagcgtgagatagaacagattgaagggaggagagaccagaggcagcaccaccaggatactgtgccaaatgaggtgctgagagtgccacctaggttgtgacaataggaataaatagaaagtgtttagttccggaaacatttagaggcaacaaatttcctggaatgggcatgagctttaggcagccctcattttcaactttagaaaactgaacaagtccccaaagaagtgagaaaaaatattcaaataaaaagctggcaaatcattgttgccaaggacaaacaaattacatttttctcttggcaagtactttttttggaaagaaatactaaaagcaatgaagagagaatgacagcagaaacaaccaacatttctctgcttatttacagtttcgagaacatttttgcatacccaagcatatttgaaacaatggaaaatagagcaaaaacagagaatcattatgaaatgtatttttatcatagataacttagtatacttttttatatggcaaaaaaatcagtatcaagtagtatctattctgaatattctctcaatggcaagaactagaaggaagagccaaacaaaattcttattttgggtcctacttttctatctattgcctactaaaggtataacttcatttgtaaaataaatgtccctaagaagatatgcatagctgtcatattaccttcaatttctaaggagaaaaaaagccatttcaatgtatgattgaaaataaatatgttttaagttaaaaaataatttgtaatgtgatataaactacaccctgggtcacacagagtggatcatgcctataaccccagcactttgggaagctgaagcaagaggattgcctgaggccatgagtttgagaccagcctggggaacatagtgagatcttgtctctacaaaagatttttcaaatttagctggatgtgcccaggagtttgaggctgcagtgagctatcatcacactatgtagctgggtgtagcctgggtgaaagagcaaggccctgtctataaacaaaacaaaacaaaaaaatggctcccaaatcatctactttgtaagttcagattttcaccaatgatttatggattttataatactctttttctatgtttatgtacatacatacatgtacatatattcatatatatacacatacacacatatacacacacacttatatatcatagtacagaatgcctaaagaaagaactgagtggtattcaatattacaggactggaggatcttaagtaattcctgaaacagtgttagagaaacctcagggacctcccacagtggtcactggagccagcttgcacagctcatgggagttgattgttagcatctcttcccaactccacattcaatgacattgtgttgatagcttaaaatcggccacagtggaattatttacaccacagaaatcagtaaacactaggaattggtgcttctcctcacccttgccaccagccagttgttaagcatttaccagaacactgctgttcctaaaatatattccaagaattactgctacagagaaggcagtatgctaatgaaaaggcatatagaaataaaaatgatgaaagagacaactttgaaggacaggaataaaatcggatctaaaaataaaaggagattcttatgataaactctaaacaaatgcattgaagcattaagaataaaaatgccttccctagctgagaaaaaatatattttagtgttcaaaaggtttaaaatgtaccaggaaaaattaattgaaggaacacaattaagcttggaaatgtctttaatttctcagagaaaaggaaagtcttgcaagcatctcttagcaggaaaaaataggttaccaacaaaggaacaaaaaatcatgctagcttcagactttctataacctgaaatatcaaagtttatggaccaatatctaaaacattagggttttaaagataaaatacagaacatgattcaagaactatacatgaagagaagtttctgtttatcctccaagataatagtcattttcagagatcaatggctaaactatctgactctcatgcatctttactgaaaaaagatttttaaaattatatttccagttatcatcagatgaatcaaaaggctaaagaataagtaagctgtgagaaaaaaagaccatcaatgaatggcctagagttaagactacatactcattataaatataattacaatattgagtgcaaacactacaattcgatattaaaaagaaagttaaatgattagcaaaacccacaaataatatgtgtgttcatacaggggagtaggtgtgcaggggtgtcaagttcaagggagaagtagagggacaattgaagtgtattagatcactgtgtaccacaggagtagtcaaaagttattgtttcatcttgactttggtaattagataaatgcctgttaaagtatgtttttaaaaacatgccaatagccactaattagaatacacaacagaatgtgtatgtacctttcgaataccttcagattatacaagtaaacatagttcacagagcaaaagacagaaatactgagtacagtgcagtaacataaaaatcaaaacataaaacaagatgataaaaataaaaccatacactcagttttttttttcttgagacagggtcttactctgtcacagcacaatcatgactcactgcagcctcaacctctgtgctcaaatgatcctcccacctcagcctcctgagtagctgggactacaggtgcatgccaccacacccaactaatttttgtatttttttgtagagatggagttttaccatgttgcccaggctggtctcaaactcctgggctcaagtagtccgcccacttcagcctcccaaactgctgggttacagcaagccaccacgcatggcccatacactcaattttgacaataaatattgatcttttaaactgctctcttaaaaaggcaaagagaatgaatttaaaaatagaagttagctacatgctacatataaaagataaacctaaaatcccgcatcacaaaggttaaaaatacagagaaatgtagttattccacaaaaagaacaagcaaaagaaaacaaaggttaactatgttgataacagttaaaaacttcaggctgggcgtgttggctcatacctgtaatcccagcactttgggaggccgaggtgggcggatcacgaggtcaggagttcgagaccggcctggccaacatgatgaaaccctgtcgctactaaaaatacaaatattagcctggcgtggtggcgggcacctgtaatcccagctactcgggaggctgaggcaggagaatcctttcagcccaggaggcggaggttgcagtgagccgagatcacttcattgcactccagcctgggcaacagggcgagactccgtctcaaaacaaagcgaattcaaggcaaagaaacatcaaccagcataaagaatatcattttatgtgaataaatgctataatctgtaatgaaacatgatgcttactaacctttgttaataaggttgtaaaataacatcaaaataaagagaagcttgatcataataggcaactaatatatcactattataatgatgtatcaagaatttatatgtatatacacacagaaattttgttctctataagaaactctgggccgggcacagtggctcatgcctgtaatcccagcactttgggaggccgaagtgggtggatcacctgaggtcaggagtttgagaccagcctggccaatgtggtgaaaccctgtctctactaaaaatacaaaaattagctgggtgttgtggtaagtgcctgtagtcccagctacttgggaggctgaggcaggaaaattgcttgaacccaggaggcggaggctatggtgagccgagatcataccactgcactccagcctgggcgacagagcaagattccatctcaaaaaaaataaaaataaaaaataaaagaagctctgttttaagcatccacggatgatttttggaaattaattataaactagtctaccaagaaatctcaataaattccaaaaagtagaaataattcagtccacatttcttgactagagtgcctaattaaaagcagaagctcaactgaagaaacttcaactacttagaaccaaaaattttgctctaaatatcactgggtcaagtccaggcatggtggctcacgcctgtaatcccagcactttgggaggccaaggtgggtggatcacttgaggtcaagagtttgagaccagcctggctaacatgatgaaacctcgtctctattaaaattcaaaaatcagcagagtgtggtggcagacacctgtaatcctagttactcaggaggctgaggcaggagacttgcttgagcccgcgaggcggaggttgcagtgagctgaggtcgtgccactgcattccagcctgggcgacagaggaagactctgtctcaaaaaaaaaaaaaaattaaataaataaataaataaacattactgagtgaaagaggaaagcaaatatagaatagttggtttagaaagttaaaacaatacttatcaagttatacaaacttttcccaaattcttatttagaagtcatttcatgaccatattttttttattacttctaaaaggaaagaaatcaaatcatgcaaatgcaaaaatataaattagttcctagtttaattattggtttactgataagtatctaatgactggctttccaaaaaaagtatgcatataaatgtatgtgcatttactataaaattttatattttactattttgcggatataaaggatgtgtagcacgcaacttacaaatgataaaacataccatattctttactgttaattccatgtagccaatcaattctcacacaatgttttcattgacttttgtcaatgaaactcttataaatgtagccagccaaccaatggttgaaattaaagaatgatgactgggcgtggtggctcacgcctataatcccagcactttgggaggccgaggcgggcggatcacgaggtcaggagatcgagaccatcctggctaacacagtgaaaccccgtctctactaaaaatacaaaaaaaaaaaattaactgggtgtggtggtgggtgcctgtagtcccagctactcaggaggctgaggcaggagaatggcatgaacccgggaggcggagcttgcagtgagctgagatcgcgccactgcactccagcctgggcgacagagcgagactccgtctcaacaaaaaaaagaaaaagaaaattaaaaaaacaaaagaaattgaagaatgattacagttccaatatgaatttttttattaacattaataagacacaaggtgatatatgtcaaagaggtatgtccaaaatctgcttgtcaatgatgtgaatgccttctttcctaaatcaaagaatagttttcaagtattgagagaatatttcctcaatattttgtgctatttcacaatgtcgtggctacagacatgacctacttttaaatttaatttgcttcattcattgtgttctctatcactttaagtctaaacaatcaactgaacaataaatcaagccccgatttgtagtgtttgatgttttccgtggtatagaatacttccatattggccaattccaagctatcaatgagaggtcaccaaacacacagttgggaaaaaatgtgcagtagcattttcaccgtagagatacaatggacataaataactacaagaacacagataaagtaacatgcagaaaaatgttagaaagtaatgagtttttagtatttcttgcctgtataagaattttaaggccgggcgcggtggctcacgcttgtaatcccagcactttgggaggctgaggcaggcggatcacgaggtcaggagttcaagaccagcctgaccaatatggtgaaaccccatctctactaaaaatacaaaaaaacttagccaggcgtggtggcgggcgcctgtaatcccagctactcaggaggctgaggcaggagaattgctttgaacctgggaggcggaggttgtagtgagccaagattgcaccactgtactccagcctgggtgacagagcaagatgccatctcaaaataaataaataaataaaaagaattttagatatataagaaggaatcacacatgatttgataaaaattttattcaataaatgatgctgaaataattggttacctatttaacaacatttaaaatgtaaaactaggctgggcgcagtggctcacacttgtaatcccagcactttgggaggccaaggagggtggatcatctaaggtcaggagtttgaggccagcccgaccaacatagagaaacccctctctactaaaaatacaaaattagccgggtgtggtggcacatgcctctaatcccagctacttgggaggctgaggcaggagaattgcttgaacctgggaggcgaaggttgcggtgagctgagattgcgccattgcactccaccctgggcaacaagagcaaaactccgtctcaaaaaaaaaaaaaaaaaagtaaaactatgcttagcttaggtactgcaaaaaaacaggccttgggccacatggattgtagtttgctgacccctgatttagatcatcacttcattcatctatcaagattaattctagattgattatatatttaagtaaaaatacatgaacacactaaaataagcaaatgtatattaaatgcctggcaggaggaagactgtgtgtaagagcatcagaagaaatttcaaagggaaagctttatagatttgactaaaaatgtgacagcttaattagtgggataaatagaaaatatggtgccacttcttaggctggtacatttgcagaaaatggttagagtcagaagataaagaaaattatcaccgagaattttctgtgtaagcttttcttttttttttttttttttgagatggggtctcgctctgtcgcccaggctggagtgcagtggcgcaatcttggctcactgcaagctccgcctcctgggttcatgccattctcctgcctcagcctccgagtagctgggactacaggcacccaccaccgcacccggctaattttttctattttttagtagagacggggtttcaccatggtctcaatctcctgacctcatgatccacccgccccggcctcccaaagtgctgggattacaggcgtgagccaccgtgcccggcctgtgtaagcttttctaaatgtctcatcaccgttatttttcaaaggagcttaaaaaagctatattctcaaaaatagttcattctttcacaatagtttgagaaatgttttcccaaagtcaaatttgaatctctcctagtgtgatcatatacccttcctaactggcctttctgtaatgaaaataaagaataattgggccaggcatggtggctcatgccagcactttgggaggcccaagtgggcagatcatttgagcccaggagtttcagaccagcctgggcaacatggtgaaaccccatctctacagaaaaatacaaaaactagctgggcatggtggcatgctcctgtagtcccagctactcaggaggctgaggcgggaggattgtttgaagccaggagattgaggctgccgtaagccatgattgtaccattgcattgcagcctgggtgacagagtaagaccctgtttgaaaacaaactaaaaagaaaaatttttgataaatttgaatattctgtcaattcttttgttattctgtcccttctcctccaaaaaagagaagcaatattcacgtccaatgttgtcaacactccataaacggtcaaaaaacaagcagtgtcaagctccctagaggtggtgggagtctcaacaggtagccagagcatgggaacagggatctgggacaaaagtgctcaaagttggtaatcaggatgttggcattctattataaagaggtccgctgggtgtggtggctcacgcctgtaattccagcgctttgggaggcccaggcgggcagatcacctgaagtcaggagtttgagaccagcctgaccaacatggagaaaccccatctctactaaaaatacaaaaatagccaggcgtggtggtgggcacctgtaatcccaactactcaggaggctgacgcatgagaatcgcttggacccgggaggcgtaggttgccatgagctaagatcatgccactgcactgcagcctgggcgacagagcaagactctgtctcaaaaaaaaaaaaaaaaaaaggtcccagacaccagactggaatgtaagggccagaaagcttgaatgcccagaatgggggaccagaaagaagcaggcaaagtctaactcaagctactgggcacattgctgtaagagtcacaaaaatgctagccaaggcagaccagttcaggcaccagcttagggacttgaaagcagcagaccccttatcagaaaagcagtgccacagtggtggggtgttgataaagggagcactgcccttgcagaatgctagagcaagccagagactttgggagcataatttttttcagtgtcatacaaataacacaaacattacctcggcaggagtcgcatcgtcctgttggtgatagttgtgttagacagattgagacacaggacccccgggcagccctcagaaatgtgtctcattgattcatcctgcatgaaaaacagagggaagaggcttatcaaattatagcaggctttgcaatttccccattatctttctattatccctcttcctgttccagaaaaaaatacatgtaagagttggtttcttcatattctttatctactattaggttgaaatgaaattaaatagaagccaatgcttttgctcaaagcatcattactccctccttttccctttccttggaaatcaagtctcattccatcacaatgacacttcattaaaatgtgaacccatgcaagttcaactctgtcacacgaaatttgagctcacatgtcaaagtgccaaacacttctgactcttcatatgcaggaaagcaattaaaaactgatccattttaaacttattaaaattattctgaaaggcatactaaacactctcaacaatggaactttagtaacagtccatatttatacacatatacatttatacatagatgtgtgtgtataattaagcttctgtggttctgttaactaaatattttaaatagctgaacagattttcaccagatttatggtaagtttgagatggctaaaataaaatagaggctacataccagttgggcaggagattcaatgctgggagtagggtgggggaggatctcaaagattcaagcatccttcccccagaaagctgaaaactgaagtaagagagtagtgggaccatgaaataagagagacagaaaaacagaggtttcaagcacagattctaagttgaaatttacaagaccagatgaattgcaagctttgactgcaacaagctgctttttgtataggtaacactatataaaatacaacgagtagcagcaggtttttatttaatgattgatgaatctccccaggaacatcaacagggcagccagtttaagtattagtggtgcatgcaatgtttgacgctacatcagtcccagaaagaatagaccactgcaggtatctatctgtctggaagaggtaaatcattactaggctagaagatgtggttctgagaagaattctgcatcagaaatatgaccactcctaacaccactaaagatagtaaaggcttattttcaacaggatcattgaggtttaacattccattcattactatttccagtagtcatggatttttaaaacaataaaatcctgcaggtcagagcatctgtcacactcagataggaattggttgatttacaggggcagcaaaccacaccttaaagagaacacaagattctatttgaagctgtaaatctctgtgattctgctatagggaaggttctatgcacccatgctgcatgagaggccagtgcagagcttttgataaacactactcttaactacagtattcaagctgtcagcattttttctagatgccccatcaccaaaatgaaggatttgaataggtatggatagataaaatgtgtacaatttttccaaaaagaatctagagaataaccacgtgtggcactgtatttcaacacaatgaaaatctgtctttgaaaacgtttggcatgccaatcaagtatcaaagtgattatacacttgttgaaagaccttggcaaaatgcaaatgagatggggcaaggaaaggagaaagagctcacttaaacaccctcagagaggcagccacaaagatgaaaatgtggggaccaggaagaggaaggtggagtagctttatgtatcataaagaaatctgactttctgtttgagatgaggaggcaatccattctttgcattttcctgtctaaagaagcttggacatccaaacaaaattagaccactcccattctcagattgagatgaggaggtaatgcattctctacattttcctgtctaaagaagcttgaacatccaaacaaatttagaccactcccattcttagtacttaaaagaactcaagatttaatccccaaatgtttgaacacataaatgcaaaaactgagtacctacattgcagaatgacttatgaatttgtccacaatgtactcaaatctttctgaatgtaatatatttcataggataagcttagaaatcaaagctcttcgaatgagtgttacccaactccttaaatgtaagcctgtgtcccagtctacgtctcaaagggaaaaacaatagtaaaatgtagctggataaaattatcagccctgtatattattagactccaaaatcggacaagactttgatgttcacaaattcaatgcattgttttgacttccctattagagggccaaactcaaagaatatgatatcttactcaagtacacaactgaagctccctgaggacaagaactgaaaaatgattagttttttaattccctccaacacctagcagaacacatttaacatagtaggtgctaaaacatccacagaaagagtaaatccatttgacaaacaacttcattataatgacaggcagacatctggagaatgtagtagtcaagatttaaaatccttcttcatgaaggagcccacgttcactttgctagtggagaaagagtgcaaccagagaaagcagaacatttttttctctgatgtgatatttgacatgtctgtctatgcctccatttcttgcggatgaccctgaagggtacttttgaacataaaggaacagcttatttatgttaaagtacaagccactgagaagatgcttagtttacagtctatggtggttctttatgttctgctggacagggattaaacaactaatttaaatgctgactctgtgtgttgaggtaaggagtggaggagttctgagggtcttaacattcttctgtacacattctatttgtgtataatgccttccatgttttgaaaagatgttttactgtggaaatgggatggatttcatggggaaaaattactaaaggaggattttcaaagtgctcagttctaaaacgggagatacatatgtaaacataagtgtaatacagtgtgaagtatctgtgttgaagtactgagaccatatgtagctcagaagagggagaaattaattctgtcagctgggtgcggtgtctcacgcctgtaatcccagcactttgggaggccgaggcgggtggatcacttgagctcaggagttcgagaccagcctgtccaacatggtgaaaccccatctctacaaaaaaaattcaaaaattagccaggtgcagtggcacgtgcctataatcccagctaattgggtggctgaggcaggagaatcacttgaacctgggaggtggaggttgtagtgagccacgatggcaccactgcactccagcctgggcaacagagtgagactccatctcaaaaaaaaaaaaaaaaaaaaattaattaagttagaaattaactgtcaaaaagtgaacagaattgcatagggccgggggttgagagaaaatgaagggtgactgttgatgggcatgggttctgttaggggtgagggaaatgttctgaagttggttgtggtgatggtcaaacaactctgtaaaaataccaaaaccatgaaattgtacactttaagtgggtaaatttaatctcaatataaatataaatttattatatctcaataaagctgtttattaaaggtcaataaacaaagagaatggaaagacccgatagcattgaagagtgtgttaaagaatgaacaggtgttagccagtttgggctaggggtggtggggagggaagggtagtcatttaggcagatggaaaaacaagttcaaagacacaatgaaatagcatgacatgaacagggaacttcaagtggttcagtattgaaatagagtagaattttgaaagaaaaaactagaaagatgaggctgtaaaaatgaggctgagaggtagcagggaggggccaattcatgcagtcttttcaccagcgaggagggcttggccttcatggtggagctggtgcctcatgattggcattccacagccaggcttttcctcctattccctcctatctcgttagggacttactccatgagttgcttcagctgactctccatcatcctctataaacctgtttccatttccctgcccctgttttccttctaccactctctaagacacttttctggaaagatcagtttatgcctaatgcctcaccttctgacctcttctccacttcacaattcattgcaagtagatttctgctccaatatcccactgaaactgttgaagcaataattggcagtcccttctgattctcaaatctacaatgcattgttcagtccttttcttacctgttcactttggttctttctgaaactctttactcactttcattttgtgatacctcttcattgtcaacctacttctcttactattccttctgaatatcctctgttcctaaaagtcagcattccgtaaggctcaactttaagtctgctcctcttctcaaaccttctaagttgatcttattcacgcttatgatgttaattatgacttatacatagatgtcaacccaagatggaatctcaattctagtcaatgttgtccattgcctacttggtatctccagatagttgcattcactaaatattattgaatataatatgccaaagttcgtgctgttgtgctatgactaccacaaagaacaagacacatctcctgccctttgggtctcttaggctagtgaaggaagccaaaaccctatggttaaggatacttatcataggaacctagaggagcagcagtgaacccagccctgggagccagtgatgtcttggtagaagaggtgataataagacttaaagcttgataaagaggaaagcaccacttggggacaaagggaaagggcattttaagcaaagagcaaatgcacaactgcaaggagcaacttggagcatgcaggaaaaggaaactcagcagctgtaggcactgcaaattagtgtgtacacagaaactgaaacaagtgaggctggaaagggaggcagaggcaaaaccacagagggtcttcaaggtagagtaatattaaagagctttggctttatccaactgtgtagatgacggcagtgtgtgtagctggtggaagatgagagtgaagtagtcatatctgccttttacaaagagtataaagtgctcacagaatggaagacaggttggggacagagggaaagactggagacaggaaccaggaagaaagcaactagggaaacatattcatttccatcttctttggcacagctgttgatagccatgaagataaaatgagcctatcatgtctactggggcccaatttttttctgtctcatacacacataccattaaatataaatacagttcattttgggtagtcattgaagaatttctacttgccagaggctccaacactgagcatacatctacatgattaatattagcgttgtgcagatggagtaaaatttcttgtcaatgtttaacatagtttgctcttttccacattgaatcccaaataagcacacaagcatctattctgcatattggcaccccaatgtagcaagtcaatctatataaacagcagtaaaaatggttgcttatactcactgtgaatgttgggcagtcagagacattcaactcttgcaagttcctacagtggcctaaatcaaataagttacacgtcactaaactacatattgcaaatgtttaaacaaagtttttctatcttacattgaatgcaatgtattcattagaaaacaaacaaaaaccttggcaagtaacatgttctaagtatatggtttctttccccagaaaaatggcttttttgggcttcagaattaaaatacacagacatgtttattattgtttgaggattataggagtaaggggaaaagagaaaaatattactttgggaaaaacactatatacttagagcttttagcttgaaagcacttgaagaaaaccaacctggttttttgtgcctgcttttttatttttttgttttcatttaacattttattatgaacattttcaaacatacacaaaagtggaaagaattgtacaataaatatctatatagccactacttggattctaatttatcttttactgtatttgctttatcacatatccacccactcattcatctctatctatagccctcaatcatcttatttttgtatgcatttcaaagtaagttgcagacaccagtacacttccccccaaatacttcaacatgtatatcataaataattcagcatgtataataataaacagaatagttgacatacagaatacaatagttattctgtttgtttgtttcgtttttttgagacagttgagacaggatcttgctctgtcagccacgctagagtgcagtggcaccatgttggctcactgcagcctcaacctcccaggctcaggcgatcctttcacttcagcaacccctactgtcattcccaagtagctgacactacaggtgcataccaccatgcccggctaatttttgtattttttgtagagacggggtttccccatgctgctcagactggtctcaagagatctgactgcctcagcctcccaaagtgctgggattacaggcatgagccaccgcacctggccagaatagttatttgagagtaattcatcagttcaacaaatacttatcaaggagatatagcagttaacgaaatagacacaaatattttcccttaaggagtttactttctagcggggagacactaacagtaaacaaaagaagttaaataccatatctactttgacagatggtggtaagtgccatggagaagaaagaagaaaagggattgggagcacccaacaagtgggaagaagtgtgatttaaaatagggctgaacaggaagttttcactgaaaaggtaacatttgagccaagacatgcaggagatgacaaggacagtgccatttactccaagcatctctggagcccacacccaacatggttggtgactgggagacagaaaaggatagaaaaaaaaaaggctcaggaagacaacaattcaagtcctacccttgtgtgtgcatctcaaggctgtgttcttttaaagaaggagaattctttgaatttcttaaatccgatgtgatggtgaactgcaggcttcggttttcatcatgctgagtcctaacatttgtgactacttcccccggggtggccatgtgaagcatcttatgcgcatgagcctattttatcctcccaacaatattaggaggtatcctcggtccgttttacagatgctgaagatgacccaggttgatacagttaagcaggtaagagagccttgattcaaactcagggcacaaacatttggcctctaacccaggcaactaagaggggaaggagctttctacgtcactgttctgtggaactagaaggcctttgccttaaaaagtctgttcttatctgtcagtaatacagtgcttgcaatgggccttaatttttaatatatatttttttctcttccagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggggaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaaggtttgtacttttcttactttttcattttcatgaataacttgaaatgctctttgaatcttataatcctccctacatcccaccatgtcttggaattcgtgatgtcacttccaccagaaatccttccctattgacaatggaatttaccacaagtttttctggggtccagactcaaggcagttggtaattaaaggacaatgacaggagggaaggaggtatcctcaggagggcagccatttgggttctactcatttgcacatcgcaagctgtcactgtaaggaattcctttcatcttaactccaatttaatttaggtaggtaaaccaaggggtatgaaaataagtgcaaatgccatctatataacctgacttacaccgattaaagccaaaacatggtgtgcatctgtgagaagatcacctcaaagagaaaacatctgcaggacaggactgtgagagcactctgagacagagtgaaagtgatggcccttcggtatttcttatcatttagtcccaaggttttaataaatgctcctatgctcatgctcctttttttttttctttctttttttttttttttttttttttttttgagatggactctcgctctgatgcccaggctggagtgcagtggcgcaatcttggctcactgcaacctccacctcccgggttcgagcacttctcctgcctcagcctctcgagtagctgattttaataaatgcctcttaacatcctatatcttaattatttccaaattacccagaataaaacaataaaaatttaaagaactaaatttaaaatatttaacctgagaactatgagactaaggaaatctttctagaatattacctacttcctgcaaatcattactgggttttgcaaccgatgcaatcttgtgctagtattatgcaggatttgcacatgcaagataaagtcatgagctaagaaaacagacgggagattttagtaatgctcttgacatgttagtgaagattgatgttctcaaagagtggtctgggaactgctaatctaccctacaataacgaaccatgtaacaatgtctatatgtttcatttctggcatggtttaataatttatttgtaatattaaagccagatgtcattaagtgaggttcatatagagcacagtatcatttcttccacttattttgggaaattttgctatgttttgtttctttaagggcaagagaaaggggaagttcagagaggaggccgtggctcctctcgagagaatgttaggcaggaatttattaatgttgtcaggcatcctgaaccagaagtaaatttgctcatttaccagcaaagtcatgctcaagccttgccccactgccccgctcccctgccccccaccccagctgtaaagatggcacctggttagatcccacagcagcagccatgtggcacagggaggtttgcttaccaagacaccctgtgaactgtatataattcagtgccataggaaagcagttacatacagcttcataacctgggacatgccattctaggctccaggtacccacacacgcatgctgtctacaacttccaggaagatagtaacattcccatttacagatgaggaaaatgaggctcaaagaggttcagtcacttgaccatggatctcacaggtaagtagcaaagctaagaagtgaatcttggtctatctgagccagagcctatgagctctctacttcaccctgcaatcttccagaattaatctgagcatattcaaacaatcagctgtctcagcaatgcaaccattagagaatttcaaagagtaagtaaatgtagtttttctatagccagagtgggtagaatttcccggatattgttatggtgagtccttagtgcttcatgctgaagagcatgtttattagaatttcctttgtggtgcttagattgaaaactggaattatatatttttaatactaatacaaagctactctcctagattttagttagaatacttgatattgctgaggctctaacctcaagctacagtgaatttgcacttgctgtatcaggtgtaaatgagaaaagtaaatagtattaagtttattaattatctgagaaaaataccatctatacaagatttaaaacttctacaacgagactacactgtgttctaagaagagataacatgtgaggaaatgtctctttttcactgcttttatgctcttgggccattccctcccccaatgagcctatttctgcttttgtgtttttttccttttttcccatatttttctcttgaaaaacatcagcttataaaaataagtacatttttattgctttcttcaacttattgttgtgtaaacacaaccttccagaaatgccccataaattcataccccctgctttaaaaatacacattatttactgaaacacaatataaataaggtttcatgacatacacacttagtatatgtaacactgggtcatcaaagaacaacttaagttcctccaagtgttaatgactgtgtaattcagagcctattattttagattataagacgaagggtaggccaggtgcagtggctcacgcctataatcccagcactttgggaggccgaggcaggtgggacacttgaggtcaggagttcaaaaccagcctggccaaaaagttgaaaccccatctctactaaaaatacaaaaaaaaaaaaatagccaggcatggtggcaggcacctgtaatcccacctacttgggaggctgagccatgagaatcgcttgaactctggaggcagaggttgcagtgagctgagatcacgccactgcactccagcctgggcgacagagcaagactctgtctcaaaaaaaaaaaaaaaaaatgaagggtagctttgtcttttaatactatcagtacaaatggctttcactgtggtttatataaatctagtgattcatttcatcatttacttttcattttttgttatattgctgattcccataaattcaaagggaagagtcttgtttattaaattccctttggtagtgcctgccacagagccatgtgctttagattgatgatgataactggactactcttctttattctttcaaagcagtaatttaagcaaccattgaaagtgaaaatacacagaagttaaaaatcatggctagaattgaagtgtgacaacctgaggatcggtacaagtataccacatatacatggtcacacatagagaacttgcatacagattccccaactcggagttgagacttgcccagctgacttgcaatgagtcagatggtgtgtataggggacctaatatgtgcccattcaaccacacagacctcaatgatcactatgtatttttgccttaaatatctaatggcaagaaaaagaaataatagctttattcactgagaaacaggtactttgccaagaaatcctagtgtttcaaagggaataaatgtgagactaattgaaaggcatatttatgccatattgaggtaaacggatttgtcaagaatacatgaaagtcagagtttttaaactgctttagcttcacattgaccagaatagtttaccatttttaaggagttattttacttctaacatcagatgggggagaattacgcaggtaaattacccttagctgcctccaaagttaaggtcacaattttactacagcttgaacaatagttaagaattttgtatatgcaataaacagggccatttatgtctcttttcttactgctacaagctttcagagtagttctgaggttgctgacaaccaatatagcctgctaaatggggaaattacctggagaaatttcctaatttcctcctcaaaatcaacaagatttggctggagaaggagcaagcttgtaaggggtaataatcaagtaaatatggtatttgttgaggcatttaccaagaatttggggtagcagtatatatgaaatgtgcataccacatagtacctggactagaaataggggcattgatcaaattctccttctggtctggggaaatgtatatttatatactctttatcaaaagcaaacactttgcatcaatatttgcaatatttgcaattctcattgaagttctaaggtaaaagaactaaagaatttttctatttatcaacacagcaaatgagattttcctgtgtttttctaagccacactaggaaagcctttgttttgcatttcctggtattacttgtggatgctatttttacccaggactgctgctgacaatcccaaaatggattctgcagtttatattctttttccagcacccacagatctgccacattgcctaggcctagtgtcagggtgttctcataaacatttttttcgacccatttatttgtggttaacccactttagcttgccctaaaatggttgctctgtcatccaccttcatgtccagcccagcagatgtgggttcaataagcaagtcctgataaacaggctgctttctagaacctaggaggttctgactttggtgacaaggatgacctacaggtcttaatggctttatagggccttagtgaggactctggctttcatcacaattagatgggaagtcactgtaggctttgctgggctttgatggaatttagcgtatgctaaggcttgtttcatactaactttctttggctttagatatccctttaccccttctctttaagagctgattcttcaatcacacagatataacggtgaccgaggaaatgggggcaaaaagagcataataacgtaaatattattaaattttccagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctggtaagttcccctgtatagccccttcaatgggtggcaagtgttctgtgatttttttctatggcaacacttatatacagtaaattcagtttaaaagtaactgaactaaataataaagtacaagttttaattaaacatgacacttatactaggagttgtttgccactcagataaatacttgccaaaatgctgctttatgaagtatgtaataccacatattactaccatttaattcagttagcccaaatagtgtgttatagatttttaaagtaatatatggcaaatggtcaatagtatactaaaatgtagtggttttttttttgttttttgagatggagtctcactcttgttgcccagactggattgcaatggtgtgatctcggctcactgcaacctctgcctcttgggttcaagcaattctcctgcctcagcctcccaagcagctgggattatgggcatgtgccaccaggcctggctaattttgtatttttagtagagatggggtttcatcatgttggtcaggctggtctcaaactcctgacctcaggtgatccgcccaccttggcctcccaaagtgctgggattacaggcatgagccaccgcgcctggccaaatgtagtgactttttttgtttgtttttttttttgagatggagtctagctctgttgccaggctggagtgcaatggtgcaatctcggctcactgcaagctccgcctcccaggttcacgccattctcctgcctcagcctcccaagtagctggaactacaggcacccgccaccacgcccggctaatttttctgtatttttagcagagacagggtttcaccgtgttagccaggatggtctctatctcctgacctcatgatccgcccacctcagcctcccaaagtgctgggattacaggcgtgagccaccatgcctggcctaaatgtagtgatttttaaagggaaattcaaatttggaattttttttgctattcattaagccccatcttgtttagaataaattagaaacaaactgctaagcactaagctcaaattaggataaaatgtgctcaaaccagagccagacatattatatctagttctagatcaagaccaattctctttcccatccttcaaatctcttctccatttgctaagcaaagcctctggcgaaaatgagcttggtaaattaagtaaacacatcggatttggaaagaactgagaattactgcaatattgaccagatttataacatatataacacaagtgctttcactaggctacttcaatttgaaaagttttaactatgaaaatgattattaaaattattaataatgtaatgtaatgttataaacattttgagtacaactgtttcccctgcttttcttcatgataatctaataccattaatagaacattagaattttaacacaataaaagtgaaaaattagaatgaacattctggagccacaagggcatattttagagttaacctttttttaaaaattagaaaagcataattttttaaaatttcccaagggacagcagtatgctacacttataccttagcttgttacagatgatgctaacttgggagtatgtttgaactgtgaagtcaaaagcaattttcatttttcaataaataaggatactacagacacccttctcccaaatgaagttagcattacattagtgtgcaagtcagtcactggtagccagtgtcatgtccacaaagccagggtacagggtaaagaatctggaagtggagaccctttcttgcaagaaaaactcacttcgaccccctatgattccatctccaacctgaccaatcagcactccccacttcccaagcccctacctagcaaattatctttaaaaactctgatgcctgaatgctcagggagactgatttgagtaataataaaactctggtctcccgcacagccagctctgcatgaattactctttctccattgcaattcccctgtcttgataaatagactctgtctaggcagcgggcaaggtgaacccattggatggctacaaactaaagaatctcaggacaagcaaaagccattccaaaggtccttgggcaagtgtctaatttccttctgctgtcatccacaagcaaaactgtagtttaccaactatcaatgcaaacaagttttaaagctgtctcaaaaaaaaaaaaagattataatagttattatatgtcctaagttaaatgtattaaagtaatgagtaacagtgtggcaatgttttagttacaacaaaactagtatacaaagaaaacttgagaaaaatgagaagacaatgcaaagagatagataatagtgtaaaatggacttgccttgcttctactgatgtttttcacatgtttcccgtaactgatacttttcatcagttgtggaattcccataattgcagggattccttttctgtccttaggatcccctgaaggccttttaatcttgttcaccaaatgtgtgttccttgctgacacaaaatggtctctaccatcagtggtggtactcttttttccccctttgttcaattcaatctcaggaacgtatttcctacattaataaatatttactgagcacctaccaaatgccaagcactttcctagaacaaaagttcttttgaaacaaaaaagtatcttggcagttaaggcaaaatgacctaaagaagttttaaaatgaaaggtctcctatatttcagggtctttgagatgaaaccctgcaagtagacttacgtgaatgatttttgctgtggtaagtatacaaatgcagtgggagttgccagactttaaaagacgtgaataacaatcatataaaatgccagacattgttgtggaaaagagaaagaagataccctactagggggtttttacctcctttaagaaacagactaaaactagttttctcaagtgcctgaatatatatggtttaaataacaatatacaacactttcaaaataaaatctaggaatgtttacatatgcttttaatctcaaagtctaatgtcttgagaaaagtaaatctgtgagatcactgactcacagaattttagcaaatagaaaaaatccagtatcttcagaacacaagggctgatcttttgtcccctacccgcaagacattgcttggtaccaaaatagaaagttatttttttaagggggaattatgggttttttctgagaacagataatatgaaaatagttaatagtattggtatgaccacatattttcctaattcaaaataaggacgctatgctctacaagagtattttaaaacaataatgagataatgtttgaaatagaaacaaaatatttgtgagtatttctggagtatctggctggtccatatcaactggaatacagataacccaggtgtagatttctttgctcttagagggtgaaaaaagctttttgttgttttattttcagttatattggttttaattatccagcctccagcaaaattaaatacatatggattcaaagctgatagctaccatagtttgccaaaatacaaccagatgttttcaaaatgtggaaaaattgtttttggactctacaggaatagaacccttcccccaacactgggaaaaggttgttttctaggcattttcagtgttactgatatcccaggaactgtcagatcaccacccggcacatttttcatttttatctgcacttgtcttacatgcgaaatattttcttaattcatgtctcttttttgtagcatctttttttcccaagtaaataccaaaaaaaaaaaaagcccaaaatacattttttaaagctaacttaaaactgaatattgtattctagtaaaactaatcaagggaaaagctttgagtaacaatatatttcacaattttgcatttagacacatttacagtgaagaaatataattaaaaacaaaaccttctatcaatccagaaattctctccacaaaggtagtaacgaaagaaacactttcattattgactaagcattaaaccagaatgtgacgcatatcacaggcaatccactaagagactgcaaagactctcgccactatgtaaccaggcagataccacccattacaggaatctcatccctgtgtagccaagcagataccacccattacatatacgttttcaggacaagcaataacgaatccttaaggaagaagatttgacaacaccttttgtcacacataattcatcctaactttacctggtaaatggagtgaccatctgtgttagcttattggccttattcagagaaaaataaatttctgtcttcatgacaggaggtagttttgcaactggaagcaagatctcaccaaagttaggaccccaccttcccaccagagctgggagatgtccttggaaaatacattcttgcatcataaaggtgacaaaaagcctatctagtcttcaaaaggatttaaagacatttcaaagagaggagaaagtacttatagttaaaagttttctaaagtaaaagctctgagaaaaagaaaggaaaagaaatctctttattttcaaaggggaaaattaagcctctttttaaaatttgtatttgtcctttccatatgccatacactgtattaactcaattactcaggctcaataaatattttctgtttccagccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgtttacatgcctttcgatagctgtttgtgcatacttaaagatgatcaaaatgattttatacaaatgctgttataataaaatgtcattccctacccctctactttttttcagtaagtcatcttatacattaaataaatttccatttctgatttctgtgcattccaaaatgaggtcctgatacatccaaattctcaaccactcttcactgatccttgcaaagtactgtcaagctagacctgaaagggaattgtcacaaacaataagaagagaatgtgagaattacattggaagctggttagaagctaggaccctgaataacagctgtagatggtgtgaagcatgagccctgaagaggtataaacactcgtgaatatggagacaccatttttgtttgtttgtttttgtttttgttttgagcagggttcatactgggaatccacctgtccgtgagaaagggcccttcctgctaagctagtatgtcgaggagcataaaataaagaatgaaattaggatttgggggcagtatttgggatgaagccagaataaaatataggaaataatacgaggccactgagggaggaggtggtgcccaaaagaagccccgtgatttgggtttgcaggttaaaatgagctcacctagagaactagatcaccagcaaaagaggaaatcagtggaggattttagaccctgatcccatcagtttgcatttagatagtcatattctgcaaagagaaaaataaagtgaaaagaaatattcgcatgtccttagtgagatactactttttccttttaatatacattttcctttcatgctgagttgaatacattttcatttcttgtatcaaggtattcctacaaagtttagcaaataaccaccttatctgatacttgcacaaactcccaaagcatggaagatggtatataacaaatagtattaggcattttttttttctgagataagagtcttgctctgttgcccaggctggagtgcagtgctccaatctcagctcgctgcaacctacgccttccgggttcaagcgattctcctgtctcaacctcccgagtagctggtattacaggtgctcaccaccatgcctggctaatttttgtatttttagtagagacgaggtttcaccatgttggtcaggctggtcttgaactcctgacttcaagtgatccacccacctcaccctcccaaagtgctgggattacaggcgtgagccacactcagccatgcacttttaaagcacatgctacatgccagacaccatgctaagagcttcacatatgctacttctaattctcacaaaatccctctgaggtaggtgatactgtctgccttttataggtgaggaatcaaggtagagggtttaggtaacttggacaaagtcacacagctggcaagtggcagggccaggattcagatctgcctaagccctttctgctatgcagagctgcacagcattgtaaaagttatccttgtccatggctgtctggcaccagaacttccagaaccaaaccccaaagaggagcaggtaccaggaaagtgggggagcactcgtgagggcagttggcaggagaaagtcttttgtccgagacatttagatctgtatttatttacaggaaacagagaatgggaagccagaagaactgccagagctaacgcttcagtaaataactctggattgtgagtttctatttttattttatttatttatttatttatttatttatttatttatttattttgagacagtctcgctctgtcatacagtctggagtgcagtgttgcaatctcggctcactgtagccttcgcctcctgggttcaagcgattctcctgcctcagcctcccgagtagctgggattacaggcgcccaccaccacacccagctaatttttgtatttttagtagagacgggggttttgccatgttggtcaggctggtctcgaactcttgacctcgggtgatctgctcgcctcagcctcccaaagtgctgagattacaggcatgagccactgagcctggactggattgtgaggttctaaccactctgcccagtggtctgggtcagaggtggggacttagagacgttacttctccatgcaaatccctacattgttcactatgaggcatgaaagccagctactacatttcaaatgttaccagagagatgtaagaagttcatttatttacaaattcatttattattgttcatgagcctcagagtggaattttaaggacataggacctgaaagagccaagatttgatgatggaaaaagcctggtgtgacaacagaatcacactggaggcaagaggattctggaatgaaatgagatgaaacctgattcagagaaagagcccaagttgttctcagtataatttttagaggctagttagggattttattggttgattttcatattcaatttaatccccagggatgtatttggaaataaagctcctgaacacatcaaaacagaaattaatccaggccatccaaaagtaagtcagtaggtattgctaacatctctcagggtcaagactgaagtggactttcaaatcttaagatttgccccttttctacatcagagttaaactttttcagggaagtgtagttgattcatgatggaatgaacaattagacacttcctcttccaccaatttcttactttatagttactcttgtaacttgcctttggatgtctcttttttacgacagacaatacaagttcataaggttacaaaaatcagtatattttacagtagtaaaaaatactactatcctgagatatacctatttgaacgtatatatcacttggatatttggataaaataagttaaaaaaaaaaaccctttcctagtcgtaagattctctgatttttctgaagtaaacaagatttactataaacggagtcctcctgagtcctgagttggctgtgacctaatgcctagttacttgagaaagatatttaatgttaagcagcactgctttttcattcattcaccattccatcctctggagcctatgccctggatcaattcatgtctgtttctgagaaatctgagtctcctgctctggcaaattggcaaatcaaagggattcagtaatgaggatcttttttttttttttttgagttggagtctccctctgtcacccaggcaggagtgcaatggcaccatcttggctcaccacaacctctgcctcctgggttcaagtgattctcctgcctcagcctcccgggtagctgggattacaggcgcccgccaccatgcctggctaaattttatatttttagtagagacagagtttcaccatgttggccaagctggtctcaaactcctgacttcaaatgatccgcccacctcagcttcccaatgtgctgggattacaggaccactgcgcccggccagtaatgaggatctacttgtctgaattctgttaagtctgtgccctcatctgccttttaaggatttatttattttcttttttttgacacagagtctcgctctgtcgcccagggtggagtgcagtggcatgatctcggctcactgcaacttccaccttccgggttcaagcaattctcctgcctcagcttcctgagtagctaggactacaggtgcccgccaccacacccagctaatgttttgtatttttagtagagatggggtttcaccatgttagccaggatgatctcgatctcctgacctgtgatctgcctgccttggcctcccaaagtgctgggattacaggtgtgagccaccacgcccagccttttttttttgacacagtctcgctctgtcacccaagctgaagtgcagtggcatgatcttggcacactgtaacctccatctcatgggttcaagcaattctcgtgcctcagccacccaagtagctggaatcacagttgcacatcaccatacctggctaatttttgtatttttagtaaagacaaggtttcgccatgttggccaggctgggctcaaactcctggcctcaagtgatccgcgtgccttggcctctcaaagtactgggattacaggcatgagccactgtgcccagccttaaatattttaagataacattctacagttaattttctaaaattttactggtataaggattacaactgttgtgttcaatcagccaaacagcccaaaagagtagccaatatttatcttcaatctaacagtcagaaaaccaatcttcccagaaatgtgtgtaattcttgacacaccaatagaggaactgatcttagctggggtaggggttggtagtggggcaggagagacaatggaaaagctaaaacatctctgagaatttttttttaacttttattttaatttcaagggtacatgtataggtttgttatataggtaaacttgtgtcacaggggtttgttgtacagataatttagtcacccaggtattaagcctagtacatgttagttatttttgctgatcctctccatcctcccaccctccaccctctggtaagccctagtgtccatcattcctctctatgtgtccatgtgttaagaatggtttttatctttgacacactcaagttttctggaattaaaatgggtttgattaaataattttcagtaaattaaaaatattaccaagataagacagacattacatttgcttccttaaaaaaaatcaaggtctactcaggcttgaatgctcagttgtttctgtgatgaagacaattgtactaagaagtacacttccagaaaaatactgcgtgaaatatattttagttacaaaatattaaaaatttaaagaaagaaaatgtttacaggctatcttgacctcagatacatatacaaacatatacatcctatgtatagtggttaaaacctcacaatccaggctgggcatggtggctcacacctgtaatcccaacacttcaggaggctgaggcaggcagatcacttgacgtcgggagttcaagaccagcctggccaacatggcgaaatcccgtctctactaaaagtccaaaaattagccaggcatggtggtgcacacctgtaatcccacctactcaggagactgaggcatgagaattgtttgaactggggagatgtggttgcagtgagccaagattgtaccactatattccagtctgggcgaaccagcaagactctgtctcaaaaaaaaacaaaaacaaaaacagaaacacaacaataagaaaacaacctggttaaaaatgggccaaagaccttaacagacacctcaccagaaagatagaagcatatgagaagatgttccataacaaatgtcatcagggaaatgtaaattaaaacagcaatgagatacccccacacacctattaggatggccaaaatccataactgtgacagcaccaaatgctgatgacgatgtaaagcaacaggaattcccattcattgctgatgaggatgtggagcaacaggaactctcattcattgctgatgagaatgcagaatggtacagccaactttggaagacagtttggcactttcttacaaaacagcacatactcttaccatataatccagcaatcatgttccttggtatctacccaaaggagttgaaagcttatgtctacataaaaacctgcacataaatgtttataacaactttattcatatttgctcaaacttggaagcaaccaagatgtctttcaagaggtgaattaataaactgtggtatattcagacaatggaatattattcagcattaaaaaaatgatttatcaagccatgaaaagacataaaggaaatttaattgcacattaataagtgaaggaagcccatccaaaaaggctacatactgtatgattccaactatatgacattccagaaaaggcaaaactatatagacaataaaaagattggtggttgtcagaagctagcagggtgaggggggatgaccaagcagagcacagaggattcctaggggaatgaaactactcagcacaatattataatggtaaacacctatcattgtaaatttgtccaaactcatacaatattcaacactaagagtgaaccctatataaactatggactttgggtgataatgatgcgtaaatatagcttcaccaattgtaacaagtgtgtcattcttgtgggtgatgttgatagtggggaggctatgtatgtgtgggggaaggaggtatataggaaatctctataccttctgctcaattttgcgagaacctgaaatttctcttaagaataaagtttatggctgggcacagtggctcacacccgtaatcctagcagtttgagaggccaaggcgggtggatcacctgaggttaggagatcaagaccagcttggctaacatggtgaaaccccatctccactagcagaggttgcagtgagccaagatcatgtcactgcactccagcctgggcaacagagcgagactccatctctaaataaataaataaataaataaataaaagttaatttaaaaaaaaacgaaaagaaagctcttaaatcaataacctaacttttaacctgaagaaactagaaaagaagagcaaacaaaacccaagtcaaccagaataataaagactgaagtgggctaggtgcagtggctcacacctgtaatcctagcattttgggaggctgaggcaggaggatcacttgagttcaggagttcaagaccagcctgggtaacatagtcagagcccgtctctacaaatttttttttaaaaagattagccaggtgtggccacctgtagtcctagctacttaggtgggaggtgggaggatcacttaagcccaacaggttgaggctgcagtgagctgtgatcatgccagtgtactccagcctgggcaacaaagtgaaactctctctccaaaaaaaaaaaaaaaaaagattggagtggagataagcaaaatagaaaatagaaaatagagaattaataaaaataagggtttttttgaatatccatatttatagtagtattattcacaatacctaaaagactgaagcaactttactgtctattattggaagaatggataaacaaaatgtgttatatacatacaataaaatattatttacccttaaaaagaaatgctgacacatgctaaaataagtaaaccctgacgacattgtgctaagtgaagtaagccaggcacaaaagaacaattattgtttgattccacttatatgcggcacctagagtcatcaaattcatagagatggaaagaaagtagaatggtggttgccaggacctaggaggagggcaaaaagcggatttagtacttaatggtacaaactatcagttttgtgagatgaaaaagttctggagatgcatcagtgatgatggttgcataagaatgtgaatatacttaatgctacagaactgaacacataaaagtggttaaaatggtaatttttaggttacatattttttacaacaatgaaaaaagaaccaaatggttgtttgaaacaatcaacaaaatttgcaaacctttacctagactgaccaggaaaacaagaggaaagactaatattattaaaattagaaatgaaagtgggtacattagtactgactttacagaagtaaaaaggatcataacagaatattatgaactgttgtaccccaacaaattagataaactgcatggaattgacaaatgcctagaaacacatgaactaccaaaactgactcgagaagaaacagaagatctaaatagagctataataagtaaaaatactaaatcagcaatcaaaaaacctccaacaaggccaggcaccatggctcattcctgtaatctcagcactttgagaggctgaggcaggtggatcacttgaggtcaggagttctagaccaccctggccaacatggcaaaaccccgtctctactcaaaatacaaaaattagctgggtgtggtggcacgcacctgtaatcccagctactcaggaggctgaggcaggagaatcacttgaacccagaaggcagaggttccagtgagccaagattgcaccactgaactccagcctgggtgacagagtgagactccatctcaaaacaaacaaacaaacaaacaaacaaaaaaaccctccaacagagagcctaggaccagatggcttcatgggcaaattttaccaaacatttaatcctcaaactttaaaccaaacattaatcctcaaattcttcccaaaaaatagaaggaaaaaatacctcctacctcattcgatgaagccaatattatcctgacaaggaagccaaagacatcacaagaaggaaaaactacagagtaatattccttttaaatatagatgcaaatatcctcaaaaaatattagcaaagagaatccagcaccatattaaaaggattatacaccatgatgtacgaacaagcaagactgatctcaggcattcaagagtggttcaacagacgaaaaaaaaaatcaatcaatgtaatatacgcaataataatagaaggaaagaggggaaaaccatttcagttgacttagaaaaggcatttgacaaaatcccatcacccttttataataagaacactcagtgaagtaggaatatatgggagcttcctcaatgagcaattgtgtaagaaaagaaaaaaaagggagaatgggtatgagcttcctctttgggctgatgaaaatggtctagaattaaatagtgctggttgctcaacattgttaatataataaaaaacactgaattgtactctttaaaatggttaaaaaggtgaattttatgttacataaaatgtatctcaataaacaaaagcttccagataagcatgccttgctatttctcagaaactcattccactgttcaactaccattgctatcatgaaaatcttaggtcaaactgaaaccctgaatgttgcaacttgagtccatttccttccttcagaaaatgcagatgtatttaatagtatattttctatgtatatttcatatgtgtatatatgtgtgtatacacatatacctatagggaaagagggacagacaaaaacagagaaacaaggggtgttccaagatggccgaataggaacagctccggtctgcagctctcaacatgatcgacgcagaagacgggtgatttctgcatttccaactgaggtacctggttcatctcactgggactggttggacagtgggtgcagcccacacaggaaaagccaaagcagggcagagcatcgcctcacccaggaagcacaaggggtcgggggatttccctttcctagccaagggaagccatgacagactacctggaaaaatggggcactgctgcccaaatactgcactttaacattcttaaagaaaataattttcaacccagaatttcttatctagccaaactaagcttcataagtgaaggagaaataagatcctttacagacaagcaaatgctgagagattttgtcaccaccaggcctgccttacaagaactcctgaaggaagcactaaacatggaaagaaacaaccggtaccagccactgcaaaaacatgacaaattataaagaccatcactgctatgaagaaactgcatcaattaacaggcaaaacaaacagcaaacatcataacgacaggaaaacattcacacatcacaatattaactttaaatataaatgggctaaatgccccaattaaaagacacagactggcaaattggataaagagtcaagacccatcagtgtgctgtattcaggagacccatctcatgtgcaaagacacaggtaggctcaaaataaagggatgcgggaagatctaccaagcaaacggaaagcaaaaaaaggaggggttgccatcctactcactgataaaacagactttaaaccaacaaagatcaaaagagacaaagaaggccatgacataatggtaaaggaatcaattcaacaagaaaagataactatcctaaatatatatgcacccaatacaggagtttccagattcataaaacaagtctgtagagacctacaaagagacttagactcccacacaataataaggggagagtttaacaccccactgtcaatattagatagatcaacaagaaagaaggttaacaaggatatccaggacctgaactcagctctgcaacaagcagacctaatagacaactacagaactctccatcccaaatcaacagaatatacattcttctcagcaccacatcgcacttattctaaaattgaccacataattggaagtaaagcactcctcagcaaatgtaaaacaacagaaatcacaacaaactgtctctcagaccacagtgtaatcaaattagaactcaggattaacaaactcactcaaaactgcacaactacatggaaactgaacaacttgctcctgaatgactactgggtaaataatgaactgaaggcagaaataaacatgttctttgaagccaacgagaacaaagacacaacgcaccacaatctgggacacatttaaagcagggtgtagaaggaaacttatagcactaaatgccccaagagtaagcaggaaagatctaaaatcgacaccctaacatcacaattaaaagaactagagaagcaagagcaaattcaaaagctagcagaaggcaagaaataactaagatcagagcagaactgaaagagatagagacacaaaaaaccattcaaaaaaaaacaatgaatccaggagttttttttttaaaaagatcaacagaattgacagactgctagcaagactaataaagaagagagaagcatcaaatagactcaataaaaaatgataaaggggatatcaccaccaatcccacagaaatacaaactaccatcagagaacactataaacacctctatgcaaataaactagaaaatctagaagaaatggataaattcctggacacatacaccctcccaagactaaaccaggaagaagttgaatctctgaatagaccaataacaggatctgaaattgaggcaataattaatagtctaacaaccaaaaaaagaccaggaccagacggattcacagccgaattctaccagaagtacaaacaggaggtggcactattccttctgaaactattccaatcaacagaaaaagagggaatcctccctaactcattttatgaggccaacatcatcctgataccaaagcctggcagagacacaacaaaaaaagagaattttagaccaatatccctgatgaatatcgatgcaaaaatcctcaataaaatactggcaaaccgaatccagcagcacatcaaaaagcttatccaccacaatcaagttggcttcatccctggaatgcaaggctggttcaacatatgcaaatcaataaacgtaatctatcacataaacagaaccaacaacaaaaaccacacaattatctcaacagatacagaaaaggccttcgacaaaattcaacagcccttcatgctaaaaactctcaataaactaggtattgatggaacgtatctcaaaacaataagagctatttatgacaaacccacagccaatatcatactgaatgggcaaaatttggaagcattccctttgaaaaccagcacgaggcaaggatgtcctctctcaccactcctattgaacatagtattagaagttctggccagggcaatcaggcaagagaaagaaataaagggtattcagttaggaaaagaggaagtcaaattgtccctgtttgcagatgacatgattgtacatttagaaaaccccatcatctcagcccaaaatctccttaaggtgataagcaacttcagcaaagtctgaggacacaaaatcaatgtgcaaaaatcacaagaattcctatacaccattaacagacaaacagagagccagattatgagtgaattcccattcacaattgctgcaaagagaataaaatacctaggaatacaacttacaagggatgtgaaggacctcttcaaggagaactacaaaccactgctcaacacaataaaagaggacacaaacaaatggaagaacattccatgctcatcgataagaacaatcaatatcatgaaaatggccatactgcccagggtaatttatagattcagtgccatccccatcaagctaccaatgactttcttcacagaattggaaaacactactttaaagtttatatagaatgaaaaaagatcctgcattgccaagacaatcctaagcaaaaagaacaaagctggaggcatcgcactacctgacttcaaactatactacaaggccacagtaaccaaaacggcatggtactggtaccaaaacagatatatacaccaatggaacagaacagaggcctcagaaataacaccacatatctacaaccatctgatctttgacaaacgtgacgaaaacaagaaatggggaaaggattccctatttaataaataatgctgggaaaattggctagccatatgcagaaagctgaaactggatcccttccttacaccttatacaaaaattaattcaagatggattcaagacttaaatgttagacctaaaaccataaaaaccctagaagaaaacctagacaatatcattcaggacataggtattggcaaggacttcatgactaaaacaccaaaagcaatggcaacaaaagccaaaattgacaaatgggatctaatcaaactaaagagcttctgcacgggaaaaaaactgccatcagagtgaataggcaacctacagaatgggagaaaatttttgcaatctacccatctgacaaagggctaatatacagaatctacaaagaactcaaacaaatttacaagaaaaaaaacaaacaaacccatcaaaaagtgggcaaaggatatgaacagacacttcttaaaagaagatatctatgcagccaacagagacatgaaaaaaagctcatcatcactggtcatcagagaaatgcaaatcaaaaccacaatgagataccatctcacgccagttagaatggcagtcattaaaatgtcaggaaacaacagatgctggagaggatgtggagaaataggaatgcttttacatcgttggttggagtgtaaattagttcaaccattgtggaagacagtgtggtgattcctcaaggatccagaactagaattaccatttgacccagcaatcccattactgggtatatacccaaaggattataaatcatgctactataaagacacatgcacacatatgtttactgtggcactattcacaataccaaagacttggaaccaacccaaatgcccatcaatgatagactggattaagaaaaacgtggcacatatacaccatggaatactatgcagccataaaaaggatgagtgcatgtcctttgcagggacatggataaagctggaaaccatcattctcagcaaactatcacaaggacagaaaaccaaacaccgcatgttctcattcataggtgggaaatgaacaatgagatcacttgaacacagggcggggaacatcacacagtggggtctgttgggggtggtggactgggggagggatagcattaggagaaatacctaatataaatgatgagttgatgggtgcagcaaaccaacatgatacatgcatacctatgtaacaaacctgcatgttgtgcacatgtaccctagaacttaaagtataataataataataataataataataataataataataaaacagagacagagagagcaaatttgggtggctaacactttaaggtttataattattttattaactttttattactacaaacataataaattggttaaaaatggcagactaagcacatgttcagcttctctcacctgcccaaaatccaagaatgaattttttttcaaaaatgtataacatgcgtgaagacaaagcaagaatggccttggtggatcagaaacaaacagttcctaaaaatccaaaggcggatgtgaccagacagaatgaggaacatgcaggacacagctgctgtaaaggtgaaaacagcattatatccacatacaggatgtatcccagaaattaaaagacgtattaatattaacattattttcatgaaaaatatgaaaaaggagacatgaacaagactcctgcatatccctgctacttttcaacattgcaaaaaaggtcctaaacaatgtaataaaatgagaaaaagagaaaagatataggaataggcatgaatgaaaataaaactgtcaacattcccagatatgacagtctacctagaaaattcaagagaatcaattgacaagctattaaaaccaagaagagagcttaatacatggtcagatacaataacatcatataaaaaactactgctttgtgtagcaccagcaataatcaatcagaattattccattttgcataatttctttttttcactaaaaaatgtacagacacagttgaaactccttgtgcacttcttccccattccattaaattctatctatttgcacaaccactgtcttgcgtttggagtttttctttctcatgcatgctttttatatgtcactatatgtgtgtgtacttaaaaatctatagtaatatatattgtttgaaattatttcaaaataaaaggtaaaaatatatataattttgcaaattgaaaagttatatacaaatggtattagattttatatataatatatagctctctcatgcaacttcattttaccctttaatatctttagacttctccaactggtatttgtacatgtatatgacattctatctggagtcaatatgaatgtatacatttttgaaatatattgtttatttcatttccagaaatacttatatgatagatagaaaacgcatctcaaaggatatataggttaaaggatatataggttaaagacaaatatcacaatggaagtacaaagcagtcagtctggaaaaaattggaaataatctcaatgtccatcaaatagaagaaggttaaataaagtatgttacatctataacatagaaaataattttacagtatgtaaaaataatttagtggatctatatgcactgacatggaaagattttcaggacataaaagaaaatataaaacaatatgactcatgttgtaaagttgtgtatttttaatcacatatatagaaatgtattttagaaaaacagaaaactaataacattggatgcctttgagtaagtgaataggtttgagggaagtgaaaaaagatggttttactgtctattgttagttttttaaaaataagaatatgttttatattttttagtagaaaaaattgatgatccatagaaatacaaatactagaccccaaaagagtagtcaagaatagaccaagcacctctacgcaaataaactagaaaatctagaagaaatggataaattcccggacacatacactctcccaagactaaaccaggaagaagttgaatctctgaatagaccaataacaggagctgaaattgtggcaataatcaatagcttaccaatcaaaaagagtccaggaccagatggattcacagccgaattctaccagaggtacaaggagaaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccacaatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacctttcatgctaaaaactctcaataaattaggtattgatgggacgtatttcaaaataataagagctatctatgacaaacccacagccaatatcatactgaatgggcaaacactggaagcattccctttgaaaactggcacaagacagggatgccctctctcaccactcctattcaacgtagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgcacaaaaatcacaagcattcttatacaccaacaacagacaaacagagagccaaatcatgagtgaactcccattcacaattgcttcaaagagaataaaatacctaggaatccaacttacaagggacgtgaaggacctcttcaaggagaactacaaaccactgctcaaggaaataaaagaggatacaaacaaatggaagaacattccatgctcatgggtaggaagaatcaatatcgtgaaaacggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaacaaaacagcatggtactggtaccaaaacagagatatagaccaatggaacagaacagagccctcagaaataacgctgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatttctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaactactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagatatcatctcacactagttagaatggcaatcattaaaaagtcaggaaacaggtgctggagaggatgtggagaaataggaacacttttacactgtcggtgggactgtaaactagttcaaccattgtggaagtcagtgtggctattcctcagggatctagaactggaaataccatttgacccagccatcccattactgagtatatacccaaaggactagaaatcatgctgctataaagacacatgcacgcatatgtttattgcggcattattcacaaagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccacatattctcactcataggtgggaactgaacaatgagatcacatggacacaggaaggggaatatcacactctggggactgttgtggggtggggggaagggggagggatagcatcgggagacatacctaatgctagatgacgagttagtgggtgcagcacaccagcatggcacatgtatgcatatgtaactaacctgcacaatgtgcacatgtaccctaaaacttaaaggataataaaaatatatatatatatatatataaaaaaaaaaaaaagaatagaccaagaaccagccgggcacagtggcttatgcctgtaatcccagcactttgggaggccgaggcgggtggatcacttgaggtcaggagtttgagaccagcctggccaacatggtgaaaccctgtctctactaaaaataccaaaaaattagccaggcatggtggcgcatgcctgtagtcccagctactcggcaggctgaggcacgaaaatcatttgaacccaggagccggaggttacagtgagccaagatcgcaccactgcactccagcctgggagacagagtgagactccatctcaaaaaaaaaaaagaatagacaaagaaccaactcccagggcatgcaatacagtaagagctgcactatattatacacttattaaatggttataattggtatccttatgacctaaaactgtcactgaagtttcctttttaatctatgcttttctgtatatttgtttaattgtaatacaggaaagcaagacaaatagttgtaatgaacatacttactgacagatctgaaagttttgggtcggagaagacaaccacgaaaattcaaacgcagcacatttaaacgccacctttgcaaagtagacactatatatttatctggaatcacatttttcactgaggaaaaatcaatctaaaaagaataaacaaaatgcattaagaaatgagaaagtccccaaaaacaattgcaacaaaaacaataatagacaaatgtgacctaattaaactaaagagcttctgtacagcaaaagaaactatcaatagagaagacagacaacctatagaatgagagagatatttgcaaactatgcatccaacaaaagcctaatatccagaatctataggaaacttaaatcaacaagcaaaaacaaccccataaaaataggcgaagaacatgaacagatacttctcaaaagaagaaatacaagtggccaagaaatagatgagaaaatgatccacatcattatcagataaatgcaaattgaaaccacaatgaggtcgggcacggtggctcatgcctgtaatcccagcaccttgggaggccaaagcgggcggatcacttgaggctgcgagttcaagaccagcctagccaacatggcaaaaccccgtctctactagaaatacaaaaattagccaggcgtggtgacacacgcctgtagacccagctacttgggaggctgaggcatgagaattgcctgaacctgagaggtggaggttgcagtgagctgagattgtgccactgcactccagcctaggtgacagagcaaaactccaactcaaaaaaaaaataaataaatagatagagctaaggaaatttgggggcaaaaggtactccataactccacacaattttgtgactatatatatatatatttttttttttttttccagactgagtctctctctgttgtccaggctgcagtgcagtggcacgatcttggctcactgcaacctctgcctcctgggttcaagtgattctcctgcctcagcctcccaagtagctggaattataggcacctgccaccatgcccggctaatttttgtatttttagtagagacgaggtttcaccattttggccaggctggtctcaaactcctgacctcaaatgatccacctgcttcagcttcccaaagtgctgggattacaggcatgagccaccatgcctggccacttttgtgattataaatgtaatccaacctttgccttaacaattctacttctaagaatttattctgccgatgtaatcatacatgtatacaatgcaacactgagaaacaggatattcaccacaggattttattaacgaaagataggaaacaacctaaatgtctttcgataggagacagattaaataaattgagtgacttccatacaacagaccactggacaaaagctgaattcagggcaaaaaagcacaactcagaaagagaaaatctaaagcaatagagtccaagtatgctgctctctgattggctgattcaattcagggacaaaatgcacagtatctagaggacttactggacccgaacccttcatgaacattactcgttaatgccaagcattttatgagagttgggactcagggctcaaagttatatcattgtaaaagaaccttaagaggagaaattctatgctgctagttaggggaaaggcaaatggcagacctggcattctcttataaatagttgataattaagagcacacactttgtagtctgacaaatcagaatttgaatcccatcctagccatttaaccatgttggctatgacttaactaaggcttagttttttttcatctgtaaaatgggaaaaataacagtgcctaactcaggaggctgcagagacaaactgagaaaatgcaaataaagtacttagtgtagcatctggcatataagaaagcattcaataaatattagctactattattacttcaaaaatacatgacaaagcacacaaaatatggagtacataaattttaaaaagcatggaataggactaaaatacacaacacataagtcatatttgacagtgtgtctgcatgcatgcagaaacacatacactctggcaatttctaatatgaaatcctaggctggcgcttatgtactatttttgccacagtactattttttaacctgaaacatgtttgtgtttctcattccaaagagacattggggagaggactcagccaacaataaaaaataagcaaataagcatacgtcccccaacaacttctcttatctgtttcttgtaagatactttaatatcaacaaacgtggtcatttatgccatcaaccaatgttcagtggcaacattttccgtgttgtctaaagtccagtcaatagctgacttcacgacccctccttattgctaatgattgaaggactgatgatatcacgtgctcagactgacctatgaatagggggactggtgccattttgtagaagctctaaaacttaactcaaagaaattaaaaggagttgagaaggtttcaggggctctagcttcataagttaactcaacatctttacgtcgcatctggacaacatcccattcttggttgcactactctcactctgtgcaacaatggcaagaagagaactgatttcatcttaccaaacctatcttagctaacaaattaggtgttcctgtcttaattttatttttggtttaatgcagtgattctcgaactttagcctgcatcagaatcatctaggtgggttgttaaaacagattactgtttactaccctaagagtttctgactcagtaggtctgggatggggcctaagaatttgcatttccaacaaggtattgggtgatgctgatactactggttccaggaccacactttgagaaccactggcttaaagtaataaatctctaaattatgttacagatatttggggatgttgctttttcctttggaaaacctacaaagaagaaaaaaatgaatccaaatggtctggaggagaaagaatatatacaatatttagataatgaaatgtcttgcagaagctggcaggagttagaaaaagccaacacgtctgcccagagatctcactagataaagaccaagagcattacaagcacatggcagtgaggaacgaagccagggtaggaagttacactgctttatgttcagcaaatttctctttccacaattgtatgttgctccatcctcctatttctgcttttgtgagtgttcacatgtggcacaattataatcagcatttttagcacaaacaataactttattcagaaggcaatgagaaattgcctgttcacaggaaattgcatgttcacaaatgtaaacttttagctgacagtattagcaatattatttatcaatcagccctggccactccaaaaacctctgctcttgtcaattttgcataccatcacccaggtacactaaggtcatccttgtaatcctgttttggtttttttgttttttttttgagatggagtctcactctgtcaccaagctggagtgcggtggtgtgatcttggctcattgcaacctccacctcccgggttcaagcgattctcctgcctcagcctcccgagtagctgggactacaggcgcacgctaccatgcccagctaacttttgtatttttagtagagatggcgttggccaggatggtcttgatctcttgatcttgtgatctgcctgcctcggcctcccagagtgcttggattataggcgtgagctactgcacccagccaatcctctctttcttttttttttttttttgaatgatacagagtcttgctctgttgcctaggctggagtgcagtggcacggtctcagctcactgcaacctccacctcccaggctcaagcaattctcctgactcagcctcctgagtaactgggattacaggcacctgccaccatgcctagctaatttttgtatttttagtagagacagggtttcaccatgttggccaggctgttctcaaactcctgacctcaggtgatctgcccaccttgaccttccaaagtgctgggattacaggcatgagccactgtgcccagcataatcctctctttttagtggaattaactcttccaaaaattatgagttatgaaaaggccattgcacacctcacaccctaaacatctttcccatggtcatggacttaacatatagtctatgctcatgaaaaggaagtagggacactgtaataaaaccagaatggagtacaaactatccaataaaatggagctttgtttcaatccaaaaatgatattcatttatatctaccatttacatttaaaaatactaatgatgtatctcttaaaatagcattattatcttttttatctcttcccccaggcttgtgcctggacaaaagaaaaccaaattcacttgctgctggtgaccacagagcatggaagaaggtgtccccacaacagctggcttcacagcagtccattctcctttaagaactagtgtaaagacatagttcagttagtatctacttacagcattccacagtgagtttagttgtgtcatcaacatccaggcatgattaacttgaccacatattatcacatcttttaaactgaggtagaagaaaatctaaacacaaagaaaaatacacaactttgaaaaatgtgaactttgatgtaacttgtccacttaccttttgtctgtgtgtgtgcacacatgtgcgtgcacacacacacgcattagtaataataaggtaatccatactttgcaaatagcaagagtttaagtgctagaattttatctgaagataggagttttatctaaagtactggaacttacctgctgactccttttatataatgtaatccttttaattgatagtggcagaaggatggtgagaaagataagcatatttgctttattttttgaatgaagatagaattctgctagaaaactaatgatttccataaatagtcattggtacatagaaggcaatcaatactgtctgctgaactaaactacattccttctaaagatataggattcctcagagaagaaaaaaaaggatttctgggaaagagcaataaacacattttggcttctacttctggaaatgtggtagaccaaaaaatcaggaaatcctgctggtacaaaacatcagtaaatgctaaaagaaacattttttaaaaacataattcagttgtcaagaaagtaaaacaaatatgcaaggacccaatccttataaacccagactgataataaggtgcttcatgctatagttgcttgggagggaggaacaataaagatggttgctgcttttcataataaaatgggttcagattttactggccatgcagagacataagaaagtcaccaggcctgtacaaagctggtacagtcatgctctgcataatgatatttcagtcaatgatgggatgcatgtatgacagcagtcccataagattataatggagctgaaaaatttctattgtctagtgacatcatagccattgtaatatcatagcacaagtacttaatttttaaataaatttagtgtaacctaagtgtacactgtttatagtgtagtactctatctgtagttgtgtacagtaatatcctaggccttcacattcactcaacactcactcactgactcattcagagcaacttctagtcctccattgataagtgccctatataggtgtgccaattttaatttttttaccatatttttactgtacattttctatgtttaaatatatacttatcattgtgctacaattacctacaatatttagtacagtaacatgctgtacaggcctgtagtctaggagtaataggctataccatacaacccaagtgtgtactggattataccatctaggtttgtgtagcactctatgatgttcacacaatgacaaaaatcacctaatgacacacttctcaaaaggtatccccatcattaagcaatgcgtgactgtaattgaaactgagtcagaaaaaaaaaagaaaagagagagagagagaaatccaggattatgaaacagaaagaaatcacgcctgtaatcccagcactttggaaggtcgaggcaggtggattgcttgaggtcaggagttcaagaccagcctggccaacatggtgaaaccctgtctctactaaaaatacaaaaattattgcacacgtctgtaatcccagctactcgggaggctgaggcaggagaactgcttgaacccaggaggtggaggttgcagtgagctgagattggaccactgcactccagcctgggcaatagagcaagactctgtccaaaaaggggaagggaaaggaaagggaggagaggggaggggaggggaggggaggggagggaaaagaaaagaaaagaaaaggaaagaaaagaaaaaagaaaagaaaagaaaagaaatcaaccatactggcaaaagaaaaactaaggtatctagcctggtatcaaaaagatctctcgccaggcacagtggctcacacctataattccagcactttaggaggctgaggtgggaggcttgcttgagcccaggagttcaagactagcctgggcaacatagtgaaaccccatttcaactaaaaatttaaaaattagtcatatatggtggtgcacacctatagtcctagctactctagaggctgagacgggagaattgtttgagcctgggaggctgcggctgcagtaagccatggtcatgcgactgcactccagcctgggcaacagagcaagactctgtctcaaaaaataaaataaaataaaatctctcaaagaatttgtaaccatattgaccatttttggtttgggttaaacagaaataataataaattcattttttttaaaaaaatgaatgaaaagaaaaaaagagtttgtaaccaaaggccagcgattatgtgtgttgggatttaaatttcatcatgcctgggatccaatttgaatttgttacctttgtaaatggatttgatatattaatgtgcaaagaggttccactggtaataactctgggacatttggcagaaataaatatcattctctctaaagagacagacacagtcaagccaggccttacaggatacccatggattaagccctccaaaaacaagctcccaatcaaaaactgcaaaacacacgaggaaaaggaagtccaacaagattcaaaagaaacctttaaagtgatgaagacataaaaagaaaaataaaactcttgagacaaatgttgtcaaaacaggactgggaagatctgtaaaagaaccaaataaaatcatgaaaattaaaaatatagttattgaaatttaaaactcagtgggtgagttaaatagcagatgcgactcagctaagaagagaatcaacaaatgaatatgtacctgaagaaattacacaggataaaatgtagagaaataaagagatgaaaaatataaaggatgctaagagacacattacataacatgaaaaggtccaacacacatctttacagaatttccaggagggaataaagagaataaaatcaaagcaaaatttaaaaataccacagactaaaatgttttagaactgatgaaaggcaacacttttcagattcaaaaagcacaggaagttccaagcaggaaaatgaaaatatatcaatggcattataagtgaaactgcaaaaggccaaagcacaggaaaatttttcaggcaatttgacacagattacgtacaaaagactgtcacgtagacagaacaacataaggtggaagtcagcagaaactatcaatctgagataccatatgcaagtaaattacaactcaaaaatgagtattaagacatttttggctgagtgcagtggctcacacctgtaatcccagcactttgggaggctgaggcaggcagatcacctaaggttgggcgttcgagaccagcctgaccaagatgaagaaaccccctctctactaaaaacacaaaattagccaggcgtggtggcacatgcctgtaatcccagctacttgggaggctgaggcaggagaatcgcttgaacccgggcggaggtggcggtgagccaagattgtgccattgcactccagcctaggcaataagagcgaaactccgtctcaaaaaaaaaaaaaaaaagacattttttgccaggcatggtagtacacctgtagtcccagctacttgagaggctgaggcaagattacctgagcccaagaattgaaggccagcctgggtaacatagcaagactctgtctctaaaaaatttaaggccaggcacagtggctcatgcccgtaatcccagcactttggaaagccaaggtgggcggatcacctgaggtcagaagttcgagaccagcctggccaacatggcaaaaccccatctctactaaaaatacaaaaattagctgggtgtggtggcatgcacctgtaatcccagctacttgggaggctaaggcaggaaaatcgcttgaaccagggaggcagaggttgcagtgagccaagattgtgccactgcattccagcctgggagacagagtgagagtccatctcaaaaaaaaaaaaaaaaatttaaagacactttgagacatagactgagagtttgcttccaatggacccttcacaaaggaacttctaaagaacactgaaatcagaagaaaggcatgaaatgcaaataataacaatgggcaaaaaatctaataagtatatgggtaaagccattaactttataaaacagtatcatgatgaaaacgtgggggtagaacaataagatggaacaaaaacactagataataataacactctaacaccagagagagtaatcaagagttagtgttctaaatttcaattattcttcaagaagaaagtataaatattaatttactttaggccttattaataaatgtacacattaaaaatatttgagtaaccagtaaaatagtagaaatagaatggttatcttctacaacatgttaaaaatatttaagagtaaccagtaaaatcatagaaatagaatgtatatcatctaaaacatgaaagtagaaaaaagggggtagatttaaatactcaataaatagtacactacttggtaatgggtgcgctaaaatctgacttcaccactataccattcatcaatgtaaccaaaaaccacatctatcccagaagctattgaaattactttaaacgtttttattttttaaaaattcaataaagtcaggaaaggggaaaaataaaacatataaaaagataataaataataaataaaaagataataaatagtataaaatgaaattagaaaaatgaacccaagtatatcaataatcataataaatttaacaaaatgtattggttagaagacaaaaattttttattcctaaaaatgctttttgctttaatgtttttcccccaatattaatgtagctatctattttcttttcttagttttatttttaattgacaaataataattaaaatgcatttatggttaaaatgtgatgttttgatttatgtttataatgtggaatgattaaatcaggttaataattaagaaatcaccacctcacataattatcatttttgtgtgtgaagaaaacatttaaaatctacactttcaggcacggaaagacaaattctccatgatttcacttctatgtgaaattttaaaatgttggacttacggaagtaacgagtaaaatgatggttatcagccttcctttcatttgtgttcattttgtttttgaaagattctccccaacgcccgaaagcttgaaggaatgagtaactcctctcttctcaggcccagtcccaaggcacaaggccacttgtaccagcagcgtgagtcagcaagatagcagaagcaggaagagagccggccagaagacacctaccctggccggaagacacgtacccctgaagatcgagaaacaggccatctgggtaccacatagcagttacatcagactgggacaattcctgtttacggaagactataaaaccctgccccctactcatttggtgctgacgccattttaggccttagcctgcctgcacccaggcgctcattaaaacagcaggttgctccacactgcctcgtgttgtctgttggcacactctcaagagtttgaacggatacaagaatctttcatctggtgccgaaacccgggaggggctccggtcttcgtcccccgtggacctacccctccgccccagaaagcaggccacagcagccggacaaaggaagctcctcagcctccagttgcttctctgtgcatgcacatcagtcactgatctcacctactggtaagtttcccgggagcccggttaacaaggaaaaatccatacagcctctcttggtttctccagtctgaaaatccaacattggtccaagaaggctccgacgtgtgccaggtacttgctgatcatctggtcttagggggacgcctctaagccatttgatcccgttccgggaacgaaaaaggcagcggtgacgatcgctcctttcatcgtctccctccaccatccaggatggtctcctttttccctgttttcccgagcctaccctcagttatgggaaactccccatcctcaattccaaaaaacagccctctaggctgcctcataaaaaacctgtaaacctggccaggtgcggtggctcatgcctgtaatcctagcactttgcgagggtgaggtgggcggatcaccaggtcaggaggtcaagactatcctggctaacacggtgaaaccctggctctactaaaaatacaaaaaattagccgggcatggtggcaggcacctgtagtcccagctactcaggaggctgaagcaggagaatggtgtgaacccgggaggcagagcttgcagtgagccaagatcacaccactgcactccagcctgggcgacagagtgagagtccgtaaaacaaacaaacaaacaaaaacctgcaaaccttaggcctcaggcaagatatccatcctccttgtctttttttgcaattcagactggccacaatacgaattgaataatgggtcctaatggcccgcaaatagaacattcgactttacaattttaactgatttaagcaattattgctgacgactggagaaatggggaaaaactccttatgtccagccctgtttgcactcagatcacaacccgacctctgtaattcttgctcacctgttcaaatcctcctctattctcgccacccagatcacctttctcctcccaactcgacatattttcctcgttagatccagcagactgctgtccattcctctcagcccctgcctctccctctcagccgtcttctttaaccccctaagcctcctctttatcttctcagctgcgatcttctcagccttcatcttcccagtcgccatcttcccagcccccatcttcccaagcagcagtatccacttcttttcctacactgtcctctcctcaggacaattctagcattgtctgtactcattactcattctccttcctcactgccctctcctgaagcctgtaaacccatcccaccaccttacgcccctatctatcctccactgcctatcaacttaaccctccttcccccttcaaaccctcagcaggaaccactttcaggttcttccttctctcccacccatactcgctcaggcaccatctttggcccatgccccacccttagttcagcccctgtgctagagagcccccttcagaaagtagcaggaactggaggcattgttaaagtttatgttcccctctccctcagtgatctctctcaaattaacaaaagactcagttcatttccagaagaccctacctcttacattagagagtttcagtacctcacccagtcttatgaactaacttggcatgacctctacattatcctctcttccaccctcaccccagaagactggggctgtatctggaccctaactcaggtacatgctgatacaattcatcaccaagctcctgctcagcctactggtgcaaaggcagtccccaaccaggacccccactgggattatcaagatggggcctctggacgctgctgtcgagaccacatgattgtgtgcctccttgcaggactcaaaaaggctgcccataaagtggtaaactatgaaaaactttcagaaatcacccaaggtcctaacgaaaacccagccctttttatctctcgtttaactgaagccatgagaaaatataccaacctagacctagccagtccagaaggaaccgatattttaaaccttcagttcatctcccaatccacccccaatattcagcgccagcttcaaaaacttgacaacagccctcaaaccccacaacgagactttcttaatttagccttcaaagtctttaacaatcgtgatgaggaaagtaaaaggcaaaaacaggcagggtttcaaatgcttgcctcctccatcaggggccctgcaggccatggggccacagctccacacagaagcctcctagcaatccacctccacctggtgcctgcttcaagtgcggcaatgaaggccactggcccacacaatgcccaaacccaggtaaacccacgaggccatgccccctctgcggaggaccccactggaagttggactgtgagcggcccctgcaaggaccacccccatcccttcctgagccaatcaaaccctcctactcggatctcgtcagccttgccgctgaagactgatagtgccttggaacagacaccccagcaactaccatcgcttcatctgagccaagggtaaccctgatggtggcaggtaggccagtatgtttttaaaattaataccagggcaacctattctgctttccctaatttttcaggacccacccagtcctcccaagtctctattgtggaaattgatgaacaagcctccaaaccctgagccccccgctccacttttctgctccctgcacaccttttccttcactcactctttcttagtcctgccctcatgcccaactccgctccaaggcatcctttcaaaactccacactgctctccacttccacgttccccataatacccaacgcatcaacccaaacccctctggggcttctttcttctattccaacctcccaccttaaaacatgcaacctttccttatcccccatctgtagttagcccccctgtttggggtaattccacaccctcagtcgcaaaacaccacactcccgtccgtccacattacccttaaagagcccacccagttcctatcacagaagcagtatcccatcccccaagcagctctcacaggcctaacgcctatcatttctcacctcctcgccagtcacctactccgcccaacatactccccttttaacacaccaattctacctgttaaaaaaccagatggaacttatcgcttagtccaggacctcaggcttattaaccaagctgtactcccagtatgtccagtagctcctaacccatatactttactttctgcagttccctccaataccacccatttttctgttctagacctaaaggatgcttttttcacaattccattacaccctgattcccaaaacctctttgcctttacatgggaaaaccccaacacccatggagtccctgtgtatgatcacttaaacagagaaaaacgatccttaaaggtaggaggaagccaaagacggcaagaggacgagtggcccctgcaatggatcatcgaatattatggtcctgccacttgggcggaggatggttcatggggttatcgcactcccatatatatgctaaatagaataattaaggctacaggctgttctagagataatcactaaccaaaccgcctccgtcctggaaatgctcgcacaacgacaaaaacaaatgtgcgtggcaatttatcaaaacaggctagcactagactacttattagcagaagagggtggagtctgtggtaactttaatgtctccaattgttgtcttaacatagacaataatggaaaagcagttctagaaatcgcttcaaacatcagaaaagtagcccatgtaccagtccaaacctggaaaggatgggacctggcaaaccttctaggaggatgtttctctaatttagaaggatttaaaatgctgataaggacagtaatcttcatcattgggctcctcctttttctcccgtgttatcccactgataataaaagccattaaaactcttgttgaagctacagttaactatgtttattgtggcactattcacaatagcaaagacttggaaccaacccaaatgtccaacaatgatagactggattaagaaaatgtggcacatatgcaccatggaatactatgcagccataaaaaatgatgagttcatgtcctttgtagggacatggatgaagctggaaaccatcattctcagcaaactatcgcaaggacaaaaaccaaacactgcatattctcactcataggtgggaattgaacaatgagaacacatggacacaggaaggggaacatcacacaccggggcctgttgtggggtggggggagaggggacggatagcattaggagatatacctaatgttaaatgacgaattaatgggtgcggcacaccaacatggcacatgtggcacatgtatacatatgtaactaacctgcacgttgtgcacatgtaccctaaaacttaaagtataataataaaagaaaaagaaactacaattaactgccagacaatccagacaatgctcctgctacaatgacaagatggatactaacctgtctctcaagaataccaaaaaaattaaggttttctttttccaaggtgcccacgccaccccctatgtcatgcctaaagtagttattgagaaagtcaccctttttcccttttttctataaccaaatagaaaggaatgaaggattctccccagggcctgaaagcttgaaggaatgaataactcctcccttctcaggcccagtcccaaggcgcaaggccacttgtgccagcagtgtgagtcagcaagatagcagaagcaggaagagagccggccagaagacacctactctgactgggagacacgtacccctgaagattgagaaagaggccatccaggtaccacatagcagttacatcagactgggacatttcctgtttacaggagactataaaacccctgccccctactcatttggtgctgacgccattttaggcctcagcctgcctgcacccaggtactcattaaaacagcgtgttgctccacactgcctcgtgttgtctgttggcacactctcggggtttgaactgatacaagaatccttcagttttgtattgtattttagttggatttttaaagtttatctcacaaagagggtgactacataataattaaaggtagcaattcactagagattatagcaatcctaactatgcaagcatctaataacaaagccacaaagtgacaaggagaatctgacaaatccacaatcataatgaaagataatatcaaaacgatctcaatacttgatagatcaatgcaaggaaataagtcttcgatttctcagtgctcctgtaaaaagcactagcctccagaggcatggaaatctacatgatataaagataggtaattttacccttcacttactttacaaacattttactttccacctactattgaaattagatctgtagttattcgtagacaaatagttatttgtctgacaaacagttaattgctctgatccaaaagaataataaaacttctcttacctccccaagaaagtcaaatggtcacagcctggattagtcaagattccaaggtgtcaggaagatccctaatttacatttcaagaagaaatgggtcccaggaccttggagacatgtctaggtcataaaagctggagatgctagggcttacctggcccttggagagatgcattctaagaagtcttgcctctctcttttacttataaatacctttgtgattttattagatccacccagataatccaggataatctccccatttcaaaattcttgatttaatcaaatctgagaagactcttttgtcacgtaaggtaacatactcacaggttctgaggactgggatatggacatctttgtagggggtggggtaatgttctacctaccatactatatgagggaataataaacactaaatttaagacagcaaatacctctgagggagaaaagagaatgcagtcatggaggctttaattgtatgttatgttttatttcttaaactgggtggtgagtgtacagttgctcattaaatttctttgcatgcctgaaatattttattgaataatctcactttttaataaaaatacttaggaataaatttaactaatttaactaaaaaggtgaaagactagcatactgaaaattacaaaacattgctgtaaaaaaatgtaaaaaggcctaaacaaatggaaagacatcccatgttcatggattggaagacataacaatgataacagaaattgaatcagaatttaaaatctgcctctgaataaacaccaaacaaacatgggccaagagttttataagaccattctatcaaatatccaaagaacagaccctacaaacaataaaaatactaagatgtcaatactatctaaagtgatctatagattcaatgtaatccctataaaaatttcaaaggctttttttgcaaaaatgaaaaatctgaccctcaaatttgcagtaagtgcaaggagtcacaagtagccaaaacaattttgaaaaagaacaaagttggaggactcacatttcctgatttgaaaacttactacaaagatatagtaatcaaaatatcaaggtacaggatagacatatagaccaatggaatagagctgagagaccagaaataaatccatacatcatggccaagtgattttcaacaagtgtggcaaaacattcaatggggggaaaaaagtcttttaaataaatgggactgggacaactgggtatccaaatgtaaaagaatgagtttggaccctctaccttacaccatatagcaaaatgaagtcaaaatgagataaatgacctaaatataagagctaaaaccagccgggtgcggtggcttacgcctgtaatcccagcactttgcgaggctgaggcaggcgaatcacgaggtcaggagattgagaccatcttggctaacatggtgaaaccccaggtctactaaaaatacaaagaattagccgggtgtggtggtgggcacctgcagtcccagctactcaggaggctgagtcaggagaatggtgtgaacctgggagccagagcttgcagtgagctgagatcgtgccactgcactccagcctgggcgacagagcgagactccatctcaaaaaaaaaaagagctaaaaccataaactcttatcaaaaaaatagggataaataaatcttcatgaccctgcgtttaacaaagaatatgacaccaaaagcatgagaaacaaaggaaaaaataaataagagttcatcaaaatgaaaaccttgtgtgtcaaagaacatgataaagaaagtaaagacttcactttttgcctgtatgtactgggagggcaagaaaaatgccagcaattaaatgagttgttgaaatggccaacaagccttggaaaggtattatgttggatcaggtggcctgaaagctgtacttgtagttttgtacctactgtacttgtaggatatttttgaagacagaggaactattgtaattagtcctatgttcagagaggtaaaagcaactagaaaagaaaagtggcagcacagaaaagtagtagaaatatagaatcaattttctgagcatacagagaaagaacaaatgacttgtttaaaagggtccattttaatgttcttcctttttatactggtaaatactttctagtccaagaaatctggctccgaatttcctaaaatttttacttatttgatctattcccctgtatgtacccatctcccattgcctgcacacctttcccccccttacccacctctttttctgacattgcacacaggccagtctctcatcccacagacttgttctcaaagaagacatactttctctagaagatagtatcctaaagagcattctcctattgtcttagtccatttgagctgctaaaactgagtactatagactgagtaacttataaacaagaggattttatttctcacagtgctagtggctggaggcctaagataaagtctccagcagattcagtgtctggtgagagcccacttcctggtttatacacagtcatttcactgtgtccacacatggcagtaggaccaaggagaatctgggatcccttttataagggcactaatcccattcatgagggctttgccctcatggcttaatcatttccaaagacgtcacctgcaaataccatcatattggggattaggttcaacgtctgagttttgcgggacataaacattcagtctatagcaactatgtttcccaaattccattaaaagccaaaatattattttgactatacaggtccaaatgggtctgtaatcccagcactctgtgaggctgaggggggcagatcacgaggtcaatgctgggttacagcccagcattcaaacactggatcccgggcacatatagatacactcttctttttcctccactgtggagtagcagtcccacttctccttgatagttagggtcaattactccacccaacacagtaattcccttcttcgcttgttgattcaggggcatgaggagttcatagtggttgggtggcagtcttaacttttagttcgatagaactatcattgtgcgtcctggtgtaaacattcctcctttttgaaccaaaacctctaggttagcagcataagcttatggaaacagaaagcaaaatttttgctagtaggttactaggggtaatagtgagtgtgccactcccatttccaacccttgattcctggacccaagaatcttgactatggaaggaagagtatcatatattggactgtgattcagagtatatacagattcctagagaactttgccccagccttgcaaggtactctcccatcgttggcactggaattgagtcttccaaaggccacttcaccattctgtcaaaccagctacttcagagtagtggtaaaaactacagtgtaactgtgttcactgtaaaaaccagtgaattccaggagcatggacccattgaggcatttcttttgctgtgaagttttataaatggaagttcctctgcacaagctctcttgcctgccaccatgtaagatgtccctttgctattctttcatttgcaaccatgattgtgaggcctccccagccatgtgtaactgtgagtccattaaacttctttcctttataaattacccacccagtcttgggtatgtctttattagcagcatgagaacagactaatacaagctttagagccctttctaactccttgtgccaaaatataaatgcagaatctctatttagagaactcatgtgaataaactcagcgtcttccaactttatcttctttctaccattatcccataccctcattatccatttccacatatttttcagatttcagtctgtataagttagaaaactcaagtagttttttttggagtgtagtgcactttctcatgggtcacattttgtcccacaccttcaaaggcctgctgggacttgagtctaattatgagactagaagcaaagaggggtggtaggggtgagttctaagaaaaatcaatattgtcttgcttggcaactgcctcagtggaggccattacaatttcctcatgcagtgtagcattaaccaccttctgaggtggagaagccactagcactgggagtgcggaggccacttccactagcagtaggattgcctcttccactagcaaagaagactcaccagaagttagaggctcaatgtcctcagtttcatcaaggtcttcccacaagtccccattccaacttatagaaacccattctggttttcttttttccccttttttttttttttttgagtggggtctcgttctgtcacccaggctggagtgcagtggtgtgatatcagctcacagaaaaccccacttcccaggttcaagcaattctcttgcctcagcctctggagtagctggttttataagtgcctaccacaatgcccagttaatttttgtatttttagtagagacggggtttcaccatgtcggccggggctggtcttaaactcctgacctcaagtgatctgcctgctttggcctcccaaagtgctaggattacaggcatgagccaccgcacccagcaagaaacccattctttcccagtcaacgccttcactttaacagagtataaaagtgggtcaccggatgagataagataactgtaaaactgggtcacaggatgagattctgcatttgattttcaggaatctcagccctgtggctaaaggagataagactctccctcagggcacatgtggaagctttcagtcatttatgcagtacttgagctggaaatttgaattcctgagctccttcttttctttcaatactttgttcgtgacattaggagcaacaagccaacctaattatattcatgtgatttccagaaatgtttgagagtatcatatgcacaatgatcagctccttgcttcttataagtggttgattgggaacatccaatggagatatttggcatatctctattgccagataacaccgtgaaacatcagtgctctttttagcactgaaaaaagagtcatttgcatctttaaatctgatcacattaaaaagccaattctaggaacctaaaaaccaattctaaaaactcatccttaaaattctgttcctatagaaccacccttggtaccaaaatctgtattagtctgggttctccagagaaaaagaaccaagaagatatatataactatctacctatctatttatctacctatctatccatccatccatccattagatatatattgagagagaaagataattacttaaaggaattggcttatgcaataatgaaggccaagaagtccaagaccttctgttggcaaactggagaccccagagagctggtggtatagttccagtacaaatctgagtccaaaggcaagagaagattgatgtcccagatcaaaggcagttcattcattcttggggcttatatgatgttttatttattataactacttaattgatatttttttaatgccgtactttcaataagaagggaaagaagataacaattgtatggagatagaaaggagatttatatttgttgtgcacttctgtgtgctaggaattttattttaattattagaagaaccctgctatgtgccaattattatcttaaagatgcgggaatctaactgcataccattttctagttctatctgggttagggttgctgccttaaataaaggatgcccaattaaatttgtatttctgataaagaacaaataaattttttgtattattatatgccacatattgcacaggacatacttacaccaaaaaataacaactttatcttaaattcaaatttaactgggcatcctttatttttatttgctagttctggcaaccctacccttgattggggtcctgcattgcttgtgctggtctctctctcctttatccctgaagacagaccttcattcctgacacctgatcacccagtctctgatcacctgcctgtcactaagatcaccatgtgttgatggcttcatacccacaccactgtgttgtacctatctgcaggattcccaccagtttagaattctttcatgctcaccacctggccagcatgcatctggtggaacccctggactacagtcaaattctctgtagaccatgtcctagcacatccagctatgtgacagtctgcacttcacactatccagaacccacaccaccctggtggctatgctcctgagtgagcttccaaccagcaaacaaaccattccacattccacacaataaaagatattgtgggaaggtacaaactgtggatagataactaaccaacaacccacagaggcatgttacaactcaggggcagcaggaagatccccagaaagggggagtagatgggatttgtgttcaatactttttttctacatagataaggctatattcatgtttatgaaatcagtgaattccatagagctggaagacatagctgactcactgaatattggaatcagaaccaaaatcaacaagatgaaattgaacaggaataacagaaactgttatgctaaggttgagattagcagtgacataaggcagaacatccagtcagcagttcacataaagacctcagagttttggttcaacacaagctcaaggatgggcattatcatgtaatgggggaaaaacaacatttagattcaaacaaacccaatctcaaatgctaatttcaccactacattgctatgacccaagtctttgtctcataaaatgggcatactcactcataaaatgggtgagtatgaacaagataacacatgttgagcatgtgtgaacagtgcctagaatgcatgggagatactcagtaatccacaccccacatccctggaacctggcacgatgccccccccccatcaatacatttagtaggagacatcatagcactttccaaataatctattgaaacattcatttttgcctgtcctctttatttaggatgccagaagaaatgggaagacattaaggtttatgtgctaatatttgagtcctttcatggcatttacatggcagagccaaaagcagaagttgacaaccatcagaagccaaaccagccccacaaaatacctagccttcaagagagaaattggaccaatctatgaaaaatgttgctggtgtgtggggatggggaggttggaaagttgctgagacttcgggaaggaatggaggctcatgacagatatttgtgccacattcccatgtagaccttcctaaaatgtggcaggccctctaatgggcaccatcagaaagccatggcaactgacgatcaaaagatctgccttgaggccatggtccctgtgcccaagctgggctcagaaatcatggagtctcccgccttcaagggactgtgtcgatttaggcagtgagcacagccacagccgcccgtgtggatgtggactgaagtccagttctcttcatgggtgcttggctgtgagacacctctaagactcttgcacaaccaagcagcaggggaagaaggatattagaattgaatgtgatgattgagatttaatttactggttaaatgggtggggacatgcagcagatgggccgattgtaaaggaataaatataacatttattttcatccaagtactagggagtattttttttgtatgctttgtcagagatcagttggttgtaactatttagcttcatttctgtttatcacaccataattcacaattgcaaagatatggaccaaactaagtgcccatcaattaatgagtagataaagaaaatgtgatacacacacacacacacacacacatatacacatacatacacacaccatagaatactaagccataaaaaaaaaatgtattttgcagcaatttggatggaactggaggccattattctaagtgaaataactcaggaagggaaaaccaaatactgtatgttctcacttgtaagtgggagctaagctatgggtattcaaaggtatacagagtggtataatagacactggagactctgaaagggagagggcgagagaggagtgaggaataaaaaaatagtatactatgtacactattcaggtgacaggtaccctaaaatttcagatttcaccagtatataattcatccatataaccagaaaccacttgtacacctaaagttattgaaatttaaaaattgtaaataaaaatcccacatatattagggagtataattcacactctctatgaagtaaaaagggcttatacagtaggccaaactcaaccctaccactgtgatttaacctaattccccaagcatcatttatttcattagcaaaacagaaaaaaaaaacatacctcacaaagatatggggaggattacatgagataactaatagcaaaaatccaagcacagttcttagggtagtgtggatgcattttatacgaatttgaatttggtggatttaaaatagtgaaataaaaacataagcctcactatatggcaaaacttgaaataatgtgaaatcccactttatatttattcctaaatgaaaacgcatcttgagtgggtatcatacactaatcactaatgggacgtggagaattttttttaaaaggagaagtccaggatgattcccacaattctaatttggatgacaagtgatgacaccatttaccaagaaagcccaggaatacagaggggtggggagtagtcccataagagaggtggggaagtaacggcttcaagctgaacacgctagggggtagatgctatgaaatattccagtggagttacccagcaggcattgttaaatgacctgggtcttacaagagagtgatggctggagatacacagatttggcaatcgtgagtaaacagcatataactataacctaaagcatgtatttgaaatcacccagggagtgaagatggaatgagaagaacagagaaacaatgacagagtccttacaaacaccatgatacaagaaggcaatggggatatgttatcctaaaggaatcctaaaagaagtgatcaaaaaggtgaacagaaaaccaagtgggagtactgtcactgaggatgagtttccagagagaattaatgctgaagaagctattgcaggtcagtggtcagtctagctagcactgcttcaatgaagggtaaagatatgctcaggaatgtccactttaaggggcggggatgatacttgcactggatgctgcactaatcagataacacttggaatatttttttccacctccagacactgctgagtatgaagaactaattggagaaggaagccgttgtatagcagatgcagagcagcagcaaaaatggtaatgaaaatagaagataaattagaaaatttggaaaaacccaaacagatcagccatattgaagggaaaaagaaaaacaaaacaaagtgggagggcagaaatgtagaacggtatacactcttttaaccccaaggatgaatgtagccaagaacacagtggggacttaggagtctcagcacagagcattctctactccctactgctcaggcaaagaactccttcatcatgcagaaccaaaactggtgtagagtcttaaatgacctgggtatctctacgcagaagaaagcgctttccatgtaaaaggattaacttgaacctgggtgctcaagggacaccctaggctgcttatcccactgattctgatctgactgtgttaagtaataaatcatgtggttacatattcacattatcttgtgtagttttctctcacattgctacttaaagagaaaccccagacacaataatgagggagctcagtataagggtatgaagagatccaggcaagctataacctggagagctccttgcccttcagaaggtgagaccactcagaatgagggagaaaacgtggcccagcccactttatgaggaagctacaaacagaattcttagaagacagcagccaagggagtagcagggatggggacagggagggctgagactagaaactcacagaggaacaaacaattgagtaaactggaaacaagtaaccacaaaagcactagaaaataaaatgaaagctttgcatgaataattgacaaatttgatcttccttgtgaatgcagaagaaggaactagaaacaaaagataatgaggccgctttctctgctttgatctgaaggacaactttctaattatctgatctttcccaagacagaacagaatgcatcgcaaagtcaacagactctccagcacagaaagtactagaccaaatgctggataaacattactgctaatggagacgtttcattgccttggcctcacatctctatctagaaacactttagaaacactctgggcctctctctctctacccctcatatcttcccaggagaagaggaggagtgtttgggagaaagaactaggcttgcaattcagctcctgctccaccctgccttgacctgaatgcaagatgcatgcatcctggtctgctctcagcagcatagggaggcctgcagttgttcagctgtgcagtgaccgaggggcgagtctatctgattcagggatgaaagaatgaagtagtatcctttgtcagtgatcttaagtcatagtctcctatcagctgtatcagaaaatatgtccacttccatctctctatttctcaattggttccaaactcagatacggaagagggtgccctctaaaacctcaagaacatctgtgaggaatattttcctgtaaaagaggttggatcacataactctaaaattgctgtatatgtagaattcagtgactcttacttttcagatacttctaggaccttctaacttaatgtctcattgacatttcaaattcactgaatccaaaattaagtttctctttccccaaaaccagttgactctcccgacattactgcacatcataagtagcactggcttcacattcatcaagatttaaaaggttaaagtttccaaataataggtaaattggaaatgtccttatcatgattccaaagcaatgccgacaccagagagtggtgggtgaaagcctagctgtgactgccatgacctagtaagaatgtagggcaaagagagagagccaaagccaacatctggaggtacagtcagaccagagccaacatctgggtgtgaggagagagcaagaaacctatcctgaggatagagaaataattcccagagaaaagaaacaggaaatgtcatgccacagaagcccagaatcaagtgctactgaaaaagcaagacaagaagggatcataggcaatcagatttgatgattaagaaattcctgggaccttgatgagaccaagtttgtaatagtggagctgaaaagaaaacatcatttttcattcgatcattcaaccaatatttattgggcatctacagattgtgaattcaaagcaggtaagacactgtccctgtcctcaaggcacatatagtccaagaagaaaacacaaaataggccattataagagagtaaaaagtatctcaagagggactctgggaacagagaggaagggtaactaaccaagactgagagagaggacagaggatcaaaggtagcctttctggaagagatgacatctgagctgagcctaagcaggactgagtagggcaaggaagaagaggagagagcctacaaagagagcacgtgatgggtgaaggcatatggccagagagggtgccttgaacttgggtaacatggagtaactccacatggctacagccaagggctcgtctggagcaatgatggagaatgcagctgagaggtagtggaggctagaactggaaatcctcatgcagcatgttaaagccaacagagttcaggagagattttaaccaggaagtgacatgaataaatgtgatctgagaaagacaactctggtggacaaatgaaaaataagtcaggtggtcaaagtcaacagtcaagagtagatgccagaagacaaattcagtagctttgaatttgatagtaatgtcactaatagacaatgagtgccagagagaatggagagaagaaagaaagtgaaattacatgctaaaaagaaaaaaatatgcagtagggggtaaaagagagaagtcaaagatatttccaaattctggccaagtcagctgagtagatgatagtgccattcattgagaaacaggatacaagagacagggttggacaggatatgggggaaaaggaaggttggaggaagaaaatgatgagttctgttttggtaatgatgaattggcttgtgcctttggaacacccaggtagagactgtttaaagcagtttttgagtgtcacagtgggcaggtgggaggtagtgtcaagaagtctgccaacacataacaggagaaaaatagaatacttagcagcattgagaaatgatttataggaaaggagtgagtcaaacacatttttagacatgaaggaataaatcaatagaaagaaagaaatttaagatcataggaccagggaaggcatgggaaagagcaagttggcagttctctcctgtttaatgttaccttgtagtgcaataaaaggagggctgtctttggaacataaaacacggactcttgagttaattgataaattgcttcaatgcaaatcacaagccacctgaaacagatggtaaactgctaaaataaattaggttccaccaaccattccaatggaacattgtatgatatggaaagaaaaatacttaacaagacaggaagcatgagtcaggaataagtggtgcgcagtgtgagtcatgcctgtaagatcaataaagaagctggctctgctcctgactgcattacttctgagcctcctacccctccagtcacccagtctcaatgctgccctatcaccctcctcactcattctttcactccagatactatgggtcccagaattctgttaatgctttggttctcacatgggtccttttttttaatttcccactgatactatcctaatgctcttagagaaatctgtctacctccagacttcatccaacccccttgacccacccaaggcagggggagggtgagggaagaacagtgaagggagaaaaagaacagctttataagtctgccatcatgttactggcttgcagtggtccctcactgcctactggttaaaacccatctcctaagtggatactcaaggcctcaacaacgcagacccaacccacctttccaaacacatcttgttactgtcaacttaaattctctatcatctcctttttacaaatgagacaatttagaaacagaaacattaagcagcatgcccagccacagctgtcacacagctagtgacagaagcggccacccagactccagggcacattctccccatttccatgtggctgcctcttactggggtatagttttttgtctttcatatgctagatcattttgcaagggtggtcctgctaaaattaatagaactgcttctgcaatttaaaagtcatgaaaactttagatcaaaatcacttgtaaactttttccctttttgggagggggatggggtctcactctgtcacccaggctggagtacagtggcacagtcacagctcactgcagcctcaacctctccagacttaagcaatcctcccacctcagcccatcgagtagctgggactacaagacatacgccagcacatctggctaatttttgtatttttcatagagacacagttttgccatgttgctcaggtttctctggaacttctggaccccagcgatccacctgcctgtgcctccaaaagtgctgggattacaggcatgagccaccacgcccagcctgtaaacactttaacagagacagcgattaagactaaagtgatgaaagtgaggtctatgggtagagcaatgttccaccaaaaatcaactgttcccaaagtgacttctagatgttttgtttcatttgctttttcacccacaccacaacttgagccaatatccacatacttccttgatagagcaatgtggttgtggaacctttccttatctgaagttcacacagtacacagctatgaaacctggaaccactgtctgcattggtgaaatgaggtcagactgacccctgaggttatcaaaacatagatctgaaaagtcactgggaatattcttttgttttacaagtaattctaagtaatttaatcaaacaggcctgaaccatctggctcttttacaacatggtactagttttaatagctatccatgtttcttttcttccccaagtgagaaaatgagtcatcaacacagtaaaatctgaaggtgattttataaccgtttgcaagtccacatgacatatatcttttacaaacaagaagtcatagttgtttaaaatgaagacaaccctaaagcaacacttacattattaaactaatcaagtaattttacattttaagaaactgcattacttaactattttagagtttccaaattcatcagcataaggcttttctctgtgttgcttgccaaactacacagaaggaaaaaaaaaaaccaaacttgtattttcacggaaaacagtctttgccaaccctcccactagctctaagtttggccaacagtttgactgatagtgtatgagccctaccatctgctaactaagcagcatttcctaacgggtaaatgatactaagaaaaatggttgcaaaacagaacctgacttgttttcatgagttgatgtaactgaacctaaaatgcaagactacagtttgttatgtgtattctaagaaagttcaaattgtatcccaatccaaattgctggtttcaattattccttcaaaacattaaacagcctgtatataaaaaacctcaatttatttaaaaaactaacacttctaaccattttaaataaggttcagaccaaattcacatcacatttttgttttcacacctttccttctcaagtccctgagttagtgaaccagattaaatgccatttaaaaagtatgatttaaaaaattaactttgcaaatctattatacattaataagcataacaaacccaaccattcaagatattagtcttagaataattaacttatatgtttatatgctattatataaatctactcttattacttgtgcatttttaatgaacattctgcacattatttggggaaattttgaggatatctataaaaataatactggcttttttttctgtcatatcaagatttagtaactttaaaaaagttacccttgtttttttaaggacaggacaactaaacagatgtataatattcttaattattgctttttgtctcatgaaatattaatatatattctatttctttagaattctccaagaggaaaaaaaaaagatatagaggctataagcttagccaaggacacagaaaaaccaggtcctgccctcagttttgtagttgtctgactttggggatgtgaaaaaagttatctgaaaaggaatttcgagaagagagactttattccagtgaacagtttccaaacggggaagacaaacccttcagtggaaacaaaagatacattaaagaaaaaaggagggtttcgcttttatagttaaaattcccacccagctttccactcaggtcctcttatgcaaatacagaattcaaactggcttagttctgattggttgacacttgcagagttctgattggtcaatgctgctggcttctgattggtcagtgcaggctacactctattggttggttcaggccacgtggacagaaactgttagctatgacaaccccaaagttaagcagatgtgtaggttttctgggaactcagagtatgtgtgtgagctctagtcagcaaatggccacctgactctattttaaatttcagcccagttaggtactcaaaactcatcttgagagattggctctttcagattcgcacataaaatttctcagatccacagctgtccctcttgtaaaaggtaaaagcttagcacaaacatctctaagctgtcttctagcttgatcatgctatggtttgagcactctggtagactttataaatctgggccccaaagggctctactttatttcccatgagcatgggggaagctggggtgagagaaggcattaaaagcatagtcagccaggcacggtggcccacgcctgtaatcccagcactttgggaggccaaggcgggcagatcacgaggtcaggagatcgagaccattatggctaacatggtgaaaccccatctctactaaaaatacaaaaaattagctgggcgtggtggtgggtgcctgtagtcccaactactcgggaggctgaggcaggagaatggcgtgaactcgggaggcggagcttgcagtgagctgagatcgcaccactgcactccagcctggatgacagcgagactccatctcaaaaaaaaaaaaaaaaaaaaaaaaaataggccgggcacagtggctcacgcctgtaatcccagcactttgggaggcggaggcagacggatcacaaggtcaagaaattgagaccaacctggccaacatggtgaaacactgtctctactaagaatacaaaaattagccaggcgtggtggtgtgcacctgtagttccagctacttgggagtctgaggcaggagaatcgcttgatcccgggacgtggaggttgcagtgagctgagatggcgccactgcactccagcctggtgacagagcaagactctgtctaaataaataaataaataaataaataaataaataaaggcatagtcataaaccataacaccatacagaaagtaatctttaaaatgcaaaaactggcaatgatttctactgtcctgagcaacattccccaattattctacacatttcccatattctgaaatggttttcccaaagtgaacctaaaacttagattattccaaactctttgctattagtttagggtttggtgggaaaatgggggtgaggtagttttaaagatcaaaggccaagagggctgaaattgctcaaggtcatattgctagtaaacagttgagactggatttaaacccagttctccctgagtcctgagcctggacttttaatcaatatattgtcaaactaaaagattgctgttgagaaaatatgtaagttcatagtttgtcataatggttgctgtttccatatacaagcttttctaggccctggatcccattatgaaatgatttgctagactgtgggtgctgtggttcttcagtagttggcttttttgttctctgaattgttcaccacaggggtctgggataggaaagagcattagaccagagttcatttgcagcactgatataatgacttattaaacacttgcttacttcttatctgctgtgattgttcctttgttgttgttttgcctttttactgcaacctaaacaacatcttttctggcaaggaaaaatgcccttttagatactgatgactggtagttcaaatccacattcagtgagacagactatactgattaactcactcaaactccacccaaagtcctctcctccccagcagtttaacaaggccttgtgacaaagttctaacctaaaacacatcaatgaaattcctgactgtgggaatttggggaaactttggatttcctcataaacaaatcaacaaacatcttgcctttaccactgtgctttttcccctctctggcctggtaaaagaacatgaggctggaggtggagtagacatattgcaatcataagacaagcaagaagatcctaaggactgtggactaacaagatagaaagacttcatttttattggtattgtggatgactggccttggactgcttttctctgcacattgtgtaatatgaaacaaatagcccttatttctttaagtcttaccattggttatattttattatattgatagttgaagacagtgctcactgatatatttgagaattactagaccgagagatccataaaaagaaagatgatgtgttcataaaaaacgtgaagccttaagattttccaaaaccttatccctttattcttctgttccaaccagcactagaatatttttatagttattgaaagcttgccatttatgtctattcatcaataactgcttagagattttactttcagacacaaaatgaatgaccgcggaaaacattcatgcttttattatagatctgcaccatctttcttaacattggattagaacaccatgaagtaatttctcttttaaaatggatacataatagttgtacatattttgagggtacacgtgatattttaatatatgcatacaatgtgtaatgatcaaatcagggtaactgggatattaatcacctccaacatttatctttttatgggaagactccagttcttctcttccagctattttaaaatatacaataaattattgttaactacagtcacccaactgtactatcaaacactaactcttattccttctatctaactgtatttttgttcccattaactaaccactctctatccccccatactccctacctttcccagactctggtaaccaccaatatatcctctacctccatgagatccacttttttagttcccacaatgagtgagaacatgtgatatttgtctttctgtgcctggcttatttcacttaacataatgaccttcagttccatccatattgctgcaaatgacagaatttccttcttttttatgcctaatcatattccattgggtacgtataccacattttctttatccattcatctgttgatgaacacttacagtgacagatactcttggtcattgtaaatagtgctgcaataaacatgggagtgagatatctttggtatgctgatttcctttcttttggatttatactcagcagtgagattgctggatcatatggcaattctattttcagttgttaggaacctccacattgtcttccatatcactgtactaatttacattcccaccaacagtgtatgaatgttcccctttctctgcatcctcataagcatgttattttttgtctttctgataaaggatgatatctcattgtgcttttggtacgcatttccctgatgattcgtgatgttgaacatgttttcatatactttttggccatttgaatgtcattttttgagaaatgtctattcagatcttttgcctatttcaaaatcaaattatttgttctttttatgttctctttgctattaagttccttatatatttgggttattaatcccttttcagatgggcagtttgcaaatattttctcctattctgttggtggcctcttcactttgttgactgttttctaatccatgagcatgggctatctttccattttttgtgtgttctcttcaacttctttcatcagtgtttcagtcttccttctagtgacctttcacttctttggttaaatttattcctagatattttatattttttgcaactattgtaaatgggattgctttcttgatttcttttcaaaattatttgctgttggcatatataaatgctaccgattttaatatgccgatttttttatcctgcaactttactgaatttgattatcagttctaacagttttttggtggagtctttacgtttttctaaatataatattaggttgggcgcagtggctcctgcctgtaatcccagcactttgggaggctgaggcaggaggattgtttgagcccaggaattcgagactagcctgggtgacatggcaaaactccatctctacaaataaaataataacaataataataataattaaaattaaaaatataatatcatgtcctctgtgaacaagaataatttgacttcctccttcccaatttggataccctttctttctttcacgtagttgctctggctaggacttccagtactatgttgaataaaagtggtgaaagtgggcatccttgccttattcctaatcttagaggaaaggctttcaatttttcttcattcagtacgacgttagttgtgggttcaccatatacagtctttattttttgaggtttgttccttctatacccaaattgttgagggttttttttttatcataaaagcatgttgaattttattaaatgctttttcagcatctattgaaatgttcatacggttgtctttgattttgttgatgagatgtattatgtttatttatttgtgtatgttgaaccatctttgcatccctgggatgaatcctacttgatcatggagaatgatctttttaccatgttgttgtattctgtttgctagtattttatcgaagatttttgcatctatattaatcagggatattagcctgtggttttcatgttgtccccttgtctggttttagtatcgggataatgctggcctcatagaacaagtttgaaaatattccctcctcttcaatttcttggaatagtttcaatagaattggtattaattattctttaaatatttggtagaagtcagcagtgaagccatcaggtctggctttcctttaatgggtcactttatattactgctttaatctcattacttgctatgggtgtatttgggttttctatttcttcatggttcaatcttgataggcttcatgtatctaggaatgtatccatttcttctatgttttccaatttgttggcatagatgttcacaatactctctaatgatccttggtatctctgtggtatcagttgcaatgtctcatgttttgtctctgattttatttgggtcttctttttttcttagtctaactaaagatttgcccattttatcttttcaaaaaaacaactttttattgtgttgatcatttgcattttttcagtcttaatttatttctgccctgatcttcattatttcctgtcttttactaatttggggtttggtttgttcttgattttccagtttcttgaggtggatcattaggttatttatttgaaatgtttctatttttttgatataggcatttattgctataaacttccctcttagctctgattttgctgtatcccatagattttggtatgttgttttggtgtgtttttattttcatttttttaacttaagatatttaaaaattttcatcttaatttcttcactgaccaattaattactcaggagtatgttggtcaatttccatgtgtttgtatagtttccaaagtcatgttcaggctgggcatggtggctcacacctgtaatccaatcccaacactttgaaaggccaaggcaggaggattgctaatacaggagttagagaccagtctggccaacagagcaagacccttactctattttttcaattaaaaaacaatgaatgaatttttaaaaaacaataaaaaaccaaagttgcttttgttgtttatttctagttttattccattgtgatcagaaaagatacttgatttaatgtcaagtttctgaatttgttgagacttggtttatgtcctaacatatggtctatcctggagaatgctttacatgctaaagaaaacattgtatattctgcagcagtgagatgaaatgttctgtaaatgtcagttaggtccattggtctagggcataatatcactccaatgttcctttgttgattttctgtcggcatgatttgtccattactcagagtggggtgttgaagtcccctactattattgtattgcaatctagctctccctttagatctattaatgtttgctttacatatctgaatgctccaatattggatgcacatatatttacaattgttatatcttcttactgagttgctcctatatcattatacagtgaccttctttgtctctttttacagtctttgacttgcatctattatatctgatataagcatagctactcctgctcttttttggtttccaattacgtgaaatattgttttgtcgttgctgttgtttttggacagggtctcactctgttacccaggctggagtgcagtggcacaatcatggctcactgaagcctcaacctcctgggatcaaccaatcctcccacctcagcctcctgagtagctgggactacaggcacatcccaccacacccagttctatatatatatttttttttgattttttttttgtagagacagggtttcaccatgttgcccaggctggtctcaaactcccaggttcaagtgatccacctgcctcagcatcccaaagtgctagggttactggcttgagccacaatgcctggcctggaatatcttttcctatcactttgccttcagtctatatgtgcctatatgtgaaataggtttcttgtaggcagtatatatctgggtctttaaaacaaaaatctattcagccactcattgtcttttaattggagaatttagtccatttatattaaatgttattattgataggtacgatggttaatattaggtgtcaacttgactggattgagggatgcctagacgactggtaaagtattgtttctaattgtgtttgtgagagtgttgccaggggagattgatatttgtttcagtggactgggtgaggaagactcaccctcaatgtgggtcacatcctattggctgccagcatagctagaacaaagcaggcagaaggaggtgggataaatttgtttgctgcatcttgtggttctctttcttcttccctgctggacacttgcttcctctcttcctgcccttggacatcagactccaggtactttggcctttggactccgggaatttcaccagtggcttcctgggggctcttgggcctttggccacagaatgagggctgtactgtcagcttccctagttctgaggcttttggacttggactgagacactattagcttctctctttccccagcttgcagatagcctattgtgggacttgtaatcatgagaaccagttctccctaataaactcccttttatatatccatatatcctattggttcggtcccactggagggccctaactaatacaataggtaaggactgactactgccattctgttacttgtcttctggttgttttgaaactcctctcctttcttccttttttactgtcttcctttgtgctttgtctgaatacttacttttctctggtggtaatgtttgaattcattgctctttattttgagtgtatctattacaggttttagttgtgtcattaccatgagaattacaaaaaaaatcttatagaaatggcaagtttttttaaacagattacaactgaattttgatcacaaagaaacaaagtaaaaaactttaaaactctacactttaactcaatctaccacttttttttgttgtctgaattcacataattttatattgtctatatcttaacaagttgctatagttattattttcaatagatttattttttaggcttcatactagagatgagttgattatacaccatgacacactattagaagattttgaatttgtctgaatacttacttttgccagtgagttctataccttcaactgttttctttttgcacattagtgtacttttctttcagattgaagaactccctttagcatttcttgttaagatgcctttggtgttgatgaattctttaagcttttgtttgcctgggaaagactatctctcctacatatttgaaagaaagctttgttgaatgtagtattctcatttagcagtttttctacttcagcaatttgaacatgttgtcccactccctcctggcctatacggtttccactgtttgctgtttccagacaaatcagacctcttttatggttatttccttcttttttcttgctgcttttagaatcctctttgaccctgacctttaagagtttattacatgtcttggggtagtcttaattgtgttgaatctatttggtgatctctgaccttcctgactcagatatttatatctttctctaggtttcaaaagttttctgttattatttctttaaataatctttctaaccattgctctttctcaactccctttgaatgccaaccactcttagatttgctctttagaggttattctctatatcttgtaggcattcttcattccttttctttctttaattctttcttttcctttgcatattttcacattgcctgtctttgaactcactgattcttttctctgcttgatccattctgctattgagagcctctaatgcattttttagctcagcaaatgcatttctcagttccaggatttctgtttaagtgtgtttgttgttgttgttgttgttttggggtttttttttttttttttttttttttttgagacagactctcactctcttgcccaggctggagtgcagtggtgtgatctcggctcactgcaacctccacctcctgggttcaagcaattctcctgcctcagcctcctgagtagctgggattacaggtgcacgccaccatactggctaatttttacatttttagtagagacagggtttcaccatgttggtcaggctggtctcaaactgctgacctcgtgatccacctgccttggcctcccaaagtgctgggattacaggtgtgagcccttgcacctggccatttttgtttgttttgagacagagtctcactctgtggcccagactggaatgcagtggcatgatctcggctcactgcaacctctgcctcctgggtccaagtgattcttgtacctcagcctcctaagtagctgggattacaggcgtgtgcaacacctggctaatttttttatttagtagagatggggttttaccatgttggccaggccagtctcaaacttctgacctaaggtaatccacccgccttgacctcctaaagtgctgggattacaggcctgagccaccatgcccatctcttctgtttgagtttttaaaacactaaaaagtttttaatctccttgttacatttctctgataaatttataaattgcttttgtgtgttatcttggagttcactgagttttcttagaactgttattttgaattctcagtgtgaaagctcacacattaccatcttattactatcaatcactagctccttgctttgtctgtttgggaagatcatgcttccctgtttgctgtttttatgaatgtatacctgtggctttgcactgaagaattagtaatttatttcagtcttgctgtctagcttgttctgctttttctaagatatggttgtttggaggttctttgcagtttgcctgctgagttccattaatgctggattgctacctccttttcagcactagtggtgctgtaagtccatccaggtttgcctcagttctcacaaacattcagagtgttgcccatcataggctggcggaggaggccccagagggaacagtccaactgtgtgagaagaacactggctagaggtttgtgcccagaggacccatggagtgtgcctcttacagcatggtgctgctgaacagacactctgatttagtgtctcctttggctaagataaagagaagaatttcaagggctggggttgctctttgtctctaactgctctcaggggtttttctccctacaggcactcactatgcttcttgttccttcacaagaacagttttcctgcaaagaaactcaagacagtggggaggctggctggctgcctcaatttcactttttccagtgtggaaattgagttgcagaggaattttctgcatggtccctggtaaatgagaggagtgcatcacagagcagtccatttctcttactgtctgctgagagtttttcatttctttgtacacccaggaatcaactcagcctcagacttgagttctgggatactgatggtgataatcctggtgctcattttcagagggggagagtgaaggccagactggttctactctgccagtttggagacgttactccttcaactaacttgttaatttcttaaatcttatgatatattcacttacttgataaatattttacatatgcctgtaaatcaaggaacatagtcctagacctccaggtatgactcagtataggtcaacaactgagtaccttggttaagaggcaacaaaaattatattgacaaataatcttgtatttaaagttaattatacagctttctgtcaactacacttcatttactcagaactgatattaataatggcccaaaagtagataatatcactacctatggcagaaattaaataaaagcatctgatgtaaatactgcacattatataggcaaaatttcttgagaacagaaaaggaagcaaaagtaggtacagaggaaggtacatttgaaaagagggtagggacatcagaaaaacaggattgaggaaggaggtaagaaagaaggctgaaggagttcctacctgatggcatatattttctcagtgaacaaggacggaaagtaaaggcaaagagcagtgaagaggaggatttagcatgatgaaaattaaagagttgttttagtctgcttaggctgccataaaaaaaaaataccatagactggattgcttaagcaacagaaacatatctcacagttctggaagctatgaagtccaaaataaagaaactggtcaattcctttcttgctgtgggccctcttcctgatttgcagaaagccaccttctcattgcatcctcatatggcagagagagagctctggtgtttctttctcttcttaaaagggcgccagttctactggattagagcctcacccttttgacctcatttaatttttcatcaactctccacaggccctatcttcaaatatagtacattgaggaccagggattcaacatgtgaattttgaggggacacaacattcagttcagaataagagtttagacagactctgtaagaaactgaaaaaaaaagaagagacccatagaaggacagtcagaaactattatggctaaagttggctaccatgcaagttcagaaaactataaacagtcacccacaaggtaactggtaccaggctatccttcccaatataaaatattaaaaatggaaaaaatatatgaaacaactgctttcagatgtggataacaaggcagcacagtattgtgatctccaaaagaagggaaaaaaatgacacaagatctatgatagcccaggtttactacttgggggcgtatattagctacttatgatagaagcggtgccagatagtctcactaagccaagaagacagatcttggagttcaagtttgttgaggctgctggaattttagggcagaaaagtgggagctacacagaataagagcttgagaaatacacatatggatcttcttgagtctttgaccgtattctaagctgtgtatgcacagagtgagacaccatgaagctgaacaaaaaatatctaccagggacaaaacatataccagggacctgtaagctgagtcactagtacagttcatacaggattgagaaatttataagttaaaacaaaccaaaatggagacgtgtcattgaatacttggggcattcaataaagacccagaaatgtcacatgatagaaacagagataaactaaccttagtgtgaaagttactctagattttcccttaaaatgcttaaatataaatggaaaagattaaacttatcttcaactaaattaattgactaccagaacaaaattcaactctcttcaaagaaagacaacatttagacactcaacaatataacctataagattatccaacatataataaaaaattactagatttgtaaagaagcaggaaaacgtgacaaataactaagagagaaaccaaaaatagaaacacacagagaaattgcaaggataacagaactagtaaacagattctttaaaatagctattataaaaatgttcaaggatacaaagaaaaaaatgaacttaaaagaagggaagtgggattttaaaaatgaaccaaaggaaacttctagagatcaatacaatatctgtaatttaaaagttcactggaagagcctaatagcaaatcagacacttgcatttaaaaaattactaaacttgaagaaatagcaataaccgctattcaaaatgaagcacagaaagaaaaacaaggctaagagaaaatgaacagaaactcaatgacctatgggacaatattaagttatctaagttatataatatttgtataactggagtcccaaaaagaggaaggagacagaaaaatagctgaggaaataatggctgaaaactttctaaatttgctaaaaatataaacccacagatccaagaagctcaatgaactccaaataggacaagcataaagaaaatcacataaaggcacatcataatcaaactgctgaaaagtcaatgataaagagagaaatcttaaaagcaagaagaaaaaaagacacactacttacaaaagcagaaaaaaaaaatttagcccctaactgatttaaagcaatgctagccagaggatgatggaattatatgttaaaatagagtgaataaacttaaaaaaacctgtcagcctagaattctataactacaggcaaaatgctttttcagaaaaataaaactgagaaaacttagcactaacagacttgtgcttcaagaaatgttaaagggggttctttatgttgaagaaaaatagctccagatgaaaactcagatctaaagaaaaagagcacaaaaaatgaacaatttgtggagaaatataaaacaagtttttctggggttttaatttctttaaaaaataattgaaccccttccgttacccttttcctttctccttcccatagagttcacattctacagtcattagattgggccaagcagagtagacatccatgccagatgaagggtatgggaggagctgaagtggcccagggcaggtatatcagaacaagtgtggaaaggatatccaatcagtgggccatcctggcacagggtttcgagctcaagaagggtgaggagagtgtctcccacgaggaatggcccagagtgaaatatcagagcccaagtgggaaaaggaaggcaatgaggaggcatggcttattgtagggtattggagcccaaggctggtgatagatggagcccaagaagaagtcaactgcccaaatccaagtcctgtaccactgagatgatgccatgagaccacgtctatggtctttctaacaaaaacgcctaacattagtctactcatgcagatattatacataaaacaagcccaaattgagagacattctacaataaaacatccctaatctttatgtcaaggttatgaaaattaaagaaagattgaggaactattccaaactggaggaggccaaggagacacgacaaccaattgcaacatatgaactggacagggtccttttgctagaacattttgggacaactgaagacacctgaattgggaggattttgatgatcaactgtaaaagcatgccctgtttataggaaatacatcaataatattcatggcatcatgctggcaacttactctcaaattattcaggaaaaaatattctttgtactgtgtttgcaactttcctataagtttgagattgctaaaaatgaaaaatgtatgctggataaaatataattgactttttttttcttttgtgagacagagactcactctgtcatccaggctagagtgcagtggtgcgatctcagctcactgcaatctccgcctccagggttcaagagattctcctgcctcagcctcccgagtagctgggactataggtgcacaccaacacacccggctaatttttgtatttttaggagagacagagtttcaccatgttgggcaggctggtctcaaactcctgacctcaggtgatctgcccacctcggcctcccaaagtgctgggattacaggcgtgagccaccgcgcccagcttataattgattatttaaagcaaaaataaattatattgtcgtttataaatctataaaagcaaaataaatgacaataatagcacaatacacaggagggagaaaataaaagcatactcttgttaggtcctttaatgtaaagtggcataacattatttgaagacagtccatggtatttaaaatgcatattttaaatcctagagcagtcactgataaacaaaggaacattagcagtcaaaggcataggagttcacaggaaaaaaaaagatagctgcatgagtgtaggaaggagtgtgatatggcttagaaaaataactaagaatgacatattaatatgacatttaaaaagacaaataggtgaggggccaagatggcgaattagaagcagctcatgtgcgccactctcaccgagagaaaacaaaagggctagtgaacactgaccctgcaggccaaccatctgagaaaccacattcaatccatcaaggcagcaggggaacacagattgcagagaggaatgaagctggggaccagcctgtctgggctcagcatggagccaggggaaccactacatgagaaagggggagtgggtgagagcccccagggggattcacactgttcacaaggacttgtgcaagactgggaatgggagaatccccctggtttcccccaacaccctgctatcacactttagactgaggcagaaagccagtcagacatttttgaggggcaactcctgagtgcaaggggacctctacaaggcttgggccctggagcagaccagcaccagcactatagccccagtagaggctgcagtagcagtatctggaagcagtaaaattgttccacccctccttgctggacagggctaggcaccagtttccagcccagcagtcctgcttcagcccttaatgagccagccagccagccactcaacccaactctgccacttgcagcccggtgggcaacacttgctagagcttgcaacccagtggtcccacttttgtgtgaactcagctggggagtgcagtctcctactgtcctaggaaacacctggacagtagacacctgcccccaccactggtagccaggctggcaatacctgctagagcttgcagcccagcagccccacttctgtgtgaactgagccagaaggcatagcttcctgttggcccaggaaacacctggatggcaggcagagcccatgaccccgcccaccccactactggtaaccgggtgccagagcttctagcccagtggccctgcttctgtatgaactcgaatggagggcatagcttcctgttgtcccgggaaatacctggatggcagagtgtgcaaccccacccacccccgccactggtaaacaggcagacaatgcctgctagagctttcagcccagtgttcccactcctatgtgaacttagctagagggcagagcttcctgttgtcccaggaaatacccagatggcagggtgagcgtccccagccaccaccaccaccagcagacaggtaagccatgcctgctacagcctacagaccagcagtcctacttctgcttgaatctgctgagaagtgcagactcctattgccctggaaacacctggatggcagggtgggcaactccacccacccttgcctctcatagccagatgggccacacccactagagcttccaacccagcagtaccacttctgcctgaattctacctcagtctatagtgcagtaggggggtttagggggaagccaaggtgattctgccattcccagttttgcataggtccctgtggagagtatgaatccccctgggggcacccacccactcactctttcccatgttccagtggttctcctggctccatgctgagcccagacaggctggtccccagcttcattcctctctacaatctgtgttccccagcaatctcatgttttcccaggaagcacacagacagaagattagggctgacctggcaaggatatggcttatatgccaactgcagcccctgcctgattcagccctgtgcaaccgaacacccaacaaaagaaacatgggcatggagagagtaatcggaggtgggaggtcctccaagattcaggagtggattagaatcaaggccagtcgacagaccaccttattctataatcaaaccccaagggcatcaaagaagaaaaaagcaaaaaaaaaatccatccaaaggacagcagtttcaaagattcaagagacatcggcccacacaaatgagaaagaaccagtgcaagaactctggcaattcaaaaagccagagtgtcttcttacctccaaacaattgccctagttccctagcaatgattcttaaccaggctgaaatggatgagatgtcagatgtagaataaagaataaggataggaatgaagatcatcaatataccggagatagttaaaacccaatccaagaaatctaaggagtacaataaaacaatactggaggtggtagaccaaatggccattataagaaagaaacaggccaggcgtggtggctcacgcctgtaatcccagcactttaggaggccgaggtgggtggatcacctgaggtcaagagttcgagaccagcctggccaacatggtgaaaccccatctctactaaaaaatacaaaaaaaattagccaggtgtggtggcacatgcctgtaatcccagctacctggaggctgaggctggagaatcgcttgaacccgggaggcagaggttgcagtaagggaagatagcaccactacactccagcctgggagacagagtaagactctgtctcaaaaaaaaaaaaaaaagaaacaaacaaactgatctgatagagctgaaaaacacaataatgtacttgtaagtattaacagcagaatcaaccaggctgaggaaagaatctcagtggttgaaaactggctctcctaaataattcagtcagacgaaaataaagaaaaaaacaataaaggagaatgaacaaaacctccaagaaatatgggattatgtaaacagaccaaatctatgactcactggcgtccttgaaagagaaaagagagggagagaaaccaaggaccttggaaaacatatttcaggatatcgtccatgaaaatttccccaatcttgcagagaggacaacattcaaattcaggaaatgcagagaactcctgaaaaatgctacaaaagaaggccatcccaagacacataatcatcagattctccaaggtcaaaatgaaagaaaaaaggcagctagggccgggcgcagtggctcacgcctgtaatcccagcactttgggaggctgaggctggtggatcacctgaggtcaggagttcgagactagcctgaccaacatggagaaaccccgtcactactaaaaatacaaaattagccgggcgtggtggcacatgcttgtaatcccacctactcaggaggctaaggcaggagaatcgcttgaacccaggaggcggagattgcagtgagccgagattgtgccattgcactccagcctgggtgacagagtgaaactccaactcaaaaaaaaaaaaaaaaaaggacagctagaaagaaagggcaggtcatctgctaagagaaccccatcaggctaacagcagacctgtcggcagaaaccctacaagccagaagagattgggggagcctatattcagcattcttaaaaaacataattttcaaccaagaacttcatatgcagccaagttgtttcctaaacaacggagaaataaaatacttttcagacaagcaaatgctaagggaatttcttaccaacagacatgccttacaagaggtcctgaagaaagcactgaatatggaaaggaaagaccattaccagccactataaaaaaacactaagtacatagacaagtgatactctaaagcagccacacaaacaagtctgcataacaaccagctaacaacatgatgacgggatcaaatccacatgtatcgatactaatcttgaatgtaaatgggctaaatgcccccatttaaaaggcacagagtggaaagcaaaacccaatggtatactgtcttaaagagacccatctcacatgcactggcacctctaggcttaaagtaaagggatggagaaaaatttaccaagcaaaaagaaaacataaaaaggcaggggctgctattctaattccatacaaaacagacttcaaaccaacaaagatcaagaaaagataaagaagggcattaaataatggtaaaggactcaattcaacaagaagacctatctatcataaatatctatgcgctcaacccagattcataaagtcagttcctagggacctacaaagagacttagataactacacaataatagtgggagccttgaatacccccactgacactattgaacagatcatcgaggcagaaaactaacgcaagtattcaggacctgaactcaatgcttgaccaaatatacctaatataaatctacagaactttccatctgaaaacaacagaacatacattcttcacatctgcacatggcccatactctaaaatcaaccacacatattggacataaaacaattctcagcaaactcccaaaaaccaaaatcataccaaccaagctcacagacaatgcaataaatatagaaattaatgctaagaatatcaatcaaaagcatacaattacatggaaattaaacaacctgctcctaaatgacttctggataaataatgaaattaaggcagaaatcaagaaattcttttaaactaatgagaaaaaagatacaagatatcagaatttctgggacacggccaaagcactgttaagagggaagtttatagcactaaacacccacatcaaaaagttagaaatatctcagattaacaacctaatatcacaactagaggaattagagaaacaagaacaaaccaaccccaagactagcagaagacaaaaaataacaaaagtcagagacgaactaaaggaaattaagaggcaaaaaaaaaccatacaaaaatcaataaatccaggagctttttctttgaaagaagtaataatacaaggtagactggtagataaactaattttaaaaaacagagaagatccaaataaacacaatcagaaatggcaaagggtgtattaccactgaccccccagaaatacaaaaaaccctcagagattattatgaacacttctatacacacaagttagaaaacctaaaagaaatggataaattcctggaaacatacaacctccaaagattgaacgaggaagagattaaatccctgtacagactaatattgagttccaaaatcaaatgaataagtcatgacagtaagattataaaaaggccaggcatagtggcctttctataccagaaaaatacaaaaattagccaggcatagtggcacatgcctgtagttccagctacttggaggctgaggtgggaggattgcttgagtctgggaggttgaggctgcagtgagccatgatcacactactgcactccagcctgggtgacagagcaagaccctgtctcaaacaaaaaaatcaaatcagtaataaaagcctaccaaacagaaaaagcccatgaccagatggattcacagctgaattctatcagatgtataatgaagagctggtaccattctcactgaaattattctaaaaaattgaggaggaggaatgcctccctaactcattctatgaggccaacattatcctgataccaaaacctggcagagatacaacagaaaaagaaaacttcaggccaatatccttgatgaatatggatgcaaaaatcctcaagaaaatactagcaaactgggccgggcgcggtggctcacgcctgtactcccagcactttgggaggccgaggcgggtggatcatgaggtcaggagatcgagaccatcctggctaacacagtgaaaccccgtctctactaaaaatacaaaaaattagccgggcaaggtagcgggcgcctgtagtcccagctacttgggaggctgaggcaggagaatggcatgaaccccggggggcggagcctgcagtgagccgagatcacgccactgcactccagcctgggcgacagggagactccgtctcaaaaaaaaaaaaaaaaaaaaaaaaaagaaaatactagcaaactgaatccagcagcacatcaaaaagcttttccaccatggtcaagtaggcttcctccctaagatgcaaggttggttcaacacatgcaaatcaataaatgtgatacaccacaaaaacagaactaaaaacaaccacacaatcatctcaatagatgcagaaaaggctttcaataaaattcaacatctcttcatgttaaaaaccctcaagaaactaggcactgaaggaacatacctcaaataataagagccatttatgaaaaacccacagccaacatcctactgaatgggcaaaagctgaaggcattccccttgaaaaccagaacaagacaaggatgccctctctcatcactcctattcaacacagtactgaaagtcctagcaagagaaatcaggcaatagaaagaaataaaagatgctcaaaggaagagagaaagtcaaactccctgtttgcagacaatatgattctatacctagaaaaccccacagtctctgcccaaaagttctttgatctgacaaacaacttcaacaaagtttcaggatacaaaatcactgtactagctgtgcacagtggctcatggcggtaatcccagcactttgggaggctgaggcaggtagatcacttgagaccaggagtttggaccagcctggccaatatagctaaaccccgtctctactaaaaatacaaaaactagctgggtttggtggcccatgcctgtaattccagttatttgggtggttgaggcatgagaattgcttgaacccgggaagcagaggttgcagtaagtccaagtcacaccactgcactccagcctgggtaacagagtgagactctcatctcaaaaaaaaaaaaaaagcaatgtacaaaaatcagtagtattcctatacaccaacaacatacacactgtgagccaaattaagaattcaatttcattcacaatagccacaaaaaagaataaaataaacaggaatacagctctaaccagctataaccaaggaggtgaaagacctctacaacaagatttacaaaacactgcaagaaagaaaacagagatgacacaaacaaatggataaacaatccatgctcatggataggaagaatcaatattgttaaaatggccatactgcccaaagcaatttacagattcaatgctattcttatcaaactaccaatgacatttttcacagaattagaaaaaaactattttaaaattcatatggaaccacaaaagggtccaaatagccaaggtaatcctaagtgaaaagaacaatgctggagacatcacattacccaacttcaaactacactataaggctatggtaaccaaaacaacatggttccgttacaaaaacagaaatgtggggggggtggggggaggttccaagatggccgaataggaacagctcctatctatagctcccagggtgagtgacgcagaagacgggtgatttctgcacttccaactgaggtactgggttcatctcactaaccgaggtaccaggttcatctcactggggcttgtcggacagttggtgcagcccaccgagcgagagccgaagcagggcaaggcatggtctcacccgggaagcataaggggtcagggaattccctttcctagccaagggaaggggtgacagacggcacctggaaaatcgggtcactcccaccctaatactgtgcttttccaacggtcttagtaaatggcacaccaggagattatatcccgcgcctggctcggagggtcccacacccatggagcctccctcattgctcgcacagcagtctgagatcaaactgcaaggcggcagtgagactgggggaggggcgcccgccattgctgaggcttgagtaggtaaacaaagtggcctggaagctcgaactgggtagagcccaccacagctccaggaggcctacctgcctctgtagactccacctctaggggcagggcatagccgaacaaaaggcagcagaaacctctgcagacttaaacgtccctgtctgacagctttgaagagagtagtggttctcccagcatggagtttgagatctgagaacagacagactgcctcgtcaagtgggtccctgacctccgagtagcctaactgggaggcatctcccagtagaggcagactgacacttcacacggctgggtacccctctgagacgaagcttccagaggaatgatcaggcagaaacatttgctgttcagcaatatttgctgttctgcagcctctgctggtgatacccaggcaaacagtgtctggagtggacctccagcaaactccaacagacctgcagctgagggtcctgactgtcagaaggaaaattaacaaacagaaaggacatccatacaaaaaccccatctgtacgtcaccatcatcaaagaccaaaggcagataaaaccacaaagacggggaaaaaacagagcagaaaagctgaaaattctaaaaatcagagcacctctccccctccaaaggaatgcagctcctcgccaggaacagaacaaagctagatggagaatgactttgacaagttgagagaagaaggcttcagacgatcaaacttctccaagctaaagaggaagttcgaacccatcgtaaagacgctaaaaaccttgaaaaaagattagatgaatagctaactagaataactagtgtagagaagtccttaaatgatctgatggagcttaaaaccatgacacgagaaatatgtgacacatgcataagcttcagtagctgattccatcaagtggaagaaagggtatcagtgattgaagatcaaatgaatgaaatgaagtgagaagacaagtttagagaaaaaaaagagtaaaaagaaatgaacaaagcctccaagaaatatgggattatgtgaaaagaccaaacctagttctgattggtgtacctgaaagtgacagggagaagaatcaagttggaaaacactctttgggatattatccaggagaacttccccaatctagcaaggcaggccaacattcaaattcaggaaataccgagaacgccacaaagatactcctcgagaagagcaactccaagacacataattgtcagattcaccaaagttgaaatgaaggaaaaaatgttaagggcagccagaaagaaaggtcaggttacccacaaagggaatcccatcagaataacagcggatctcttggcagaaattctacaagccagaagagagtgggggccaatattcaaaattcttaaagaaaagaattttcaacccagaatttcatatccagccaaactaagcttcataagtgaaggagaaataaaatcctttacagacaagcaaatactgagagattttgtcaccactaggcctgccttacaagagctcctgaaggaagcactaaacacggaaaggaacaaccggtaccagccactgcaaaaacatgccaaattggaaaaaccatcgatgttagaaagaaactgcatcaactaatgagcaaaataaccagctaacatcataatgacaggatcaaattcacacataacatattaaccttaaatgtaaatgggctaaatgctccaattaaaagacacagactggcaaattggataaagactcaagacccatcagtgtgctgtattcaggaaaccaatttcacatgcagaggcacacataggctcaaaataaagggatggaggaagatctaccaagcaaatggaaaacaaaaaaacaagcaagggttgcaatcctagtctctgataaaacagactttaaaccaacgaagatcaaaagagacaaagaaggccattacataatggtcaagggatcaattcaacaagaagagataactatactaaatatgtatgcatccaatacaggagcacccagattcataaagcaagtccttagagacctacaaagagacttagactcccacacaataataatgggagactttaacaccccactgtcaacattagacagatcgagacagaaagttaacaaggatatccaggaattgaactcagctctgcaccaagcagacctaatacacatctacagaactctccaccccaaatcaacagaatatacattcttcgcagcaccacatagcacttattccaaaattgatcacatagttggaagtaaagcactcctcaggaaatgtaaaagaacagaaattataacaaactgtctctcagaccacagtgcaatcaaactagaactcaggattaagaaactcactcaaaaccgctcaactacatggaaactgaataacctgcttctgaatgactactgggtacataatgaaatgaaggcagaaacaaagatgttctttgaaaccaatgagaacaaagagacaacataccggaatgtctgggacacatttaaagcagtgagtagagggaaatttatagcactaaatgcccacaagagaaagcaggaaagatctaaaattgacaccctaacatcacaattaaaagaactagaaaagcaagagcaaacatattcaaaagctagcagaaggcaagaaataactaagatcagagcagaactgaaggagatagagacacaaaaatcccttcaaaaaatcaatgaatccaggagctggttttttgaaaagactaacaaaattgacagacggatagcaagactcataaagaagaaaagagggaagaatcaaatagacacaataaaaaatgataaaagggttatcaccactgatcccacagaaatacaaactaccatcagagaatactataaacacctctatgcaaataaactagaaaatctagaagaaatggataaattcctggacacatacaccctcccaagactaaaccagaagatgttgaatccctgaatagaccaataacaggctctgaaactgaggcaataattaaaagcctaccaaccaaagaaaaggccaggaccagatagattcacagccgaattctaccagaggtacaaggaggagctggtaccattccttctgaaactattccaatcaacagaaaaagagggaacaacccctaactcattttatgaggccagcatcatcctgatacgaaagcctggcagagacacaacaaaaaaagagaactttagatcaatatccctgatgaatatccatgcaaaaatcctcaataaaatactggcaaaccgaatccagcagcatatcaaaaagcttatccaccatgatcaagtgggcttcatccctgggatgcaaggctggttcaacatatgcaaatcaataaacatagtccagcatataaacagaaccaaaggcaaaaaccacatgattatctcaatagatacagaaaaggcctttgacaaaattcaacaacccttcgtgctaaaaattctctataaattagttattgatgggacgtacctaaaaataataagagctatttatgacaaacccacagccaatatcataatgaatgagcaaaaactggaagcattccctttgaaaactagcacaagacaaggatgtcctctctcaccactccgattcaacatagcgttggaagttctggccagggcaatcaggcaagagaaagaaataaagggtattcaattaagaaaagaggaagtcaaattgtccctgtttgcagatgaccagatgacatgattgtatatttagaaaaccccatcgtctcagcccaaaatctccttaagctgataagcaacttcagcaaagtctcaggatacaaaatcaatgtgcaaaaaacacaagcattcctatacacaaataatagacaaacagagagccaaatcatgagtgaacttccattcacaattgcttcaaagagaataaaatacctaggaatccaacttacaagaaatgtgaaggacctcttcgaggagaactacaaacctctgctcaacacaataaaagagaacacaaacaaatggaaaacaattccatgctcatggataggaagaatcaatatcgtgaaaatggccatactacccaaggtaatttatagattcaatgctatccccatcaagctaccactgactttcttcacagattggaaaaaactactttaaagttcgtatggaaccaaaaaagagcccacattgccaagacaatcctaagcaaaaagaacaaagctggaggcatcatgctacctgacttcaaactatactacaaagctacagtaaccaaaacagcatggtactggtaccaaaacagagatatagaccaatggaacagaacagagccctcagaaataatgccgcatatctacaaccatctgatctttgacaaacctgacaaaaacaagaaatggggaaaggattccctatttaataaatggtgctggaaaaactggctagccatatgtagaaagctgaagctggatcccttccttacaccttatacaaaaattaattcaagatgaattaaagacttaaatgttagacctaaaaccataaaaaccctagaagaaaacctaggcaataccattcaggacataggcatgggcaaggacttcatgtctaaaacactaaaagcaatgacaccaaaagccaaaattgacaaatgggatctaattaaactgaagagtttctgcacagcaaaaaaaactaccatcagagtgaacaggcaacctacagaatgggagaaaatttttgcaatctactgatctggcaaagggctaatatccagaatctacaaagaacttaaacaaatttgcaagaaaaaatcaaacaaccccatcaaaaatgggcaaaggatatgaacagacacttctcaaaagaagacatttatgcagccaacagacacatgaaaaaatgctcatcatccctggccatcagagaaatgcaaatcaaaaccaccatgagataccatctcataccagttagaatggtgatcattaaaaagtcaggacacaagtgctggagaggatgtggagaaatagtaacacttttacaccgttggtgggactgtaaactagtacaacgattgtggaagtcagtgtggtgattcctcaaggatctagaactagaattaccatttgacccagccatcccattactgagtatatacccaaaggattataaatcatgctgctataaagacacatgcacacgtatgtttattgcggcactagtcacaatagcaaagacttggaaccaacccaaatgtccaacaatgatagactggattaagaaaatgtggcacatatataccatggaatactatgcagccataaaaaatgatgagttcatgtcctttgtagggacatggatgaagctggaaaccatcattctcagcaaattatcacaaggacagaaaaccaaacaccgcatgttcttactcataggtgggaatggaacaatgagaacacatggacacaggatggggaacaccacacaccagggcctgtagtggggtggggggaggggtgagggatagcattaggagatatacctaatgtaaatgacgagttaatgcgtgcagcacaccaacatggcacatgtatacatatgtaacaaacctgcacgttgtgcacatgtaccctagaacttaaagtataaaaaaaaaaaccagaaatatagactaatggaacagaataaagagcccagaaataatgccacacatctacacaatcaagaaaaacaagcaacagggaaagaactcttcattcaataaatgatactgggataactggctagccacacgcggaatattgaaactggaccacttccttacaccatatacaaaaatcaactcaatatagatgcaagacttaaatgtaaaacttaaaactataacaaccctggaagataacctaggaaataccattctgggcatagaacttggcaaaaatttcattatgaagatgccaaaagcaattgcaacaaaaacaaaaattaacaaatggggcctaattaaacaaaagaacttctagcagcaaaagaaactatcaacagaataaacagacaacctatagaatggtataaaacatttgtgaactatacatccaacagaagtctaatatccacaatctataaggatcttaaacaaatttacaagaaaaaaacaccaccattagccaggcacggtggctcatgcctgtaatcccagcactttgggaggccgaggcgggtggatcacgaggtcaggagatcgagaccatcctggctaacacggtgaaaccccgcctctactaaaaatacaaaaaattagccgggcgtggtggcgggcacctgtggtcccagctactcaggaggctgaggcaggagaatgccgtgaaaccgggaggtggagcctgcagtgagctgagatcgcgccactgcactccagcctgagcgacagaatgagactccgtctcaaacaaaacaaaacaaaacagaacaaaacaaaaaaaaataccattaaaagagtggtgaaaacagacaaacaaacacttcttagaagacatacaggcaaccaatgagcatatgaaaaaatgctcaacatcactaatcattagagaaatgtaaatctcacaccagttagaatggctattattaaaaagtcagaaaataacagatactggcaaggttacagagaaaaggaaatgcttacacactgctggtgggaatgtaaattagctcagccattgtggaaagcagtttggccatttctcaaagaacataaaacagaattgccattcaacccaacaatcccattattgggtatatgcccaaaggaatataaatcattctaccataaagacacatgcatgcatatgcacatcacagcactattcacaatagcaaagatatgaaatcaacctaaatgcccatcaacagtagactggattttttaaaatgtggtatatatatacattgaaatactatgcagccataaaaaagaatgagatcatgtcctttgcagcaacatggacggagttggagaccattatcctaggcaaactaacacagagacagaaaaccaaatactacacattctcacttacaagtggaagctaaacttctgagtacatatggacacaaagaaaggaagaacagacaccaggatctacttgagggtggaggtgggaggatggtgaggattggagaagtatctattgaatgctaggcttataacctgggtgacaaaatatacaccaaattcctatgacacgcaatttacctacatataacaaaccttcacatgtactccctcaacctaaaataaaagttaaaaagagagagagagagagagagagagagagagagagagagagagagagagagaaataattagggcaaggatgacagactttattacataaagctttaaaatttctgtcatcagccgggtgtggtggttcatgcctgtaatcccagcactttgggaggccaaggtgggtggatcacctgaggtcaggagtttaagaccagcctggccaatatggtgaaaccccatctctactaaaaatacaaaaaattagctgggcgtagtggtgggcacctgtaatcccagctacctggaggctgaggctggagaatcgcttgaacccaggaggcggaggttgcagtgagctgagattgcaccaatgcacttccagcctgggcaacaagagcgaaactccatctcaaaaaaaaaaaaaaaaaaaaaaaattctgtcaccagaagactccacaagcaaaactgaaagcaaacatcaagtgtgggggaaaaaaatctccaaatatattccaaagggctaatattgccaatataaagagctactacaaaccagtaagaaaattataggaattacaatgtaaaaacagacaagataggagcaggtaatttgtaaaggaagaaataatgggcaaaaatatccttattctaactgaatgcaatacatcaagagtaggattatagtgtatacatacatatatatgtatatatatgtgtatatatatatatatatatatatattttttttttttttttttttgagatggagttttgctattgtcgcccaggctggagtgcaatggtgtgatctcggctcactgcaacctctgcctcctgggttcaagcaattctcctgtctcagcctcccaagcagctgggattacaggcatgcaccaccacacttggcagattatagtatataatgtatactgaattcatacaaacctgtaatattgctctttcaggtaacagtgaaatgtcacattttagagtctcatctacaagaaagacttcagaagaacttcgttcaggaaaattggattcttctgcagcagctcttttgagtattaacctatttttccattttttcaattgaagttcatgttttaatatctgcaatgaaaataattttaaaattccatggaattgctgtaacggtcaagagagatgacagacacaaagcacagtgcttgacacaagaataggaccaattaaacattatttatgatcgtcatcattactacataaactataatttttcataagcatgtttaatgttctctaaaccaccgaagtattacagatcatttccattagttgtcataaaacactggcacaggcagccatcttgaaacgctgatctagtctcctctttcacagatgaggaagtgaggaccacaaagtcaaggctctggcaatgataaaactggtaattggtgcatggagtgaaggtgattaacatacagataacaaaaaagggaagtcagtagtaatgcatttgggaaattgccaaatttattgtcacaggaagtccccattttaacttttgatacacttctgaaaactgtgtaataaataaaggtagtatttcagtcataaacatatacacaatattggcataatatatattgatgtaatatatatatgtgtatgtgtgtatgtatgtatgtatgtgtctgtgtatatacacacacatattagagcctgaggcagaacacatgtggagcgcttgacacacaggtgttccctgcctctgctcccagcatacacttgccatcctcactccatttaagtgaatgtagaatgattgttaggtcaataaatcatatatctagaaaaaaagttctctaaacacacaattaactatataatatatataatatacatatatcttgatgatattatagtacatatagcataaattatatatattaatatatatcaaccactgtgtgcaaaacattacgctcagcatatggacaatactaagagaacaatactgcctgctctcagggatttttttgtttgtttgttttttgagaaggagtttcgcttttgtcgcccaggctggagtgcagtggcgtgatctcggctcactgcatcctccacctcaagggttcaagagattctcctgactcagcctcccaagtagctgggattacaggggcccaccaccatgcctggctaatttttatattcagggatgtttagctgaagggggtgtataaggggggactggtcatgtacagttacctatttcactattagacaatcagtgatcaggcatagagggcagttatcaaaacactagcttaacatacagactggtggaaagcagtgaatgagcagactaacatagtattaggtacccaaagtagagctgtttcactggtaacattgaaaaggtagtttgcaaaaggcaaagcctagaggacagcctgcaagaccaccagctcaaaacctatagattataaacttctagagagcatctcaagtaatctctgagatgcttaaagctcagcacaggctctagcattgttttaggcatatgtaagtaataaatctcctcatactcttttgctgcgtgtgtgctattgtcagtctcaacatctgaaccaaatttaggtgagtagaggcattgatccatggggcaaccacaaaagaaggggatttaacttcaccccacattctctttcctatctacccttactttatatttcaaagaatattaataaaatatctcctactaaataatgtaactacagaaaaaaaaatccagcatgtttctacatctgatcatagtgttactttgagcatactaaaccaatattaagtaatgatatactaatagctgaagtaaattttaaattattaagttaaagaacaagaatcccggccagacacggtggctcacgcctgtaatcccagcactttaggaggccgaggcgggcagatcacctgaggtcacgagttcaagaccagcctagccaacatggtgaaaccccatctctactaaaactacaaaaaaattagctgggtgtggtggcagacacctgtaattccagctactcaggaggctgaggcaggagaaatgcttgaacctgggaggcagaggttgcagtgagccgagatcacaccattgcactccagcctggacaacaagagcaaaactctgtcccaaaaaaataaaaataaaaaaaaacaagaatcccatcaaaagtagataatattcaggattttagtattttccacacacggcattactatttgaggcaacatgaatataactgaaacattcggattcttaaaaaattgtttcaatatacaataccagctcatcttctttctttttactcttatgtcttgctgtattccgccattttgttaggataatggttagcttgtgacaatagatgatctgttgtatccgcaatagaatatctgaaggaaatttactagattactgtatatattaatagttatagctgtttccaaaaaacacaaagtgatttaatagtctatcatgtttatgagacaatgtcgcatctgatcgtttttgtttggtcttatttacacttgaaattaattacttttgatagcattagtactctcaagactttacgaactgggaaacatcacctttgcccttagaaattaagatgtaaaactgcaatagaaatgtcaagacatgtatcatttcctttttttaaacaaggttgttctttgtaaaaccagaacttctaaactttttcataagaaatacagtcataaggtagcatttagatccaatgcctttgaatttaattttatgtcctgtgattaaccagttcctaacccttcgttacactaatgttaaaattttcggagggtccactctaactgaggtaccaaccaaagccagccaaaaagaaatgattctctggtttgcaacagtcataaacaagttgttatcaggagagttgcaaaaaaatctaactggaagacaagagctcttggaggttatactgagtgagcatggatcacatgaatgtacctcccacccactcagtataacccccaaggtcttaagagaagataatttttattttttagtttcgtcatatatacattaaatataatctttgtaaaaagcataaacctctttacaaaaatagtcaattttggtacctgtccatactatttggaacccatccagctctctattatgtagaaaagctcatagtagattctatttatattcatgtatacatacacacaaatgcacacaagatttgattttaaatgttttctattaaaataaaatcctttgagacaaatctccttaagtatttttaaattagcagctctaccttcatttcatgacaattgtctagacataaaaatgataggttctctaagtacccaaagtatgcttaactgttagtttttttattatttcaataaatggatacaaaaagtaattgctactatgtaagaatttacttttaagtttttctttctggtcttccatataagagtgccagtgatgaaatacagatttttgaagtctgaaattgtagcatgtcactgctctgttcattttttcagccaggacgacattttcatttgtacgagctatgtctctccaagtgctgcaggcagaagacattttttaaaaaataatattttgatattagggcaatatatcattaaataaattaaggagaacaaagaatgatatctcctttatgacctcaaaaaccacagcatagaaagaaacttctacaacttgggtatgacctgaagaattcctaagagttatagagaaaaatggagattatatgagtcatatttctttttagataaaataaagaaatcatgggataaaatcatgttgtcataattccaatttaccaaaagaaccacctaatgatgtctttttttaaaaggaatctaaattccacaacatatttggctccaagggtttcagataagtggactgtgaaactaactatattttaattttaaagttttattttttaagaaaagataattataccttaaagaagtaaaatacatattttaactaagtaaaagctgattaaatataaaagaaatatataatacaaaatggtagaaacatgattaaacagataaaatcagcacaactggccaaaagtgaatttttctttgcacggagaatatcaagaataaaaactcaaagaggaagaaattgtaaaaatcacattcttaccaaaaatgagtctttactaaatgtccagtataaaagctacaggcttttatcatcaattccggagtcatctaaagtaaataaataattgaaataacaaatattagaaataaatggaatgcacagactacctctgcaagatactcaagaaaaagagagcaatggatgccaagagggaagggaattgggcagttggagacaggaatgggctgaaagaactatatactatttatgttttggaattttgtgtatgtctgtaagctatttttttaagttaaaataacagcttaatatattttcccattatatctcacttagtttgaagagttaagcatcatggcattgttatgataagctatatttataatagtatagaattgcagttctgctgttcactattaaaacagaatgattttctgaatcattctgaatcaaacagaatgatttttttcaaggatataaactgagattctcttttcaacatagaggaattcctcatttaccaagcaggaataggaaaaccacataaatgaaaagtctaaactgtggaatatgcttaaagagatgcaaatttatcacttacaactattcacaataacatgtggcaacagctaactgaaatcatctataccttctgtgcattctttaataagtaaagatattattatattaacataagtattatatgcacatggctactgttaagtgttaatggtgttttcctcttattttgttgcccctttgcttactatatagatatacaaacatatggtcacatctatttggtgtataggtaagtttggttcaaatctataccaacagccaggaattctgaattctacttttctaaggcaaatgttttctcctttgcacattgctgtaaatactttgttaaattaacagatatggcatacacatgttcatcatagatttattttaggcatacaagaaaggcccataggacccccgacatgtgaaaatcctcacttttgatggagattaaatgcaaattatgcctacagtgagggacaacataaacgattcaagtcattcttcactaaattcagatttttatagaagaaaggaatccagatgagtaaaggagtattgaggatattacagcaggcagaataaaaaccaagaaggggatgaggtggcaaaggcagacaaatttcactaacattacaatttttcagtactgttgtaggtccctaaatttcatgagcttaattctttttagatgatattacctgaaaagtcctaaataaataactacagtaaatgatatgtcataaaaatatgagtatattatatgaccaaatgaatgtagttcaaaacattatagtaataatgattttgaaaagaattattaaaattcagcaaataccatttgaactcaagttttcttttctgatgatcaactctttaaaacagcataaaagcattttctattctattattgaaagaagtaatttaaatcctcattaattcatgatttataatacaccagaatttttgttgttctaatattcattttttaagagtttctcttcataaatttttattttaactttacatttattgttctcccagtttgcaagggagggagggagcgagggagcgagggaggggaaaggaaggaaagagagaaagaaacaaactcacaatttttcattattattattattggtatatattcttttcttcacagggaaaagcaagtttaagagagcatctccaagggactaatatgcaagaggactccagcccagtaatgccccattccccacttaggggtgggcatgtgttgacttcactgcagctccaaggaatctctggccaatccaatcactgggcacatgtctggaccacttagtcacatggcttcacttcctccatttatgtttccaccatccacactccagccaatggcttcccacccttcacagtcgctgcatattgtttaactgcttctgactgaaaaatattcttcctctcaccttttaattccagctggcagtgttttgcacagagtaggagctcaacaaatatatatgtattgatccatcaacagaattagaaaactgcttaaatgcaagccaattctccaccatctgactaccacaaatggagggcaaaggattctggtaacaactttgtgggcaagtcagtggataaacagcaagttagtgctggctacagatggcctcagagtaccctcacataacactcacaccactagtgctgctatccccagacacccgtagttacaaacaaagtgagggaggaatggacagtgcatcacaatacgatttctaagagtccaggtacactgaaaggttaatttctagtctggaaataaaagaaaaaattctaccataagagatgatttttaaagttaaagagtgggaatgtgtaaataaataatgaattcgttgcaaaagatttttcatagtattaagttagggtttaacactacttttttaggccagtggcctacaagaagccagttggaatcaactgcaaaacttgtaaactacccaggctcacttcccaagattccttagccctccactcttaccctctctaggaattactgctgtgattagtcactattatgactaagagtatgtcttattcctcatgtacactggggacagaagaatgttaagtcccaaattttaagctgagttccagcagcatacaatagcacacacactagtttcaaggaaacatgtttttatagattaggagagaaaaagaagtgaaatataaaactgatttctttttgaaaagatattatatgtagcatgattacaacccagtcctaaaaaaatagcttataaaaaaatttcattcctctgccagggttggaggaaaataagatttaaaatttcaaacttacagagaaataaaataaacacctaatacccacaatccatgtttaacattgtcaacattctgccatacttgctttttctattttaaagtatataaattaagacatcatgacatttcatcccccaaatctcataatatccatctcttaaaaaatgagtaccttttctttgcaaccacaattccattatcctgccttagacacttaatagtaattgcttaatatcattgtacccatgccatagccaactctctggaattggcctccaaatgtcttacacggtttgttcaaactagaatccagacaaggaccatatatttgcattgcaaactcagttgatgcgaggatttcaatagctacagaaaaaaagttttagtttttccttctccttttctatattttcaacatttaatgagtatgaggtgtggaggtgggataacattggcctaaatctaatggattctgttacctgggcctgtctaatattacattctaaaagtcagccaggcatggtggctcacacttgcaatcccaaaacgttggatggctgaggtgggaggatccctcgagctcacgacttaaagagtagcctcggcaacatagtgagaccttgtctctgctaaaaataaaaaattagcggggtgtggtggcatgcacccatagtaccagcaacttgggaggttgaggtgggagaatcactggagctcagatagaggctgcagtgagcaagctatgattgtgccactgcactccagcctgggcaacagagtgagactctctctctctgtctgtctgtctctgtctctctctctccatccccccatacacacacacatacacactcacacacacagagttctaaaagtcaatttaaatatttttgacagacaagagactaagaaaggtttttttgtttgttttttgtttttgtttttcttttttttcttttcctatgctctgaaagaaagacaagaatggggatggggtggggagccacatgtcatctgtctctgccacctgaatcaggggtctgagtcttagggaagaacaaactgcaggcagaatccaaaagaactgctcctatgaggcacacagcactatttgtgcaatacaaagtgaaggaaaggcattgtgtccagaattggtgggttcttggtctcactgacttcaagaatgaagccgcggaccctcgcggtgagtgttacagttcttaaaggcggcgtgtctggagtttgttccttctgatgttcggatgtgttcggagtttcttccttctggtggattcgtggtcttgctggctcaagaatgaagctgcagaccttcccgatgagtgttatagctcttaaggcagcgcgtctggagttgttcgttcctcctggtgggtttgtggtcttgttggcttcaggagtgaagctgcagaccttcacggtgagtgttacagctcataaaggcaatgtggacccaaagagtgagcagcagcaagatttattgcaaagaatgaaagaacaaagcttccacagtgtggaaggggaccccagcgggttcccaatgctggctcgggcagcctgcttttattctcttatctggccccacccacatcctgctgatcggtagagccaagtggtctgttttgacagggcgctgattggtgtgtttacaatccctgagctagacacaaaggttctccacatccccaccagattagctagatacagagtgtcgacacaaaggttctccaagtccccaccagagtagctagatacagagtgtcgattggtgcattcacaaaccctgagctagacacagggtgctgattggtgtgtttacaaaccttgagctagagacagagtgctgattggtgtatttacaatcccttagctagacataaaggttctccaagttcccactagactcaggagaccagctggcttcacccagtggatctcgcactggggctgcaggtggagctgcctgccagtcctgtgccgtgtgcccacactcctcagccattgggtggtcgatgggactgcgcaccgtggagcggggggcggcgcttgtaggggaggctagggcggcacaggagcccatggacggtgtgggggaggctcaggcatggcggactgcaggtcctgagccctgccccacgggaaggcagctaaagcccagcgagaaattgagcacagcagctgctggcccaggtgctaagcccctcactgcccggggccagtggggccggctggccgctctgagtgcggggtccgctgagcccacgcccacccggaactcccgctggcccgcaagcacagtgggcagccccagttcccacccacgcctttccctccacacctcctcgcaagctgagggagccggttccggccttggccagcccagaaaggggatcccacagtgcagtggcaggctgaaaggctcctaaagtgccgccaaagtgggagcccaggcagaggaggcgccgagagcgaacgagggctgcgagggctgccagcacactgtcacctctcagcatgtcccccactactgtacagcacacagagtacaaggccatcaaatttaatgtgactttaaattttgcaaacttaaactaatgtgatacaaaatatattacaaaagtcttacattatgccagtttttgaaaaaacacaatctttcaaattaaaattttactgagaggtatttcctttcaaagctggtgggaaaacgaattaaaagtttaagtattgccacaaagtggtactattttggcaggtaaacaaatgcggctttagtcttgaagtatgagtttgagttattagcagtcttcagaaaaatacggcatcttgtgaaaagtgtgaccaaccagtgtggtctgagtaaagttggcaggcaagggaaaggaagagtatttggcacttaaggattccaggtgtacagcctggaacaccagctcaggcagacattggggctcttaggaagaccaggttggcagttctagggtccccttcagatggcctcacaggttccagacagacactaggaggaattcttgaatttacatgggatagctttgggattcccagacacaaatgggtagaacttgaagaggaaactgacctcttgtgttatgaagacaggagctagaggcagtgaaatctgggatattcctattaacactgctctactaatatcccaggttggtgagacctggggaagtgttgtagtaaatgaaaaaataatgaaatactattacaaattactgttgacttaacagataccaaatttatggctctttaatataagtagtaattgatcccattaatttttaattttgtaagatatccatttactatatgtaaaaaaatgcatttaaacaacagctatagaaaaaaagtttcagttctataaaatacttaaagtatctagtaaagtattaagaatctggtaagaaccaaatgtaaaataaatgtaaatcattaactttatattataatttttagcttccagcatattgtaatattatttttcttctggcaggcaattcccttttttgctcagttaacctgtgaatcaaaagattatatatgaaattgtcttaacataattcaccatattataaagtaccatgcctttacttcattaatgagcttcatttatatcccacatagtatcattctagaataggggtctccaacccccaggccacagactggtacaggtccatggcctgttaggaactaggccacacagcaggaggtgagcagtgggcaagcgagcattacctcctgagctccacctcatcagccgcagcattagattctcatgggagcacgaaccccactgtgaactgtgcatgcaaaggatctaggttgtgcattccttatgagaatctaactaatgcctgatgatctgaggtacaacagtttcatccttaaatcacccccaccaccccaccacagtccatggaaaaaatttcttccacaaaaccagtctctggtaccaaaaaggttggtgaccactgttctagaataataatagcaaaacagaatggggattataaatatgtgttgaatggatatgcctaatttaaatccctcccaactcagattttttttttatttttcaaaagccctacaagttaataacaatggcaaaaagaagccatgtctttaatacagagagaacatatctttatatatagcagcacggcatggtatgaagtgttgaatttttcatgatgagtcatttttcttatttcttgatcttctgcaaattactgatttatttatttatttatttttgagacagagtctcaatctgtcacccagactggagcacgatcttggctcactgcaatctccactccccggttcaagtgattcttgtgccttagtctcctcagtaactgggattacaggtgtgcaccaccacacgtagctaatttttgtatttttagtagaaatggggtttcaccatgttgcccaggctgctcttgaactcctggcctcaagtgatctgcccacttcggcctcccaaagtgttggggttacaggcacaagccacagtgcctggcccaaaagagtctttaatacctaaagggcttttgtgcctggacagaaacgctcactaacatttgtactttaatgctttttaccaataaacacatatttaaataaatacaattttggaaactcaatgtttcttaaacatgttcatgtttgttaccaacttcattaagtaaagtccctgaaataatttaaactacaattacaatttacaaagccattccttagaacacctaaaatgccataaatagcagacagaatatacataaatatcatatcattattatatgttacacttaaacttatcctaaacaacatgaatctagttcatatcttcattacttccacactttacttaatgttttactccttcctgattacagtaatgtttattttgatgccttatcagataacagtaatgtactcagtttcaaaagaaatgaaatacctttgcagagccaacaaggatacaggatcaaccaactgattatcaaccaactgattcttatttggggcacaggcattgtctgcctctcccaaatgattaaaactccagcccctaagggtcttaagattaagtttcctttccacagttaaactttgttcatcagtaagacttttcaaatccatatctttcatttacattttagggttttttttacacgatgctcctctgtgatagcattattttaaaatattttgtattttattttattattttaaaagacacagtgggtcacgcctataatcctagcactttgggaggctgaggtaggaagatctcttgaggccaggagtttgagaccagctggggcaacacagtgagactctgtctgtaccaaaggaaaaaaaaattagccaggtgtggtagctcacatctagtagtcccagctactcaggaggcagaggcaggaggattgtttgagctcaggaattcaaggttacaatgaactatgatcatgccactgcactccagcaagagtgacagagtgagaccctgtctgtaaaagaatatttttgggcatgcttccaagatggccgaatagaaacagctccggtctgcagctcccagcgagatccacgcagaagacggatgatttctgcatttccagctgaggtatctggtgcacctcactgggactggttggacagtgggtgcagcccacagagggcgagctgaagcagggtagggcatcgcctcacccaggaagtgcaaggggtcaggggatttccctttccaagccaagggaagccatgacagactgtacctgggaaaacggtacatgcctgaccaaatactgagcttttcccacagtcttcgcaacctgcagaccaggagataccctccctcccatgcctggctcggtgagtcccacacccatggagccttactcactgctagcgcagcagtctgagatcgacctgcgacactgcagattggcggggggaggggcatctgccattgctgaggcttgagtagctcacagtgtaaacaaagaggccaggaagcacaaactgggcggagcccaccacagctcagcaaggcctactgcctctatagattccacctctggggacagggcatagtagaacaaaaggcagcagacagcttctgcagacttaaacgtccctgtctgacagctctgaagagagcagtgattctctcagcacggcgttcaagctctgagaatggacagactgcctcctcaagcaggtccctgacccccatgtagcctgactgggaaacatctcccagtaggggctgatagacacctcaaacaggcgggtgcccctctgggacgaagcttccagaggaaggatcaggcagcaatatttgctgttctgcagcctccactggtgatacataggcaaacaaggtctggagtggacctccagcaaactccaacagactggcagctcaggggtctgactgttaaaggaaaactaacaaacagaaaggaatatcatgaacatcaacaaaaatgacatccacaccaaaaccccatctgtaggtcaccaacatcaaagaccaaaggtagataaaaccacaaagatggggagaaaccagagcagaaaagctgaaaattccaaaagacacagggcctattctcttccaaaggatcgcagctcctcgccagcaaggggacaaaactggatggagaatgagtttgacaagttgacagaagtaggcttcagaaggtgggtaataacaaacttctctgagctaaaggagcatgttctaacccatcccaaggaagctaaaaatcttgaaaaaagattagatgaatggctaactagaatgaatagtgtagagaagaccttaaatgacctgatggagctgaaaaccatggcatgagaacttcatgatgcatgcataagcttcaatagctgattccatcaagtggaagaaaggatatcagtgattgaagatcaaattaatgaaataaagcaagaagacaagattagagaaaaaagagtgaaaagaaatgaacaaagcctccaagaaatatgggactaggtgaaaagaccaaataaatatacatttgattggtgtactggaaagtgacagggagaatgcaatcaagttagaaaacactcttcaggatattatccaggaaaacttccctaacctagcaaggcaggccaacattcaaattcaggaaacacagacaccaacacaaagatacgccttgagaagagcaactccaagacacataattgtcagattcaccaaggttgaaatgagggaaaaaatgttaagggcagccagagagaaagattgggttacccacaaagggaagcacatcagactaacaggggatctctcggcggaaaccttataagccagaagagagtgggggccaatattcaacattcttaaagaaaagaattttcaacccagaatctcatatccagtcaaactaagtttcataagtgaaggagaaataaaatcctttacagacaagtaaatgctgagagattttgtcaccaccaggcctgcattacaagagctcctggtggaagcactaaatatggaaaggaacaaccggtaccagccactgtaaaaacattccaaatggtaaagaccatcgatgctatgaagaaactgcatcaattaacaggcaaaataaccagctaatataataacaggatcaaattcaaacataacaatattaactttaaatgtaaatgggctaaatgccccaattaaaagacacaaactggcatactggataaagagtcaagacccatcagtgtgttgtattcaggagacccatctcatgtgcaaagatgcacataagctcaaaataaagggatggaggaatacttaccaagcaaatggaaagcaaaaaaaagcaggggttgcaatcctagtctctgataaaacagactttaaaccaacagagatcaaaaagagacaaagaaggccactacatattggtaaagggatcaattcaccaagaagagctaactatcctaaatatatatgcacccaatacaggagcacccagattcataaagcaagtccttagagacctacaaagagacttagactcccacaccataataatgggagactttaacaccccactgtcaacattagacagatcaatgagacagaaggttaacaaggatatccaggacttgaactcagctctggaccaaggagacctaatagacatctaagaactccacaccccaaatcaacagaatatacactcttctgagcatcacgtcgcacttattctaaaattgaccacataattggtagtaaaacactcctcaccagatgtaaaagaacagaaatcacaaaaaactgtctcgcagaccacagtgcaatcaaattagtactcaggattaataaactcactcaaaactgtacaactacatggaaactgaacaacctgctcctgaatgactcctggctaaataaataataaaattaaggcagaaataaacatgttctttgaaaccaaggagaacaaagacacaatgtaccagaatctctgggacatatttaaagaagtgtgtagagggaaattgatagcactaaatgcccacaagagaaagcaggaaagatctaaaatcgacaccctaaaatcacaattaaaagaactagagaagcaagagcaaacacattcaaaagctagcagaaggcaagaaataactaagattagagcagaactgaaggagagagtcacaaaaaacccttcgaaaaaccaatgtatccaggagctggttttttgaaaagaccaacaaattgatagaccgatagcaagactaataaagaagaaaagagagaagaatcaaatagatacaataaaaaatgataaaggggttataaccaccgatcccacagaaatacaaactaccatcagagaatactgtaaacacctctatgcaaataaactagaaaatctagaagaaatggacaaattcctggacacatacaccctcccaagactaaatcaggaagaagttgaatctctgaatagaccaaaaacaggttctgaaattgaagcaataatagcctaccaaccaaaaaaagaccaggaccagacggattcacagccaaattccaccagaagtacaaacaggagctggtaccattccttctgaaattatttcaatcaatagaaaaagagagaatcttccctaactctttttatgaggctagcatcatcctgatacaaaagcctgatagagacaaaactaaaaaagagaattttaggccaatatccctgatgaacatcaatgtgaaaatccttaataaaatactggaaaactgaatccagcagcacatcaaaaagcttatccaccacaatcaagttggcttcatccctgggatgcaaggctggttcaacatatgcaaatcaataaacataatccatcacataaacagaaccaatgacaaaaaccacatgattatctcaatagatgtagaaaagacctttgacaaaattcaacagcccttcatgctaaaaactctcaataaactaggtattgatggaacatatctcaaaataataagagctatttatgacaaacccacagccaatatcctactgaatgggcaaaaactagaagcattccctttgaaaactggcacaagacaaggatgccctctctcaatactcctattcaacatagttttggaagttcttctggctaggcaatcaggcaagagaaagacataaagggtattcaattaggaaaagaggaagtcaaattgtctctttgcagatgacacgactgtatatttagaaaaacccattgtctcagcccaaaatctccttaagctgataagcaacttcagcaaagtctcaggatacaaaatcaatgtgcaaaaatcacaagcattcctatacaccaataatagacaaacagagagccaaatcatgagtgaactcccattcacaattgcttcaaagagaataaaatacctaggaatccaacttacaagggatgtgaaggacctcttcaaggagaactacaaactactgctcaacacaataaaagaggacacaaacaaatggaagaacattccatgctcatggataggaagaatcagtatcatgaaaatggccatacaacccaaggtaatttatagattcaatgctatccccatcaagctaccactgactttcttcacagaattggaaaaaactactttaaagttcatatggaaccaaaaaaaagcccacatagccaaggcagtcttaagcaaaaagaacaaagctggaggcatcatggagacttcaaactatactacaaggctacagtaaccaaaacagcatggtactggtaccaaaacagatatatagaccaatggaacagaatagagacctcagaaataacacaacacatctacaaccatctgatctttgacaaatctgagaaaaacaagcaatggggaaagagttctctatttaataaattgtgctgaaaaaactggctagccaagtgtagaaagctgaaactggatcccttccttacaccatatacaaaaattaactcaagatgcattaaagacttaaatgtaagacctaacaccataaaaaccctagaagaaaacctaagcaataccattcaggacataggcatgggcaaagacttcatgattaaaacaccaaaagcaatggcaacaaaagccaaaatagacacatgagatctaattaaactaaagagcttctgctcagcaaaagaaactatcatcagagtgaacaggcaacctgtagaatgggagagaatctttgcaatctactcatctgacaaagggctaatatccagaatctacaaagaacttaaacaaatttacaagaaaaaaacaaacaaccatatcaaaaagtgggcaaaggatatgaacagacacttctcaaaagaagacatttatgcagccaacaaacatatgaaaaaaagctcatcatcactggtcatcagagaaatgcaaatcaaaaccacaatgagataccatctcatgcccattagaatggagatcattaagaagtcaggaaacaacagatgctggagaggatgtggagaaacaggaatgcttttacactgttggcgggagtgtaaattagttcaactgttgtggaagacagtgtggtgattcctcaaggatctagaactagaaatacataccatttgacccagcaatcccattactgggtatatacccaaaggattataagtcatgctactataaagacacatgcacacgtatgtttattatggcacctccgtcgccgaggccggagtctaatggcatgatctcagctcactgcaacctcagccttcagggtctgggcaattctcctgcctcagcctcccaagtagctgggattacaggtgtgtgctaccatgcccaactaatttttttgcatttttagtaaagacagggtttcaccatgttggccaggctggtcttgaactcctgacctcaggtgatccacctgccttggcctcccaaagtgctgggattacaggtgtgagccactgcacccaacctgaatatacacatcttaaaagcaaaaagaattgcataatcttcttaaactgcattcagtagtctttttgttagtggttctatggtaatgttattcggaaatcattatatgcacattgtaggatacaattaatacagaatgatattaagatctctaggagtcaagattcattaaaagtgggtcaaccagatcatgtgtgcctccagatgtgatgcactaggaaaaacacaacacctctatgcaatattattgtccacacaaaatgttggtaggggggaacctgaatgaaatcaagcatctagatttaactaccagcttgcatgaaatacgggaaacagagtaagtaaaatgacactagaggaagcattgagaacctgggacattttacaagacaaattacccgtttccttcaataaataagtcgcatgcagaaaaaataagacaaggagaattcttgtccattacaagagatgttagataaataacaaccaagtgcaatatgtagactctgtatgaattctgatttgaacacagccacatgtaaaaagacatttttgagacaatctgggaaactaaaatatagaatatgaatctgaatataatcaggactagatgacattcaggaattattgttatttattcataagacagtggcactgtgtttctattctctaaaaatataatctcctattagagatgcacactacagtataatataatttctgggatttgctttctaatactccagcaaaaatggaggaagagagaataaattaacaagattggcaaaatgctgattattgttcaagttagatgatgagtgatcattatggtattccttctacttctgtgttatattaaaatgtttccataataaaaagattttttaaattttatatatgctttctcttgtagttagaaggcccatctggagatttcatttcctaagaaatgagaaccaagtctgtgaagttcatttcctccttacaatggttgattctttcatcttggaatgcttgaaacaatgaaattgtctttccttctactattatgagagcagttcctactttttctttactatttggcttactcacagtttcctgtattcactcgtctttaagtagagacatatttatcctttataaataggcaatgataaaagaaaaacttcagccgaattaaatgtaaaggaatttaattgagcaatgaataatttgtgaattgggcagcccccagaatcacagcagattcagagagactccagtgcagccacatggtggaagaagattaatagacacaaaaagggaaatgatgtgcagaaattggaagtgaggtacacaacagctggactggttacagattggtgtttgccttatttgaacacagtttgaacactcagcagtgtatgaatggttgaagtatggctgctgggattggccaagactcagctattgatacacgtgcatactcctagttaggttttcaatcttgtctatctattaagctaggttgcagttcgtccacaaagactcaaatatagaaacagggaatccttctcaggccacatttagttcactttaacaacttcccccttttggtcattttctcaattttgagagattgaccaaaactttaattatcaatgtcactatcaccattgtaaaagtacttatttggtcttgaaacatactgggaaacagtagaacattgagttttgcaaaggtaaaaacaagtatgagtagagggaccctttatgggtacctctttatgctggaatgtcctatttacaggagaaaaacaaaacctggtctgttctaggatctatgtgtttccgtaaagtcttagtttgattatgtcacatttagcataagtgaccccattttagtttggtttggcctgttggggcctagtgaatgagcttagtccaaaacagtggcctcccacaactttgtttaaaaaagattcccccctttttggtcaggttctcacttaggtgaaagtgtgaccaaaacttagggccttagtgccactctcagttaccatcattttgggtttccagtctcaccacgtcattcataggttatagtaatctcatggtcgcacatttctttcagctcgtctttccatttgaagagagaccatttgacattctagaggtggctgcatgcaagatttaaaaccttcgagagaatacagtgcaccagggagactattattatgactctcaggaggataataccaagagtttagagtatgctccttacccagggtacccataaaccgaaccacctaaaattaaatagattaaagaatgagctggataaagagtctacttgctttaagtggtcttttcattaatcatctacaactgaatttttataatctacgtttgatgtatttctccataggccacaagtgtcagaagctgcacaggtacttttctgtttagccaattatattatttagcataactttcacaagagaatttaaagtctgttgtgtaacaataggctttacattagaatctgctatacagcctatcatgagggatacatttctaattattgcctcttttattctaaaccatggaaaaaggacctaacaaatgatgtccttctagaagagtgaaggcctcctggcaatgttctatttaacccatgatgtgggctaagaggagttttgactgattatgaggcgacatatataccattaaagtttctcacctatgttgggccttcatcttttatccatcaaagtataaagttattcatgtataaggctggtgcaaaatccttcacgaataaaagtataccctataagtgcacataatagaccccctcatcatttctattggctacagaggcataaataaggaaaaaatattcaaagataagagtctcacaatagtagatgtcttgatctgtgatctcgggaaaagctgtttacatcaaggatgccatcttattctggggagaaactttcctggttagttttaccttaagggttccaatgggtgtacagttccaatagtgtggagggacccttctcagttgtgagattatgaacttaaagttcaaggttccaaagttttgttgcagtgtggatggcaagcacagtctttctctgatgttctcaaaagatccagtctttaggttctagactgtgaagcagttgattatcctcggtgaaccataaaaactttctttacctggtgaaaatatactgtggcgtaataattactgtagcataaaacatgcattaaaaatgacagttgaatgaactccctttataaatgtttaaatgacccatcggatagccaaacgtacctgatagccaagcgtacatgaaggtttgattgtcttcccaggaatatggaaccaaacattggttttaaactatttttgaaatgtataagtcattatatcaatatattcaatttggatgattttatcttttccatgatgagtcatggaatgcagagcctttaataacaaaagctttaagggctcaggaaggacaagatagccttcctggtcttccatgagtctatgcttaatattggacttatgtcctgttgaataccagttgtttctccaatttaaattcatagcactgataactaatggttatcacaggtaatgagacttagactatggaattcaaattgtatatctaatcaatttcactatcggctggtttaacatgaaaatcttggcaaagtattttcttggtatttaattaattttttgttttacttgggttagcagttctatacaaggaagtttggttatttctgtgatatacaataacttaacataataactataattatggttgacagtatatactcagacatattagaattttataagtcctatacatttttttttgtttgtttttgagatggagtcttgctctgtcacccaggctggagtgcagaggcacgatcttgcctcactgcaacctccgcctcctgggttcaagtgattcttccacctcagcctcccaagtagctgggcttacaggcacccgccaccatgcctatctaactttttgtacctttagtagggacggggtttcaccatgttagccgggctggtctcaaactcctagcctcaggtgatctgccttcctcggtctcccaaagtgttgggattacaggcatgagccactgtgcctggccccatacaattttagaacatacattaatatcattcactaaaatataacctgaagattaaacattatttttattttgacaatgcttcccatgtaacttaacatgttaaataattctgtttacctctcttttggatgcttcaggggccctctgtagcgttccaaagttagaggtcagaaaagaccattttaaagctgaaatttaattttgggaagcctattaaatataaagatatatatataaagttttaaaacacttgatattatgaactagaattccaggtcactgtaagtcactcacttagccaaaatgatgactcaaaaaattttttaaaggcaaaaacctttactcattgatagagggaagactcagctttccaaacaatctgtcttttgtctttcctttcttttttttttttttgatagtgtatttaaaaggcaaacaaaacaaaaatctttcattaccttttaatattacatgaaaatcttgttcaagagagaaagccaaatttcacccttgcattagtggactattaatgtcaaccccaatttttaataaaacctcacagacaaatctatctaatcttaatcagtttgaccataaggtgagattttcataaaccttttataaccctttaccaatttttattaaagagcagattagtgctttaagaaaaccctattatgcttttatttcaatgttcaatttacagaaaaactgaacaatacacttttaaatttagtcaatattttcacacacagaatttcttttacaaatttttacaaaccttccacaacttgttcaaacctttagctttattctatttaatttaaaacaatcctttaacccattaaactaggtaaaaatttacattcccatgcattcttataatctcttaccaaaaacatgtttcattctcctcacacaccttgcgtgtaaacctagtttttcagtagtctcaatcacatgttataatggtaattcttagcaactttcacttttggtgcataaattttcttttatgaatcctttcacgacttacacagaccatctacaacatgcttggtctttctgacttgtcctaaacatccctctttttaaacaaccagtcattttactttaggacaagaatttactctacaagatcctttcttatataaaatctcttttctttataaccttcttttcatagctaggtggcatggctaattccacatatccccaggacttatttagaatgtaatgtctccaaaataaattcaacaattttcaaaggtcaaagcagtttatggccttaaacatattaagcaaacctaatatctgacctgcataatttagactaaatgtctttattttatcaataatctttaaagctgtttatatttcccaaagatgacttaagttacatgaactaaaaagcattacagtttttctttcaaaatatttaagcacttatttttgtttaaaccaatgaattagagttcttttatacaaacattacacacacaacacatatataactacacagacaaaccaaagaagattactacagtagttgtaagattttccattcaccagtttttaagtttcttaattagattactggctttggggtggagtcctcgcaagaacagggccaagaaaggatctctggtgcctcctgtttttcccaaggagtcccaggctgtgagagcttgaatatccacttttaattaagctgacttttaaccatagcactctttaataaagtccttttaaaatttcttattacccgactttagccaggccaaagagctgatatttctggcttttaaactttacccaaggtaacctcacaggtgctctgagaaaggaaaattcaagacagttggtggaggggaagagaatcaaaaaatggcaaaggtcacccaaatatcaatcagaaaggctcatcccctaagctagggattgaactctgaacccaggccaccattgtgaaaagagaaagcatagccacgtggctacaaggtcaagcgcctaagcacataactgaccagtttgctgggtcgtcttgaacaacaggcttatgaggttttgggcacacattttatcctaaggtacccctctttatgacagaacaatacagaaagacacacaaagcacatcagattcactacagcttaagagaagcctcagaattttttttgtatcaatcaaaactttacacgggagataagagtaatttttgccattcatttaaccattttgcacaaagaaaaagaggaaaaaagccagaaatatgactggtaagaaattcttacccttttactagcatgccaggcttctgggctttctttccctttccctgagcagccctagcgtcccagcttgccacaccatcgccctgggggccaagctgcatcataaaggaaaattaacttttttcgttttggccagaacaaaacacatatgataaaacatagacattagccactctgcttagcacccaatatcaaactggtaaggcttaaatttgccttcagatggcccctgtcatctttaatccaacctccaactaggagtttcaacacatggtctctgggcaagatggttgccctgagtaacagaaaagataggaaaggaaaggtagagaaagaaaagtattgcctgtggcaaggtggggaaggtgaagagctcagggaggccagagcaagacccactcattgcaatgacactgaaaaattcaggcggccacttgtcagtagtgaaggcatcttttccagcaatcccatcagctctcaagtttccccttttggggaggaaaaagcttcccatgtcccatggtcctgtacatgcctaatactgtcacctatagccgtcagcaaaaagtacaagacagattaatcaaaagagaatagcagttaacatcccatagcgccaaacctgttcttaactgaaagagactttactgagaaccctcatttttaaacacacttcattgctttgttgctcatttggaacattccactgtaagttacctttagtaagattttgtcatttctctaagactatgctgcctcccaggcctaatgtataagctggaaggaacttagttttccagaaattaaggatctcatttttacctaaaatattggcttgattctcagggtctcttgattaactgagccaatgatttttcctacctaagcatgcaagaaaaatgaaacaaaggggtagaacataaaaattcctgtgaattttcaaaagccaacttttataacccctgcaatattactgcttactatcagttcctttctgaaccagtcaggtgtaagagacctctaactggatccaagccaattaattcccagatcaaatccattcctggacccagctgagtttctgtcgtgacttccaaaccctgtttggatcagaaatttgctcaaagaaactcggagagctcaaaacacaaatccatggagctctgaaatccgagagagagcttacccacgatccccagctgctctgagagatcagtgaacacaagtgggtcctgcaggtaccttgtttgttcagttcactcaacgctcctggggtcgctagaagctctacctcagatcccatttctgacaccatctgataaaagaaaaactttagccgaattaaatttaaaggagtttaattgaacgatgaacaatttgcaagtcaggtagcccccagaatcacagcagattcacagagactccagcgcagccacctggtggaagatttataaacaaaaaaggggaaatgatgtacagaaattggaattaggtatagaacagctggattggttacagattgatgttttccttggttgaacacagtttgaacactcagtagtgtatgaatggttaaagtacggctgctgggattggccaagtctcagctattgttacaggcacatactcctagttaggttttcaatcttgtctacctattaagctaggttgcagttcttccacaagaactcaaatacagaagtacagagtccttctcaggacatatttagatcactttaacagcacatattggcagtcctcactgtgcagaactgtgtagtgtaagactgaaaaaccctgcaattaggcaatccacaattaatgggaaaaattatagttattcataacctttgaagttttttgttgaaacattaaaaatcattttactgccagttataacggtatggaaaaccacataggaaaggcatatgaaaaaaagtaaaaccaatattcatttagtatactatacattttttttaagagatgaggtctcactatgttgcccaggttggtttcaaactcctggcctcaagcaattctcctacctcagcctcctaagtagatgggagtacaagtgcatgccactgtgcctggctttagtgtatatactttaaaatatcaaaaatattgaggactaaagtgttttgcttctttgtaaaaaaaaaaatttcatttttctctgacggtggaggagaaattaatgtggatccaacctaggttgagccctctaacaagcaaccctaggacacttggagattcacattttcatgtctaaccttaacaaatattttcgtcattgcttttgcaaagtcatatctcatttttattatttccaacttattatatgaagtggacaccttttctatgccttggcaaactgtcataactctaagtttggatcagcttctaatattttaacttttgcattttcaacatcatgaaacatctctgacaattccttttctttttttttttttttttgagatggagtttcattctggtcgcccaggctggagtgcagtggcacgatctcggctcactgcaacctccgcctcccaggttcaagtgattctcctggctcaccctcccaagtagctgggattacaggcacccgccaccacgcccagctaatttttgcatttttggtagagacaggatttcaccatgttggccaggctggtctcaagctcctgacctcaggtgatccacccgcctcagcctcccaaagtgctgggattacaggcgtgagccactgcgcccagccgacaattccttttctaataaaactttaggtttgaagtagctatgatgtctcttgaaattctctacaggttttttgtttgtttttgttttgttttgttttgttttgttttttgagacgaagtcttgctcttgtgtcgcccaggctgaagcacagtggcgcaatcttggcacattgcaacctccacctccttgattcaagtgattctcctgcctcagcctcctgagtagctgggattacaggcacccgccaccatgcccaactaatttttgtacttttagtagagacagggtttcaccatgttggccaggctgctctcgaacttctgacctcaggtgatccacctgcctcggcctcccaaagtgctggaattacaggcatgagccaccgcacccagccagaattctctgcagtttttaagtgattccctacgggcttctagctggacactggacacagcctgattttatataaggtctttgtcgtaatattgacaatagggtttaccacgctaaatcagtggttttcaaaaactttagcatattttagcaatagttgtcaagcttttctcaagcaaaatcatactgaaaccaaaactattctggagtataggagtaggcatacacaacccagaatcctgtcccctaggcctctccctcagctcctgaggttgtccccaaacagctccaaaaacacagtaatttgcagatatctgcactccataggtcaaaagtctgtggttaataaagtactataaaaacacctacacaccatgatgcagatcaagtaggatgggatacatgggttctgcccagtgtactggcacctcagaatcatctcatccctctaattctgtttctctgttgcagaccactgattaggatccagtgttactctccacccatccttctaaacagatgcctcaaattgtttttgcctctcagcccccaccttgaacatggctttgattccacttttcaacatccaacttcagtagcaactccaagtcctgcctggacctaccagacaacagccctgtaatcaagagatatcatgcacgggccaagcacagtggctcacacctgtaatctgaggctgaggcaggtggattgcctgaggtcaggagttcgagaccagcctggccaacatggtgaaaccccgtttttactaaaacacaaaaaattatattttagtggcgtggcagcatgcatctgtaatcccagctacttgggaggctgagacaggagaatcacttgaacccgggaggtggaggttgcagtgagccaagatcgcgccattgcactccagcctgggcagcagagcaagactccgtctggaaaaaaaaaaaaaaaaaagagagagagttatcacacatggttccacacatatctaatttgtgttagtatttctctcttcatgtgccttttgctctgttagcctctcttaaacatttatctttgttctaaagtcttcatgtcctaaattacttccttgccctctttacaggatcaaaactagctgctggtaccagttttcagtaacaatgagatctgtcttttaagttggatgtcaataatattttggtcatgtcattacgagcatgattccctgtaacctaatctgagaaggcagacagcagagagaatgggcggtggaatggaacacagaaggaagcagattagaaaggaaagaaaacatcctcttgtaaagctttccataattctattttcatctttataaagatgcacgagaggagaaggaggagaaagaggaaagggggaaaacttaatggaaagattttataagagaaggaacaaatgcctttgtaaatactttctggaaatttgggaaggttactatgaatgtggctttgcatgcgtctgtgtatgtgtgtggctattccttcacttttctcggtgcccccaacaacaaaaacagtctgacctcacacctcccataaatataaaatctacttggaaaattccatcgaagtttaaaatatatatttgcgtattcttgattactaataattaccagctgatcatccaattcaaaaagttgttccaggtaagtttcagacaatcttcgaatgtttggtttcattgatggagtaatgcacatatccctttaataacatcataaaatacagtcaaaattaatttcattaattagttagttccgtaattaaatcagtgattcttgtaggtggaatgaaagggaggagaaggaaaacacatttccccttaggagaagcagatcagaatcacctggaggactttttcaaactactctcgcaagattttgctgtgtcccccaaaggaggatatgcctccctttcctctttcccaacttgaaataaaccggccctatgaacacgttactgataagaatacaccgtatttctcaggttgagatctagtgggcaaattattcaggtttgcgtctttgaaactgaaaagcctgtggagggattccttaacaatcttgagattggaagcattcattggcaagaccttattttgttactatgcaataaaagttttccttcaaaataaaatatttccctatcaaaaatcaaaacaatacttaccaaagaagattctgaagaccacttttgattataaccatgatcattccctctaaatacctcagcggatcctcaggacatgtaacaagtataccacataacagtgcctaggggaaaaaagggaaatggcatcaatgtttctgaattttcacgtttttactaagcagcacgtaactttttattgttcaatttgttttgggtttttttggtttttaattatttatttccataggtttttggggaacaggtggtgtttggttacatgagtaagttctttagcggtgatttgtgagattttggtgcacccatcacctgagcagtgtacactgaacccaatttgtagtctttcatccctcaaacccctcccactctttcccccaagtccccaaagtccattgtatcattctatgtctttgcatcctcatagtttagctcccatttatgagtgagaacgtataatgtttggttttccattcctgagttacttcacttagaataatggtctccagttccatccaggttgctgtgaatgccattaattagttccttttcatggctgagtcatattgcatcatatatatatgatgtgatatatatatctcacaatttctttattcaatcattgattgatggacacttgggctggttccatatttttgcaattgtgaattgtgctgttatagatgtgtgtgcaagtatctttttcatataataacttattttcctctgggtagatacccaatagtgggattgttatcccactactgatcaaatggtagttctacgtttagttctttaaggactctccacactgtttactagtttactttttttttgagcagagtcttgctcttgtcgcccaggttggagtgcaatggtgctatctcggctcactgcaacctccacctcctgggttcaagcgattcttctgtctcagcctcctgagtagttgggattaaggcatccaccaccacgcctagctaatttttctatttgtagtagagacagggtttcaccatgttggccaagctggtcttgaactcctgacctcaggtgatccgcctgcctcagcctctgaaagtgctgggattacaggcatgatccaccatgcccagcctagtttacattttcaccagcagtgtagaagtgttcccttttcactgcatccacgccaacatctattttttttttttattttttgattatggccattcttgcaggagtaaggtggtatcacattgtggttttgatttgcatttccctgatcattagtgatgttgagcattttttcatgtttgttggccatctgtatatcttcttttgaggactgtgtatccatgtccttagcccactttttgatgggattgcttttttcttgctaatttgtttgagttctttatagattctggatattagtcctttgttggatgtatagattttcgcctactctgtgggttgtctgtttactctagcagcagcaaactttttcttatacagttaaaaagtcaaataatgtgacagttttaaagtaaatgtgtttttacatacccctctgtatttattcagtgttaatattctgctaaagtaaaacaaaaatgcagtttatcttgcctctttctaaaaatccatcataaacaatacaataaagtcactgtaccgtgagggtttgcattacttgaggagtaagttctttatagccaatctgaagacataactatgatgctttacatcagggttttctagccttttaaagtatgagaaactcattggggttggggggggttgttttgttctgttgttttgttttgttttgtttttgttttgccaaaaagttccttagacccaaccataaaagagattgagaaaatccaccattaaaatgtgtgaatttaagaactcttaaaaacacatttgtattttatcattcacaacatctaccgagtatatacatttgaaaaattgtagcttagtacacataggtgggaaacaatggacttgctggatctaagatactgtttaaagcacatatgtggaactcgtaaagttgctgctgtctcattttccttatgaggtccccccaaaagaagaaacttcttgttaaaagtgtctgcaagatatacagaattactgatgttttctccatttgagacagatgaaaaggtctgcagcacacttcccacagaaaccacctggaattctccatcggcatttctctttccctttgtggttcactgttttctggtggggtctagtgtgcatgttgggggtggtcgggatgcttcagacccactcctgctggcttcttctcttgatcctctatttccagaataaaataattccatcacttgagttacacagagcagttctccctacctccataggccaagtgtcagcagatctaggcctggggtcttttcttagactctcagcaattctcatactgttcctccaaaactaaaaagggtaatttctcctaattggaccctgcataataacaatctccccctttgcaatggctccatgctcctcttcttagtgtacagccttcaagcaggaagctcagtcctttagagaatggcagaaaggtaagatttagatccctctccctctccagctctgccttcagaccaagcccatagtaactgcttacaagtgctcagccacctgcagactgacttccttttcccccaaaccaagagactatagttgcacaggagattagtggtctcaccacagttgcaacctgaatttggacagtcatctattacctaaagagccagcaagagtgggtcctacagggacctaacaaaaagggctgaagccatctattatctggaggccaatcagacttcccacagctccctcaatatccttggtgaaaagcccatctgctctctagcacttctgtgcctgggtctccagagtactgagtttttgtattcctcactctacatccttttctccatcttattctggcaccctgaggacatctatatcagaatcacctggagaatgaatttgtctctgagaatagggcctagaaacctgcattttactaagctccccaggtgattcctatgcatactgatgtctgagaatgagtgcctaaatgaagttcagctttatggtacatttttaagaaagttgagatctggttaatgtatgtgagaaattgattatatatatatttccaagctccacttataataaactacttttcctgaaaagctatcctgcagaagtcaggttgagaggataagtctctgaaatgctaataaaggcatatggaactagcagagttgaaatgcacacttttcacataggaaatctcactgttggccaggtgtggtggttcatgcctataatcccaccactttatgagaccaaggtgggaggtttgcttgaagacaggagttcaggactacccggggcaatacagtgagaccccatctctaaaaaatacaaaaattgttttaaaaattagctgagcatggtggcgtgtgcctgtagccctagctacttgctaggtgggaggtgggaggtgggaggattgcttaagcccaggagttcaaggctgcagtgagttattatcacaacactctactgcagcctgggtggcagagaaagaccttgtctcaaaaaataataataaagaaagaaatctcactgtttgtctttttcccttggacaaaatagcacagcatgatattttttgtattaatgagtgaacagcgcatagctacatgccaataagacagcagttaatgaatcaatagctttttccctgcccaatgaaaataaaaatcacaaaaccattaacttagtctttattgtaagcagaagcaaaataaacattcccataagattaacgtttgactctcaaaaacattaatcagggccttattattaataatattctcagtaaaaacttacacaatcaaggacaaaaaagtccatgagttaattattggattagctctctcaagcttgtaaattcacaaagcaattacgtaatcctcagtttcttttggctctacttccctacactcagttcccaatatttctcatctattctgaaggatgttctgggtcctgaggacaaacatgggtttaaccaggactgttgcttccactcctttctcctgctacctatctttcaaagagcaagataatgcaaagggtggagtccacttggtttaaatctgggatctgcaatcttctaccatgcaaccattgacaaattacgtctgtttccgtttccttaaaaaagggggataataaaggttcatacgctatagggctatcatgaaaattaaaaactgctttgaatagtgtctagcacaaaataggcattcaacagataatgatagcaagatattttatatatatatatatatatatatatatatatatatatatatatacttttttttttttttgagacaaggtcttgctctgtaacccaggctggagtgcagtagcacaatcaacccagtgtaacctcaagctcttgagctcaggcaatcctcccacctcagcctcccaaggagctaggactacaggcatgagcccccaaactcacttaattttgttgttgaaatggagtctcactctgttgcccaggctagtcctgaactcctggccttaagtgatcgtccttcctctcagcctcccaaagtgctgggattacaggcatgagccactgtgcctggtccatcactatttttaaccattccactgttaattatcaccttaattagaggaaaacacttggacatagagaaaataaattgaaaatattcccttgtaccactcaaagtccagtgtgatgactgagagagaaagacagagactgactctgacttaaaccacacctaatagaagatgttaggacaaaagcatttaggggaaaatggctaggagagaactgaatagaccaatagttcaaatataaatagcaagatagtaactattataacccttggtggacacacaaaaacaaatgtaagacacttaagagaacaagtcttgcttagctttttagatactcagataaacatagtgaaatacgctgagggctgaaatagtaatattataatataaaaaataattactccaaaagtgcagagataaaagtgattatcaaatacttggggaaccctcagcaggtgaagaaacagaaaaacattgttcaaagtcccttccatttccctatcccctaccccaacctctgaaacatatctaaagcagtatctcacaaatgattgccatccccctgtgggacggagatggaggtagcacgctgttgttttgggagatatcttaatttgtatttatggaagttagtaagtcacaattttgaaaataaaggggcttttatgtctttttaacattgaaatagatggtgtcaaaattttattttagaaactctataaatgaatattccggaagattactgaaagaggccaactagcttcaacattcagatgagaccccaggaagaggaagatgcccctcaggaccagacttgaagggttttttttttttgtttttttcttttttgttttttgttagacttgaaggtttttaaagcagactggacaggacaggtgaggagcagcaggctctatgaggtaagagtgagacaaaggactctgatacctgccggactgggcctgtcccagaggggaagcagtcccagccgtctcatcccctctaagaaaattgttattggaaaattaataaatcatgtgcttttctttgtttagtgtcctgtggatttacctcaggaactacacgtgtaaactgcctggctgggctgagggaattcagcaaaggtaactgtcctctggagaagccacagccttcctgcccaaggtccagcaaaatgagttagtgtatccagctcctcctctcctaaatgggcagggcagtcccttgctcaagaatcagcaatttctgattcttgcatctctgacaaatacgtgcagcaattagtctcttaaaaaaaaatacctggcccagcacggtggctcacgcctgtaatcccaacacctgggaggccaagacaggcagatcacgaagtcaggagattgagactgtcctggctaacacggtgaaaccccgtctctactaaaaatacaaaaaattagccaagcatggtggcaggcgccggtagtcccagctactcaggaggctgaggcaggagaatggcaggaattcaggaggcggagcttgcagtgagctgagatcgcgccactgcactccagcctgggcaacagagcaagactgcgtctcaaaaaaaaaaaaaaaaaaaacctgattggcaacttaatcttgaaagaaacataaaacataaaaacttctcagaaaaatcataattaccaaaaaaaaaaaaaaaaaaacaaacctttgctttaaaaccataatttgtagattaagtactccctctgctgagcagatctggttttgcaaactcttttcatcttccctaaatgctaaactgaaattggagctcaccatttgaagagtactttcttcctctcagatacaatcactaggtgtatctgcttaatgtttttgtagaccataatatctagctcatctttggtccctgtggggcagtccttgtttgtctgtaaacaatgtactgacttctacctagtagaaaattgagggagaaactagggtttctatgttatttctggatgacccactgtctgaaggtctaccaataaggctttattatatgagttcctatcttaataatctctttcaaaacacaaatgcctttgggaaggagtatatccaaaaatagagggcacattaagctaattcccacagtggtggaaagagtatctcagagttctgagagacagaaatgaagaatacaaggagagtgagggatcgcaaggcaatacttagttttcctacaatttctacctatcttcaggtgacttaaaaaaaaaaaaacctctgaatttctaaaatatatttttcctgaatcttaatgatgaaatgtaaatatcttcatctctatttctccaagatagatttctatgaaaatatagaatcaaaaggtatatattacagatcttcatacatatctcaaaactgttttcccaaaaggtattatcaatgtataatctcatcccaaatggataaatgctcagagagctcaggagacaagctcaggctagggacagcctcagagttacagctccaagtggttgaagccattgaggtgttttcaactagcacgtggtagagacccagcaaatatttgctgatagaatgtcctagtgtatccccctcagctgaccactcttgctgttccccaggagaaaagactggctggtgtcaagagcctcatctgttcaaaaaattaagttacttgtttaacttgaattgaacatagaatccagtagtctttaagttggacatgtgaatctccaagagcccacaaagacttttgaaggattacatgggcaagaatagtataacggagtccactttcagatcttcacctttcctatgcaggttggccttctatatccatgggtcctgcatccatagattcaatcaaccacagatcaaaaatatttgaaaaaaagttttatctgcactaaacacatacagaatgtttcctcttgtcattattccctaaatgaaacagtataccatctacttacatagcatttacattgtattagatataagtaatctaaagatgatttaaagtatagaagaggatgtgtataggttatatacaaatgctatgccactttttatcagccaacatcagtctccaaggaaggtcttggaaccaatcccccatggatactgagggattactgtattctttacttaaactgatctgcctgaggacacagtttgctattttctttttctacttttctctttcacaatggctcttcctcccactctagaaaataaagccctctatcacatccatctggaatcttactataaagaaaactgaagcagagagatttggaaattttctcagtcacccagttaacaattggtgaagcctagaatcaaacttaggctttttttttttttttttttttctgtagagacagtctctcactatgttgcccaggctagtttcaaactcctggcctcaaggaatcctcctgcctcacactgccaaagtgctggaattacagtcatgagccatcatgtggggcctaggaaggtcttacaaataagaaataatcccctcatcttgcttcagatgctttaggtttcaagtaacaaactcaacttaatacgtactctattagctcctacaagaaattcaaaggtagatgaagcttcagtgtgggtttaacccagtggcttactgatgtcactagggcctggtttctttccatttccccaactggccttttgtggaatccacttcatgctaaaattctctctccttgtggccacacaggtaattgccaatgttcccaggactaagtgcttccccatcaacatccagagagggtatatccaaccagcatcctgatctaaatcagcttggattacatattgccctcccccatgaccctataccttctgcctccctgtcgttacaaacattatggccagggaaactgaatgcaccggttgttgcaagccagttggggtccaaccccagagatggggatagacagttttcttgaagcaaatgggctaggtgagggaagagacagcgtatagaataagaatgtaggaaatattaggaagagggaagtagatgctacgtaggcaacttgtaaatgcccagtagacatctgctcctggagaacatgggaaaggaagaagaaaagggggtaattacagtaattgagatccacttactgagtgatgctgttgtgatctatatctttttagagactgctttgagatccaacttgatctgactccccttatatgaacaagccaagtatggcagattatattttccacaatggccataacagtatctcccatcctccatgttctttttgcaatgtgcctttgttatacctcccatcatgaaatgggttccatgttccctccccttgaatctaagtgaaaataatgttgacttccaaatctagatcataaataatggtataacttctacctggttctctctggggaggtttggtcttagaaatcagctaccatactgtgaggaagtctaagcagcccatgggcaggtccagatgaagaggaaccaagcctactggttcacagacctggctgaactcccagccaacagccagcaccaacttgctaggcatgcaaaagaagatatcatcttaaaagtggatcttccaccccctgcaaaaccttgccaaaatttcaaatttttaagcaaactaagtgattcctgttgttgtaagccaccaagtgctttaactggttgcatgtcacatggcaatagataattgacacaccaaacaaacagaaaatgactacacagccaaatcaaatctgtcattccatccatccctagcaacatacattctgaaaaaaaaagcctagccataactatctttcattttagatttttaaatttcaaacatttagaaacagtagtatagggaacacttatgtacctatcacccagtttcaacaataattattctgtgatttttgtatcatctatatatctacccatttctacctattctcaattataatttaaggtaaaatttatattatttcaaatgcataaatcttattagtataattttgataatgaaaatacccacaccccgggtgtggtttctttccaactctccggaaagttctcatgtccctctccagttaatcctcctgtatcactcagagtccagtcaagagacagaaatcacacccgtgttttgaataaagaacaatttattctatctcataaagagattctaataaagaatgcaattcaaagaattactaactagtaaaaagagagtaactactaagagcaaaagagaacactaaaggacaccctgtggctcagacagagtacccaaagatgaaataaccttggaaggagggcagccacctccccaaggctgagattcagagaatgtggagtgtggctgaggtatagtggggaagtccattaggttgccctgagacagagatagttctcagccatgatggtccaaggcttggtgaacaggaccccaccagctcacactagtgagcagacgccccctgctggggtgccaatgggctgaggctggtgagcaaaacttgctgaagagtgggcaccactgggtgcaccacacacatgctcctggaagctgtgtcatgtgaacaagaagtgaggaagcacacaggaaccaggaactgaagtccctctccctccagggtccctccagcactgacaaggcttaacaacatgctagcccaaagcaatgccaaggtctagatcatgacaccagtccagcttctaggtgtcaagggctacttttctcctcctcaatatttctgcagtattataatcagctgtctagttttatggggaaaaaaattttagactttaactaaaattgcattgaatttatacattttctgggaagacattacatgttgttattttcccattcataaacacagcagagtacttcatttctttaggtcaccttaaacatctttcaataaaattttacaaattcctccaaacaggtctttcacatcttgtcctaagaaaccttatattttttgtggctattatgaatgtaatttctttttttttttttgagacagagtcttactctgttgcccaggctggaatgtagcggtgcgatctcggctcactgcaagctctgcctcccgggttcacaccattctcctgcctcagcctcctgagcagctgggactacaggcgcccgccatcacgcccagctaattttttttgtatttttagtagagacgaggttttaccttgttagccaggatggtgtcaagctcctgacctcatgatccacccgcctcagcctcccaaagcgctgggattacaggcgtgagccactgcgcccagcctatgaatgtaatttttaaaagctactgtttaaaactttggttctagtgaattgaaatgcaattgattttttaatattcagtggaagaattttgtgaggatttttttttttttttttgagatggagtttcgctctcattgcccaggctggagtgcaatggcgtgatcgcagctcaccgcaaccttcgcctcctgggttcaagagactcccctgcctcagccactcgagtagctgggattaaaggcatgcgccaccacgcccagctaattttgtatttttagtgatctttctccatgttggtcaggctggtcttgaactccaaacctcaggtgatctgcccgcctcggcctcccaagaatttttttttttttgtctactctttcactgtgggtgtaatggaattgtcagaaactgaaaatactaggaaatgtaggactatggatattgagagcccatttgacaactgaggattgaatttaaagtgacacaattcagtttaattgtgtgttcttcctttaaataatgttcagttgctcaggggtaagcacggactgctggatatttgagttttaccagggatgggtgtttgtcacatcaataggacagagggagaaacaggtaaaggagataatcgtatttgaaagtgatcataatgatggtgtggtggcattttaaaagcatgtctgcaaatgatatttcttacataaagaggtggggtttaattcctctcctcttgaatatggattagtcttaataatccacttgtaatgaagagaatacagtgaaagtgatgttgagtaacttctggggctaggttataaaaggagattttacttggctctgtctcttggacacctgttttgggacccagcctccacgctgtgaggaagctcaagctacatggagatgttacacatagatgttctacctgtcagtctcaggagaggtcctcatcgacagccagcatcaactgccaggcatgtaggtaaggaagccttcaagatgattttaacctcagccactctgacatgtaagtgcatgagggatctcaagcaataatattctgtcaactcccataactgtgagaggcaataataaaatgaatactgttattttaaatcactaaatgttgtaaagacatttaggtaatagacatccacaataatgatgaaccaaggaatctaagatgggtaaagagagaaataaggacataagagtaatatttgacagtgcaaagataattgaatgaaatggtggtttgagtcagttgaagaagtgctagtgtagaagctccaatgtgagtgagctaagaaattaagagataagtggatgaagaaatggagatttcagagatggtacagcaatttaggataaaatggttaagagtatgaccatagaaggacatgactgaggaacggtgaaagcaaagataactggaagaaaggtcaaggatgtgaacggaacatccctgtgaatactgcgggcacaagaacaatgacaggagtagagaaaaaggaagatggtgagccagatgctaatgctaccaacaaaacatagagattggtacataatgaagacagtgagtgctaaatctgatgttatgaactacaaagaagctgagactttagaaaaaggagggaagatacatagtttggaagtggaaatggggagccaaggaagacacctaacctatctctagatctgaggtaaactgaggagtgaaacaagacagtctccctaggatttcatatctgagtaggatgtggaaagtcaccatggtccaatgaccctgctacaacaactagaaaaaaacagacacattacaaaaatcacatttaaaaaagatattggcgagccatggaattccaggggaaggaaatttttctgaagtgagctgacaatgcacagctgctttttttccctgggaacgtgtgccagctctgggtaggaaagaggacagggctgggcccaggcagagaaagtctacaaatgggaagagaaaccaataggcttatggtggtggcacgggggtaacatgacaggttagaaacttgaggtgccccaagtgtggccactgtctcccataaggcagtgagttctgggagtgttcacacaggaggctgaggagctagaacatcaactcctacaaggcagagtgagtctttcataatctcagggaaggaagaggaagcctgcctcaaacatacagccagcataaccttcaatgtacttgccagattttaaagttgagggcccacggccaccacgccatctgggaagtaaggagcacctctgcccagccgccccaccatctgggaagtgaggagcgcctctgcccggccgccccaccgtctgggaagtgaggagcacctctgcccggccgccccaccacctgggaagtgaggagcacctctgcctggctgtcgccccctctgggaagtgaggaggccctctgccctgccgccccactgtctgggaagtaaggcgcacctctccctggctgccccacagtctgggaagagaggagcgcctctgcccagccgctgcaccttctgggaagtgaggagcgcctctacctggttgccgccccatctggaaagtgaggagcgcctttgcccggccgttgtgcaaccctcgaagtgtgaagtggcagccttgtgtgtgatttttatgccctccccaagtttgcatttttgatattaaagtttacttttaaaagttttaaattggggaatatatatacatatataaaagttgagggcctagaagggaaactaaagagctaagcttaaatacctccgaagagcagaaccaaatctctcacaatctttcagtctgaggagacagagactggctagcttctcaatcaaaagcccagaagagctatgcctgaggaatagggatgaaccagatgtaaaccgaacccaaataaatccacagtccaagctcaacacagatcagtcccttcctggactgaggtcatgagctctgtaccctatacagaggaaaggacgaacctttgctggcgaaagagtatatcatctggaacttctattgttcttttctcacacaatgtccaataaaaataagaaattactaggtatgggctgggcgcggtggcccacgcctgtaatcccagcactttgggaggccgaggcaggtggatcatgaggtcaggagatcgagaccatcctggctaacacggtgaaaccccgtctctactaaaaatacaaaaaaattagccgggcatggtggcaggcgcctgtagtcccagctactcgggaggctgaggcaggagaatggcgtgaagccaggaggcggagcttgcagtgagccgagatcccgccactgcactccagcctgggcgacagtgcaagactctgtctcaaaaaaaaaaaaaaaaaagaaattactaggtatgtatgaaggcaggaaaatgtcttgaattatcaacagaagaaaataagcaatagaagcagacccacaaatgatctggatattcaagttaacaaacaatgatttaattttatgtatttattttatttatttatttttttagagacacagtctcactccatcacccaggctggagtgtaatggtgtgatctcagctcactgcaacctctgcctcctgggttcaagcgattctcatgcctcagcctcccaaatagctggaattacaggcgtgcaccacacctggcaaatttttgtatttttagtagagacagggtttcagctggtctcgaactcctggcctcaagtgatccacccacctcggcctcccaaagtgctagaattacaggcataagcaacaaacaataattttaaaataacaaccatcaacatgtgtgttgatccattttgcacggctataaagaaatacctgaggccaggtaatttataaagaaaagagttgtatgcggctcagggttctgcagggtgtacaagaagcatggtgccagcatctgctcggcttctggcgaaggcctcaggaagcttttactcactgcagaaggcaaagggagccagcatgtaacatgggaagagaaggagtaagagaaacagctagagggaggctcttctaaacaaccagctcttgggtgaactaatagagggagaactcactaattatcacaggggagggcacaaagccattcttgagggatctgcccacatgactcaaatacctcccactgggccccacctccaacactggggatcaaattttaacagatttggagagaacaaataaagaaaacagaaaaaggcaaactgaatgaaaagatgcataattctaataatcagaatttatttaaacatcaaattgtcattctagaactgaaaaacatgtctaaaattaagatttcatttgatgtatttaagagtagactggacacagcataaaacaaaattagtaaacttgaaaaccatcaatgaaaaagatccaaacttgagctcaaaaagaagaaaatggggaaaaagcagaagagatcaaaagaggcatgtagaacaaggtaaagaaaaagaaaaaaaaagctaacatatgtacgattggagttccaaaaggaaaagagagaactgaatagaagtactatttgaaaagaaccaagaattttctaaaacggatgaaaaatatctatcaacagattcagtaagcccaggggaccaagcaggattgtttaaaatgttttttaattttttatttttttagagatagggtcttgctccatcacccaggctggagttcagtggtgcaatcatagttcactgcagcctcaaattcctgggctcaagtgatcctctcctctcagcctcatgagtagcagggactacaggtgtgagccactaagacaagttagcttttttttttttttttttttaatttttgtacacacagggtctcactatgttaccgaggctggtcttgaactcctggcaagcaatccacctgccttgggctctcacagtgctgggattacaggcatgaaccaccaagccaggcctgatttttaaaaaaatcagtctctattcaagagatttgcaggaaaatgatattgtaggtagaaaatcaggttttatttaggacaggtagatgaaattcagaagaggttaaatatacagggaaaactttaatgaaaggttatttatgtattccaaggcttgcagaagatgggttttagaaaagtataaaacctgccagacatggtgggtcatgctgtggtgggtcatgcctgtaatctcagcactttgggaggctgaggcgggtggatcacctgaggttaggagttcgagaccggcctgaccaacatggtgaaaccctgtctcgactaaaaatacaaaaattagctgagcatggtggcaggtgcctgtagtcccagctatttgggaggctgaggcaggagaatcgcttgaacccaggaggcggatgttgcagtgagctgagatggcaccactgcactctagactgggcgacagagctagactctgtctcaaaaaaaaaaaaagtataaaacccatctgggaaattgagtcagataaataaatgtacagacaggatatgaggcagaatggaattcatcttgatattctcttagaagaaatgggtaatgagtttaaggtgggtgtgtggggcccagaggattgctcctttgcacttcctgctagtgtgctagcagaggtgagtgaaggactcctcaggagaacatgatcttagacaatggagaatgcatataagggcctcctctatgggtgcagaacaatgcagtaagctggtaaggaaggaatgctttcacccagagggggaactggggactgcctcattgcagctttgtgatgttatagtaactggcggcctagatgagaagaggccatcccttccttgatgtaccctgactctcaactcaagtccatttctgccacctgctccaccgccatatcacagactgagccatcactcagaatggctgcaccctgaattgtaaatataaacgttccactttctgacccccacctcctgtgtttccagctccctcacttaattactccctctacttctcttcactcacctcttagaggagtcttcactttctgtccatgtatcagtatgatatccttttctcatttcccactgagtccttagagtccttggcccatcacttcagatactcaggagcttagctccctaacctactgcctttccattctattaatatatgcctggcaaattcctatcccagacgaagtcaacttggttatctctgtacctacatctgatttactgactgctacttgagaaaatcacacaaccgggaagatgggtaccattctccctacatattttcaagcacaattgtatagaggtacaacacaaaactcactgtaataaattaaaacaatacagctatggacagagtaaaaagttagaattctccatcttttcccccaaaaccattccacaagacatctgttattaacagtttggcataggttctatgcatgcactattgtcttaaagctagatatatacacatatatgtacataaacacatatacaacatatatgaaatcaaatggacagctagagcagaatggacagttgctaagcaacttgcactttttcttttttacttaataatatgtgttgggagccagccatgtggtgtatgcctgtagtcctagctacttgggaggatgaggtgggaggatcaattgagcccaggagtttgaggctgcagtgagctaggatggagccactacaccctagcctgggtggcagaccaacaccccgtgtctcaataataatgatgataataataatatgtcttggaggacatttcttcttagtaggtacagatatactttattctacataatgcctcattcgcttagtcactctaggtcatttactatttttactatgaaacaaagttataatgaatatccttgtacatcctcctgaacacatgtgcaagtatttctctaaagtagatccctagaagtagaaatgcttggttaaagggtacatgtatttaacatcttaataaatatttctcaattaccatccaaaaaagagacgggtggggggtctctaccaaattgccctcccaaccgcctaggagcgttactaccctcaggtaggacctcctctttctttccctagacatctctctccctcattctccacataacgtatctttgctcgaacctcctactgcaccaacatccccatccccactcaaacacgcacattcttggtaaatatctcaccaactatttgtagagaaaaaaagaggtcaacaaaggcaaatgttctcagcttcctacccccaaacctacaaaacctaatgtctatccccttcctgtcttccttccctactcttataacggcagtaggagggcagtccttcctgttgtctaaaggcaatcctggttgagagggtccttaccttcacaaagggctgactacactgaccaaaggtctcagcttccactcttccctccgctaacctccatctattttctgccctcacggctccatggaaacctcaggctcaccttgggcagaatccagctccttatcttaggtgactagtgcctactccctacttctgacaacattcttcataatgccagtctgctgattttcctcctcaggctctctggcacttctttctcactcctccactcctcaggtacttcttgtccaaaccttaaaatctgagtttggggtttccgatctgggccttgtgctcattccccctgggagatgtcacccattccccacgtgcagccaccatcaccctctgttttctctctaatcagcgtcttcagccctgatcgcctacaagtccgaatttgacttcactttctcgcattct

SEQ ID NO: 1533 - DNA, 49547 bp, Homo sapiens
gtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacggttttttcaaatctacctccctatttaatgaaagcatattcattaaatatgaaactatgcatacattaaaaaccaggatttgtttttaatgtgctttagcagcagtagattctaaaactgtgtcttcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtattcctcagttatcacaggaaacttcaataaaatcttacatattgctatgggtattcacgaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagcactggtgacttgtttcaggttacacaaaaaaatccatgatgaaagcagggtaaaagttcagatttagtggctaacgtggcaccacacatacaggtgtgcaaataaattatagagcactgcctgggtagcatttggtgtagaaaacctattttgattattttgtatgaataaagtgctgagactggattaggaatacagaatgggcctccagtggtatctaatccacctccctcccttaggaagggtcagaataatcaagtgaatacagagtccttattaggactaaatcttatgtcaactgactccccccccgccccccaaccactggcattcatactggcttaccaaaagaatcatgcttaaggttcatttaatataaaaatgtaagacatctgaatcaggtaaaaaaaattataaatctgattgatatatttagagctaagagactccaggaaaaaaaaaatgtgtagagaaaattaaaaacaaatttaattcaaagaatatggtctattaacattttgtctgtaaaatatttcattgtagctgtatttgtgcttagaagatcttctagatttaaaaacagaaaatggcataaatcatattctcatagccacactccttcccttcctctgctcagctaaggagagggctttcttttgagacagggtctcattttgtcgcccaggctggagtgcagtggtacgatcacagctcactgcagcctctatctcctgggctcaagtgatcctcccacctcagcctcccaagtacctgtgactacaggtacacaccacctcacccggctttttcttttttctttttttttttccgagagagacgggaggtcaccatgttgcccaggttgatgtcaaactcctgggttcaagtgacccacccaccttggcctcccaaagtaagaggtcttttgggaattgtagacgtgcaatagaatatactgttccctctcatctgaaggctctaggaaaaaaagaatatactgttcttttaaaaatttaagtgaatggtggtcatgggtgcattaatgcgaaagaactgtacacttaaaaatggttaaaatggtaaatgtttaaaatggcaaatatgtatttatatattttaccacaatagagaaaatcaagtctttaaaaatgatagcccctatgtttttatgcttacctaaataaaccatatttaatatttggcatataagctaatttgatagagcaagaattgctatgtttataataagcatgttggactgaatttcatcatttattagaatgtgcatataagaaagatacttgtatttgtaggcctctgaaaaacatctaggtaggtagagagccttgactcaccttgccgaaggtcctgaagaatggaaaaaagaaaaatgaatcttcaatatcggtttttcacctcaggaaattctagtaccacaaaaatataatgttttagtaaaaacatttccattgcagtgcttatatcatgatatgaaatttaaaatccacattagccaattcattatttaaatgacccacccctgaaccctctcatagtgtacatgagctgatcatactaggaagcaagttattacacaaaacataaaacataaacttgcagaagttgtttccaaatgtaaaataatcacaatattcatgaatttctaagtcttttcatttgtttttaaacttagatgatgcctttttcattaaaagtgcctgtgctcacatttattaaaagttttcatcatcattatttaggtatcttgattctccatgcttcaagacaaaaaaatcttcagcgttaagtccgtatctctctagagcttcattcagcttcactggaggctctaagtaatgctggccaaagagaaagaagaaaaatagaaaaagattaaacatatatttgggagattttccaaataacagttcaaactaaaataaccaacagatgcctagttagaattaggccctttcttttaattgaagcattagcaaatgggtctatcacattttctaatacagttttgagtcatgaattaagtcaacaggtatttggttggatagaaatcatgccaacaccatgtatgtgaaatttggtgccatcttactttgaacatcactggattgcatgaaatcatcacggtttcaccatatgaaattccaatctagatggaatcagtgccaaagatgatgttattagagaattacatgttactaacatttttgaaaaatatagaaatcaaattgtggtgtgtgtgtgtgtgtaaccaaatgctagagcaaattgttttgctgaagaagggttgttatcctcaaaaagtctagtcacatacagaaaccacagtctacagaatgaaagaggatcccagagaatatgaaggttgagctctgtgtggcaaagaggagtcaagattttgccctgaggaattgctaaatgggagtcaccctttactgagatgtttgaaaagtaagcttgagggaagatgagaaagtttaatttcagactttagttctaggtacctaatggatatccaagtggagatgtgaaggagacagttggatatataaatgtggattatagaagaaaaacatctgagctagagaggaacagcaggtaggtggtatttgaagccataagactggatgcgattcccaagggagaaaccaactacagaagagaagaggtccgtggactgacttctacggcacgcactgttcagagcaagcggagaggagggactagcaacagagaataagggacagccaatgatgtgcaaggaaaaccaggcaagtttcctgagcccttaaatgcacaggtttggtaacagttgttggccacacacaggtcatccttttcccccttgctcagttccaggttttatggctatgtttaaagataaaggatacctttcaactgactactgagtaagtttggttttaactgtatgctggttatccaatattcctagagctaaccccttagtaatggatagttgataacaggaatttacttttagtctattttatatataaagaaaaaagatcactaattatattacaaataaaatttaactttataccctaagtcaagaaatttcccctgaaataatttcctaaattattttaagagatttcaaaatgatgagcttttttcccattgaaaaataacttcttttgttaaattctctttctcccatgctgtacaagtctgggctaacagtacacactcacagaatcaccctacgtcagtaacttatttgctaagctataactttagtgtggagggcgatgtttgcgtttagtgagaattctgatatgttagagttggcagtagaccctctgtctttaatctgcctagatttagcagtatctttctgagtttcttcacagaccaattcttcgctgtttcaaccatctggaagataaccctggaggtaggtctgaaaggcttctgagtgactgagagctcacagtccaagcactttagtccagaagggagataaaaatgccccataaccatgggacaaaacaactacatataaagcaaaacagcagatcagagatcaatatgagtaaatgggaaaagcagaagactccgagcattctggatccattagggtctaggcagctagccacacacaactcgtaaattcctaaaggggtcagtttcatgatatacaacaatagaatatattcaaagtaaagacccggatcacttgaaaggcaatgtacatattatgtaatgcttgaaactcgtttccatcaaaactagtaatttaagttttagtgcttaaatatatgtaggaaatgcactcatcattccctagataaattagatgttgccatatatgcaattttagagtattgccaagttaaggacatccttaatctgcttatattacacgaggcagctactataacagcatatatgcaaagagtgttaaagtgtttagaagtcatgggtaactggctgggtgcagtggctcacgccagttaaggctgaagcggacggatcacctgaggtcaggagtttgagaccagcctggccaacatggcaaaaccctgtctctactaaaaatacaaaaattagccaggcatagtggccggcacctgtaatcccagctacttgggaggctgaggcaggagaattgcttgaacccaggagacggaggttgcagcgcgccgagatcgtgccactgcactccagcctgagcaacagaatgagactccgtctcaaaaaaaaaaaaaaaaaaaaaaaaaggctgaagaggaacagctctggtctgcagctcccagtgaggtctacacagaaggtgggtgatttctgcatttccaactgaggtacctggtccatctcattagggctggttagacagtgggtgcagcccacggagggtgagccaaaggagggtggggcattgcctcatccaggaagaacaaggggttggggaattctctcccctacccaagggaagccatgagagactgtacggggaggaacagtgcactccagcccagatactgcacttttccaatagtgttcgtaacaggcagaccaggagattacctccggtgcctgccccaccagggccctgggtttcaagcacaaaactgggcggcaatttgggcagacaccaaactagctgcgggagctttttttttttttcataccccagtggcacctgtaatgccagcaaaacaaaaccgttcactcccctggaaagggggctgaagccatggagccaagtggtctggctcagcggggcccacccccacaaagcccagcaagctaagatccacaggattgaaattttcgctgccagcacagcagtctgaccctgacctgggatgcttgagcttggtagggggaggggcgtccgccactgctgaagcttgagtaggcagttttcccctcacagtgtaaacaaagccactgggaagttcaaagtgagcagagcccactgcagctcagcaaggccgctgcagccagactgcctctctagacttctcctctctgggcagggcatctctaaaaaaaaaaggcagcaccccagtcaggggcttataaataaaactcccatctccctgggacagagcaactgggggaaggggtgctgtgggcgcagtttcagcagacttaaacgtccctgcctgacagctctgaaaagagcactggttctcccagcacagcgttcgagctctgataagggacagactgcctcctcaagtgggtccctgacccctgtgtatcctggctgggagacacctcccagtaggggccgacagacatctcatacaggagacctctggctggcatctgacgggtgcccttctgggacaaagcttgcagaggaagaaacaggcagtaatctttgctgttctgcagcctccgatgttgatacccaggcaaacagggtctggagtggacctccagcaaactccagcagacctgcagcagaggggcctgtaagaaggaaaactaactaacagaaaggaatagtatcagcatcaacaaaaaggacgtccactcatagagcccacctgaaggtcaccaacatcaaagaccaaaggtagataaatccacaaagatggggagaaaccagcacaaaaaggctgaaaactccaaaaaccataacacttcctctcctccaaaggatcacaactcctcaccagcaagggaagaaaactggacacagaatgagtttgatgaattgacagaagcaggctttagaaggtgggtaataacaaacccctccgagctaaaggagcgtattctaacccaatgcaaggaagctaagaaccttgaaaaaaggttagacaaattgctaactagaaaaaacagtttagagaagaacataaatgacctgatggagctgaaaaacacagtaagagaacttcattaagcatacacagtatcaatagccgaatcgatcaagcagaagaaaggatatcagagattgaagatcaactcaatgaattaaagcgagaagacaagattagagaaaaaagagtgacaagaaatgaacaaagactccaagaaatatgtgactatgtgaaaagaccaaatctacacgattggtgtacctgaaagtgatggggagaatgaaaccaagttggaaaacactcttcagaatattatccaggagaacttccccaacctagcaagacaggccaacattcaaattcaggaaatacagagaacaccacaaagatactcctcaagaagagcaacctcaagacacataatcgtcagattcatcaagggtgaaatgaaggaaaaaatgtaaagggcaaccagagagaaacttcaggttacccataaagggaagcccatcagactaagttacccataaagggaagcccatcagactaacaccagatctctcagcagaaaccctacaagcccagaagagagtaggggccaatattcaacattcttttttttttttttttttttttttttgagatggagtcttgctctgtcacccaggttggagtgcagtggtgcagtctcagctcactgcaacctccacctcccgggttcaagcagttttccagcctcagcctcctgagtagttgggatcacaggcgtgcgccacaacacccagttaatttttgcatttttagtagagacggggtttcaccatgttggtcaggctggtctcgaactcctgacctcatgatctgcccgcctcagcctccaaaagtgctgggattacaggcgtgagccaccacgcccagctcaacattcttaaaagaattttcaacccagaatttcatatgcagccaaactaagcttcaaagcgaaggtgaaataaaatcctttacagacaagcaaatgctgagagatttttgtcaccaccaggcctgccttacaagagctcctgaaggaagcactaaacatggaaaggaacaaccagtataagccactgcaaaaacataccaaattgcaaagaccatcaacactatgaataaactgcattaaccaacaagcaaaataaccagctaacatcataatgacaggatcatattcacacataacaatattaaccttaaatgtaaatgggttaatgccccaattaaaagacacagactggtaaactggataaagagtcaagacccatcagtgtgctgtattcagaagacccaactcatgtgcaaagacacacataggctcaaaataaagggatggaggaatacttaccaagcaaatggaaagcaaaaaaaagcaggggttgtaatcctagtctctgataaaacagattttaaaccaacaaggatcaaaaagagacaaagaagggcattacataatggtaaaggaatcaatgcaacaagagctaactatcctaaatatatatgcacccaatacaggagcacccagattcataaagcaagttcttagagacctacaaagagacttagactcccacacaataatagtggaagactttaacaccacattgtcaatattagacagatcaacgagacagaaaattaacaaggatatcaaggaactgaactcagctctggaccaagcagacctaacagacatctacagaactctccacccccaaatcaacagaatatacattcttctcagaaacacatcgcacttattctaaaactcaccacataattggaagtaaaacactcctcaacaaatgcaaaagaaaggaaatcataacagtctctcagaccacatgcaatcaaattagaactcaggattaagaaactcactcaaaaccacacaactgcatggaaactgaaaaacctgcttctgaacaacctgctcctgaatgactatgggtaaataacaaaattaaggcagaaataaagatgttgtttgaaaccaatgaggacaaagacacaatgtaccagaatctctgggacacatttaaagcagtgtgtagaggaaatttatagcattaaatgcccacaagagaaagcgggaaagatctaaaatcaacaccctaacatcacaactaaactagagaagcaagagcaaacaaactcaaaagcgagcagaagacaagaaataactaagatcagagcagaactgaaggagacagagacgcgaaaaatccttcaaaaaaaatcaatgaatccaggagctggattcattagccagactaataaagaacaaaagagagaagaatcaaattgacgcaataaaaaatgataaaggagatatcaccactgatcccacagaaatacaaactaccatcaaagaatactatcaacacctctacgcaaataaagtggaaaatctagaagaaatggataaattcctggacacatacaccatcctaagactaaaccaggaagaagtcaaattcctgaataggccaataacaagttgtgaaattgaggacgcaattaatagcctaccaaccaaaaaaagtccaggaccagacggattcacagccaaattctaccagaggtacaaagaggagctggtaccattccttctaaaactattccaaacaatagaaaaagagggaatcctccctaactcgttttatgaggccaccatcatcctgataccaaaacctggcagagattccaaaacctggcagagacacaacaaaaaagagaaaatttcaggccaatatccctgatgaacatcgatgcgaaaatcctcaataatggcaaactgaacccagcagcacatcataaagcttattcaccatgatcaagtcagcttcatacctgggatgcaaggctggttcaacatacgcaactcaataaatgtaatccatcacataaacagaaccaatgacaaaaaccacatgattgtctcaatagaagcagaaaaggccttcgacaaaattcaacaacccttcaagttattcaataaactaggtattaatggaacatatctcaaaataataagagctatttatgacaaacccacagccaatatcctactaaatgggcaaaaactggaagcattccctttgaaaaccagcacaagacaaggatgccctctctcaccactcctattcaacatagcattcgaagttctggccagggcaatcaggcaagagaaagaaataaagggtattcaattaggaaaagaggaagtcagattgtctctgtttgcagatgacatgattgtatatttagagaaacccatcatctcaacccaaaatctccttaagctgataagcaacttcagcaaaatctcaggatacaaaaatcaatgtatcacagcattcctatacagaattaaaaatcacaagcaaactcaaaagcgagcagaagaccaataacaggcaaagagtcaaatcatgagtgaactcccattctcaattgctacaaagagaataaaatacctaggaatacaacttacaagggatgtgaaggacctcttcaggaaaaactacaaaccactgctcaaggaaataagagaggacacaaacaaatggaaaaacattccatgctcatggataggaagaatcaatattgtgaaaatgctcatactgcccaaagtaatttatagagtcaatgctacccccatcaagctaccattgactttcttcacagaactggaaaaaactactttaaatttcatatggaacaaaaaaagagcccacatagccaagacaatcctaagcaaaaagaacaaagctggaggcatcatgctacctgacttcaagctatactacaaggttacagtaatcaaaacagcatggtactggtaccaaaacagatatatagaccaatggaacagaacagaggcctcagaagtaacaccacacatctacaaccatctgatctttgacaaacctgacaaatacaagcaatggggaaaggattccctatttaataaatggtgttcagaaaactggctagccataagcagaaagctgcaactggatcccttccttacaccttatacaaaaattaactcaagatggattaaagacttaaacataagacctaaaaccataaaaaccctagaagaaaacccaggcaataccattcaggacatgggcatgggcaaagacttcatgactaaaataccaaaagcaatggcaacaaaagccaaatagacaatgggatctaattaaactaaagagcttctgcacagcaaaaaaaattatcagcagaatgaacaggcagcctacagaatgggagaaaatttttgcaatctatccatctgacaaagggctaataacaaaaatctacaaagaacttaatttacaagaaaaaaacaaacaaccccatcaaaaagtgggcaaaggatatgaacagacacttctcaaaagaagacatttatgcagccaacaaacatatgaaaaaaaaaactcatcatcactggtcattagagaaatgcaaatcaaaaccatattgagataccatcttatgccagttagaatggtgatcattaaaaagtcaggaaacagatgctggagtggatgtggagaaataggaatgcttttacactgttggtgggagtgtaaattagttcaaccactgtggaagacactgtggcgattcctcaaggatctggaaccagaaataccatttgacgcagcaatcccatcactgggtatatacccagaggattataaatcattctactataaagactcatgcacacgtgtgtttattgaggcactgttcacaatagctaagacttggaaccaacccaaatgcccatcaatgatagactggataaagaaaatgtggcacatatacaccatggaatactatgcagccatagaaaaggatgagttcatgtcctttgcagggacatggatgaagctggaaaccatcattctcagcaaactaacacaagaacagaaaaccaaacaccgcatgttctcactcataagtgggagttgaacaatgagaacacatggacacagagaggggaacatcacacattggggcctgtcagggggtggggggctacgggagggatagcattaggagaaatacctaatgtagatgaagggttgatgggtgcagcaaaccaccatggcacgtgtatacctatgtaacaaacctgtatgttctgcacatgtatcccagaacttaaagtataataaaaaaaaaaagaagtaaagggtaacatatcctctctgaagattatatctgctttataattcaactaactcatagttatgaggtttattcaacatcaaaacatgaacaaattccaaaatgctgaaagtcaaatgagtttttattaacattctcattaagaaataaagatggcggttaggtttataacaggaataattcttgaaggctgaataacacaataattctcaaagacaggattttttaatcctctctcatcttccccatctcagtaaagagcacaactgtctaaccagctattgaagctaaaaatctaggagtcaaccttgattcctttctttgcataggtttaataaaataccattacttcatctaagtcccatatatatggaatatacataatggaatatgtgcatacacgcacacatatatagatggaataagaaattgtcactgaaaaccagtcttaaacttctcccttctccaaatacgcacccacacacccacatttatattctcatttatcctccccacaaccctatggttagtcattattctattccttctcccaacagtggccaagaattgctgcattgtggctcagggttgctgcctcatggcacaggaattttgattagggagtgggggaatgggcaggcagtgtattaggtaattttggaacacactgcatctttgggagagggcaggccataagtgagacagaggagtaactaaaactgcaagaaaacactgagttcctgcagagaggctctgggatgtggaagatgccacagaaagtaaagaagccaagtcctaaccacactttttttttttttaaagacagagtctcacttttttttttaagacagagtctcactttttttttttttttttttctcaagacagagtttcgctctttcacccaggctggaaggaagtgccgtaatctcggctcactgcaacctctgtctcccaggttcaagttattctcctgcctcaggctcccgagtagctggaattataggcgcctgccaccacgcccagctaattttattagagatgggttttcatcatgttggccaggctggtctcgaactcctgacctcaggtgatccacccgcctcagactcccaaagtgctgggattacaggtgtgagccacaggtgcccagccaaatctcactcttttgcccaggctggagtatagtggcacaatctcgacttactgcaacctctacttcctgggttcaggcgattctcctgcctcagcctcccgagtagctgggattacaggcacgcaccaccacgcctggctattttgtatttttagtagagacggggtttcgccatgttggccaggctggtctcgaactcctgacctcaagtgatccacctgcctcagcctcccaaagtgctgggattacaggtgtgagccactgcactgggcctaaccatacatttctaagttttgtttagagaagaccttggatccaggaaaggagagaaagctttatactatcctctgcttgatcccaggacccaggctagtggcagagttctagggtccatctgccttaaggaaaaattatctcttctgttttaatctaggaataaaatcacatttatccctatgcctggcacatagcagacaccgagtcaatgtttactgaatatatttctagaaagttccacactagccttacttctccctattgccctccactctcctgctgaactgattcaagtactccccacactagctgcctccgagcctatgctctgccctttcctcctctgaaaatgccttcctccctgccctctcagagccaagttcaaatgtcacttattccatcacgccctctctgatccctgccatcagcaaacatcctgattctgagaccatctcatctgttccacattacagcactttccccttctaacatctgtatcacatacatgacttctgtcttctgctagcatgagagcctgcttgaggggtgagacatgatggcttgcttttctagtctccagaccacatacagatttttggttatacaaatacaagctttactaacttcagaaataagccaaaagaaaacacaatgaggttgtgttgttttttttttctgactgtatatgtgtgtattgttctactaattagtatgatttaccaccctaattcatgcagtgactgtgatgactgtgcagtatctgattccagagtcttgggtctgaaaactaaggaacagtgatgcctgaatcctatcattggtcaaacacacaaagttatttttatcgcaatcaaacttacctcatttgctaaggcaaaagttccccagtgaattgccatagatttctttgtttggacatcagtgtgaatccttacagcttcttctgggtctacatgctggtatttcataaaccacctgaagaaacatggcaatttcttaattctgacctttgagatatacactaaattctaaaatctgtttcacttaaccaaactttaagattctgcgcaggactatggatgttgagaattaagaaccactgggataaaacatgcagttttggggaggatgagctagaaaccaagtctgaaggccaggtcaaggctagattgtaaaaacaaaacaaattctgcacaggaattaagtcacaggaggcaaaaccatctccctttggtacactttctgctgaaaaataaaacaagcaaaagtctttcttgtacaaattgctataaaataagtaagtctcaagcaaactcccctctgaatagtgagatttttgtttcacgtatattttgattttactggatctatctgaagatacaacttactgatgatgcaggggaggcgagccccaaaattgaggcttagcccaggagggtttttggcctcacaaacgaaatataattcaacggcaagccagtggtgctggccagcaattttttttaaacgatactgctccttgaggagcagtgctaagttataggcagtaagtgcactcagagttggcaacatatgaggggttggtaactgtatttacactcacttatacccacttttaattatatgtaaattagggaatgggttaatgcaaattaaagggcagattatttagaactttctaggaatggggtggtaacttcttggtcattgccatggaaaggggcagtaacttctaggttgttgccatggccatttataaactgtcatggtgatggtgggagagtcttaggctaatgagcaatgagggcagctagggatcacttctgtcaccatctgctggtttttgccagttttttctttttttctttttttttttttctgagattgagtctcactctgtcgcccaggctagagtgcagtgccgcgatcccagctcactgcaacctccgcctcctgggttcaagtgattcttctgcttcaacctcctgggtagctgggactataggcacgtaccacctctcccggctaattttttgtatttttagtagaaccagggtttcaccatgttagccaggatggtactgatctcctgaccttgtgatctgcctgcctccacatcccaaagtgctgggatcacagacgtgagccaccgcgcccagctgccagttttttcactttatcaattgagactgggaaataagtcctgcctcactgttacttttaaaagtagatattttacagtcctggatatgtatcaaagaaactgaataattggtaaagaaataaaaaccaaagctccaattacaaaagaatttgtatgtcctgctgatacaaatttgtaaaaacctgctaaagcaaaaataaacaaaaactagtacataaaatttaaagaccaggagccaaatatccaattactattcaagaaattttatttaatcataaaactgaacaatgaggtgtttggtttggcaagaagatcagactaatgggtaaatgattaaggaaataatgaaagggtgcctaatgccttgggaagagcgagggctcaggaggcagaaggcttgggtgtgaatcctagctcttgcagttcttagaatgcctttggaaagtctgttcaaattctctgagctgctatttctttgtctgtgaaatataaattttaccccattatgtgagggtattgtgaggattaaacaagacaaggcttaggaaagcatagagaacatcatctactttcatagaattctcccaaaacagtaaacaaaaccaacactttcagaagaaagacgtattattcctgatataaaggagaaagtgtactgtctacaagcaaatcctttgccttccaagccatcagtttcaaggaggaaaaacaacactgtattcacattatttacatcctagtctgccagtgacaactaacactacagtgaagaccaacagacatggattcagcacaggagcttccacactttacagaagacatcatggagaagtttatccatctgcaacagatatttactgttaggagttgctgggtcctacagaaggctgaaaacaaagccactgtgttctcctcaacagcaaatgagagcagcactgttctgccatatctcctgactcttgggattcagggaaagatgaaaatggtttttggtgtttctctcttgattttttttaaatcctagtgcaaatcaaagggatagatatattcctttccacctgaaatagatttaaattttttactgtgatataacaattaaaataaaaacttaaaatcttaactgacttggatagaatacctggtgacaggagattccctaaagtaagaatgaaacattccaagcatattattgaaagttgttttcggtctaaacatcttaaatttatagagcactctcaagtgttattcaatatcttatttctaaagccgttaacagtaaccaaagaaacagactacacattagaggctaccacaatttaactctcttagggcaaataatagcctccttgtctttttcccatcttagttgtttcctgtttgcctgcaatgcaagcaggaaagggggattatgtgagtaaatttggttgtacatattttatcatcacaaatatatgtgacaaatttatatattactacatatgaaaacttattttcataacaaataaaagatgttctaatctattaagaacatacatcaggctgggcatggtggctaacgcctataatcctaccacgttgggaggccgacacaggcagatcacttgaggtcaggagttcaaaaccagtctagccaacatggtgaaaccctgtctctactaaaaacacacataaaaaaactagccaggcatggtggcaggcgcctgtagtcccagctacttgggaggttgaggcaggagaatcacttgaacccagagacggaggttgcagtgagccgagatcgtgccactgcactccaacctgggcaacagagtgagactccatctcaaacaaccaaccaaaaaaggaacatacatcgagtaaagaccaattttatgttacaaatacataactgatttgtaacagttctaaaaatatataagttgacaggttttgagaggtttcattagaattataactatttaattagaaaagtaaaattcaagcaccaatattgatttgtaatcattttaataattatcaagaaccaaaaaagggtaaaaatatctagcccctccaaataaggaaactagcaaaaaacaaaaagggataaataagcattagtaaataaaaatagggacaaaatcgttttagtgaatgtaaaaatttagcaaataacaaaatcagatgaaaacaaaagtttagattcattcaattcatctatgtattagagaaatacttgttcttccacttatggaattacctaaacaaaatgttgttgtatgtatctgtccatgcactatagaatacaatatttttaaaattatccattgctttgttactattagtgttttgttttctctttatttgcacatataaaccagagttgactgaaatctaacttaattctttgaaatcacttctcttttccctaaacagagaatattaaggaaaacaaagacagtggatgagtctcctaggtgtccaatgagagtgtgacctttcgctgctctgaaataggtcaatagtatgtcaaggttggaggatgagtggtgagtagtacaacaccaccatgaccagattaacttcagtgctgactgaaataaaaccctcaccagggactaatgctataggccaattccttgctttttctctttgctaaacgtaggagagctgtaggacaggggattggggcactcaagttatggagcaaaaggtggttatataaagaaagtattctccatgtgaaagaataagagtaggttttattactggctgaccagtttagttgaatggtatgtgaacttctggctaggtatagtaattctttaaaccttgatccctttcttatggtaacatcatccctgattttgagtaatttttttaactcatatgactataattaaaatattttaattctcaccacaaaaacataagtatgtgagataatgcacatgtaaaatagtttgatttagttattccacaatgcatacatatatcaaaacatcatgttgcacaccatatacacaatttttacttgtcaatttaaaaaatatttaatttaaaatatttaaaaataaaatctaattgaatctgacctaccaacccccaatcatgtataacaaagtccaccattaaaatcataaattacagtgtcacaaaaatcataattgctttacttttaaattcagttaatttatcacatagcaggaatgttttctttggaagtctacatacctcggttcataagctccgatgggaatagctgcaaggtcaaaaggtccaaatctttttcctatctcttcaaaagcagggcaataaccagtatctcctgcgaaaaaaaatcgattccaaggccccaagacagaccagctgccccatagcaccttgttgtcatccattagagtccttttacaccagtgctgggaaggtgtaaagacaaaagtgaccttatcatgtccggggacacaattctcctcccaccagtccaactcaatcacattctcacagccacatttttgcatccagtcaaggagacccaaaggcacaaaccatctcaactcattaccaaatcgctcattcaaagcaatgacagaattgtagtccagatggtcatagtggttgtgactgataaggaccgcatctattggagggagttcacttattgtgcacggggaacgacgaaatcgctttggacccatgtactgcgatggtgaagcacgagagctaaagatgggatccgtgagaaatatgagctcatccatttccaccattaccgtggcatgtcccagccatgtgactcttaagccagcttccctcactccagcttcttcagggttagtgataaaatatggcttaagcactgggagttctttgtctagttcctttgtgtataaagaaagcaagacaaaagagtagttagaaaaaaaagtattatatcatcatagtccacattttgacctaaataatggcaagaagagctgttttaagagaactaaagtcattcaataaacttgctacacttttgcttttttcttgaaaatgcatacttctttctgaatctgacttaataatcatgataatatggtaatcttcttcctcccaaatgcaaaagagaaaattaaatttaaaactttgagtgctgctaaatgtatcaattttttaaaggctctcttcagtactgccagaagtagactggcctagatgcagtcatttttctattgccattctactcagctgatgtatttgctgctaaaaactgccttaaaagcaggtcagtccctggaaatagtaaagaaagcttatgaccatttatttgtagctcttggctctcagacatgaatcatgaatctgatatttttcttttttttttttttttttttttttttgtctgagacaggctctcgctctgttacccaggctggggtgcagtggcataatcacagctctctacagccacaaccccccagggtcaagtgatcatcccacctcaacctctcagctgggatcacaggcacacagcaccaccatatccagctaattttttattttttgtagagacagggtctcattatgttgcccagattgatcttgaactcctgggctcaagcaatcatcctgtcttgccctcccaaagtgctggtattataggcgtgagccactgtgcctggcctgaatctcactttctgagtacctataattcaaaatggagcgctgtgatgattcctggacaaatcacagtcataaattgttttcctcattccttacctttctgattttctaccattaatcaaaccaacgtgaatatgatcccttcctgtgagaagctgatcactgagataaggggggccgtaaatggatataaaacaataactataacaaagcgtgaagagtattatcccttggttattctacattttatacttggattaagctaggccaacaaaaagtggtaaggttgcagcatcacagtcctggcttttataaagctcttttactgaattgtgctctggtaccatgctatatagctgcatggaggtctctcataggaagccacctcatgaaactcaccatgtatgtgttcaggctgcagacttggtaccacctccaccttcctacttaccccagaaacatttccctcccatctcgtttcaggaaaaattcttctccagagcacctggctttgtcatttctgtcactgggaaaactcttaagatttcatgatacttctctctttaggaagttcagaggaaaagctgaggccacctgcagcaacgtgcagcacatgatggaacatatttctatattaactttattcttggctttattttatttttctagtctaatagtccattttgctcctagactggctaggtatagtaattctatacctcatccaattctttttttactgctttatgtatgtttgtaagttgccactaaatcaactttgaaagggtgtggtactggataagtagttaaaatacaggtcatgttatagcctgataagaaggaatgaagagcccagttgccaaaggcatcacagacacagtgacttgtgtgagttcctgaagaatgatgagaaactcatgatgcagagaaaaggaagaagggcatttcaagtagagaaaccacccaagcaaaggtacagagccaaacaggaatgtggtgtttgagggcaggggacaaactaaatctataaagatgggaacacattaagagccttgagtgtcatgcttcactctaagacaatgaggaagcatctttttttttttttttgtagagacagggtgggttttaccatgttgcccaagctggcgtcgaactcctgggctgaagcgatctgcttcccaaagtgctaggattacaggtgtgagccaccacgccaggcctaggaggtatctttttgccctcacacgtgcacacacacacgtacacatgcatgcatgtgcacacacacatacacacagacatgacccaattatgtttagataaaacaattctagagtccaaatgatggcatggagagtgtcacaacagttgccaagatatgaagagatgaggacctgagcaaaggatacaccggtagacacagacaaaagagggcagatggggagatgctggtgaagggaaactgagaggtcaatgagagagtgagtctgaatgggaagaaggcctggacaggaagagaaggagcagcacaggtggaggacaaaaaggtttctcttagccacttaaacctttagtttcctcatctggaaaacaggtgtaataattgtacctatgcttcattcctgtgaggatagaattacgagtggctgggacataataagcactctacaagtagtccaaaagaaaaagcaagaaagttccaaccctgacaacaaaccaggcaccaatgttaccaatcttttgcatttccgtggagctactaacctagttaagatgctaagaaatattcagacattcaaagctctccagattgctcaactatctgcctgtcaactcaatccatgcacaagagccacctcaaaaacagccaacttaaggtataacttaagtctcctctgctgcaaaatctccactggctctctactgcctgacaaagtctgtctcacctcctcagcccagcagtgagctgcccagggactgccccaattctctcgggcgtttcatgctcctcttccacatgtgctgtgtcccacctacatggagactgcttcctactcctagactgagctcaagaaccctgcacggtactcatcccatttctcaggttaaattatcttcccccttatcccttcgggccatctcttgagtcccacagctagaagcacttactcctgcctctcaacttccatatctccctattcacacatctcctctggatattctggttatgtgtacacagaatttgtcccatgtcttatgaaaggtggaatcattcagtgctcagtttgattaatgaaacacagcatgtgctcaacaaaatttgttgaatggatgagtaaatgaatgaatgtcaactttcaatcagttcttaaatttgggagttagggttagtgaacaatgacatatgccaagaggtatacttatccagaattaatgaggaaagggagagggaatgaatataaactgagtacctactaagtactcgtacttggcatcatattgggcacataatgatgatgaactacctaatgtatcaagtactttagcataacacaaaacaaaatactattaacaacagctaccatttatgaagtgcttattatgtgctagacactgtactaactgctactggctacgaccacaacactggaagtaggtcctataaaccagctccattctacagctaagaatacaatgaattagggaagttacagcactcaggcaaggtcacccagccagacccactgtagtaaaccatacttcctctcattaaatctcatttactaacatgttttcgtaaaaagtaacagcctggggtccaggttgggagaataagggggtatgaatttcaaaaggacacaaggaaacttttggggataatatatatgttcattgtcttgattgtggtgatcttttcgtgggtatatacatatgtcaaaactcattaaattatgcattttaaatatgtgaagcctatatcatgttaataaaactatttttaaaagtttaaggctggtgctgtggtacatgcctgtaatcccaacacttcaggaggcctaggctagaagactgcttgaggccagtagtttgagaccagcagggcaacatagtgagatcctgtctctatttaaaaataataataaataataattaaaaaataataatagaccaggcacagtggctcacgcctgtaatcccagcactttgggaggccaaggtgggtggatcacctgaggtcaggagtttgagaccagcctgaccaacatggagaaaccctgtctctactaaaaatacaaaattagccaagtgtggtagtgcatgcctgtaatcccagctactcgggaggctgaggcaggagaaccgcttgaacccaggaggcgaaggttgcagtgagccaagattgcaccactgcactccagcctgggcaacaagagcaaaactccgtcttagaaaaaaaaaaggaagaaagaaagaaaaagcatatagaaaaaggggtggggagaggatggactcttgtttacttgaggaaactaatcactcacgtggcattttcatggctagatcaagactttcttggctggtcttcctttttgaaagctgcaaaatggaaaatcccaagactcataattaaccagtacgctagttaatgttttacttttctcgggaaaagggaaaaatcctaacgttcattcaatagctactctttgcaaggtgctttaggtatactgtgtcatctaaatttgtgaagcaaatattactgccattttacagatgaccagaccaaggcagactggggtcactaagaaatttgccaaagtcatgcaagaggtaagtacccaatcaggagtgaaatctaggtcttcctaactcaaaagacctctctttcactaagccatgctccttcgatggcataaatattaacttacattaaaattaaacaatgaaactcatatcttcttaacatacttacaattttaagagtatgtgtttgtgtgtattaatgagacaaaaaagaaagatgtgactcaaatccatttaaaccatgtttttaaaatatcacttttaaagaagacacagtaatacttttcttccaactgaaggtacattttcaccatcttagaaaactttactacctatactgtaatctgcaactcagattttttaaattaaaaaataacatttttctttttcacatttgttatatgtgaacactgaataaagatacatgtgttaccaaaataactccaattcaattaattattgatgccaatgtttgatatttttgccatgtgtattaagagtataagatctatcaaaatggcttagtatttttaaactccttgattataagagaaaatgctcttaatatgtggaaaatgcagaaaaatataaatagttgccatcattatatcaacatgcagatattataaccactgttaacattatgatctgtacttgtagttctattttatgaatggttgcaatcagagtattcatattttctagttttataaaaaaattgtatatggtgacattttcagtcatccctacgactctacgagacacaaggtttaaaaatgaaacaaatagggccaggcacagtggctcatgcctgtaatcccagcactttgggaagccggggcgggtggatcacctgaggtcagcagttcaagaccagcctggccaaacatggtgaaaccccatctctactaaaaatacaaaaaaaattagccaggcgtggtggcaggcgcccatggtcccagctactcacaaggctgaggcagaagaatcacttgaacccgggaggcagaggttgcagtgagccaagatggcgccagtgcactccagcctgggcaaaaagagtgagactctgtctcaaaaataataataataataataataataataataaataaaaatgaaacaaattcttgaggaaatttttcagaatgcaaatttttttcaaattgctgaaatttattaaaattgaaagacattgtttaattaatcttctctgccatgaaactccatcaggctgtgtacaaaaaccactgggaggctgagggtcactagagcccgggagtttgaggctgtagtgagcctcaaagggctactacactccagcttgggtgacagagtgagaccctatcaaggtttgcatgcttgcttgctatctgtggtcattaaaaaccctagacctctttaggaaatcaggtctgcctgcacttctccaagcatgaattttgagttctttgcttctttaaaacttgctccatgtgcactgttgtcaagccgattctctatacctttaaaaggtctccaaaaatctgcactcaatcaacagataaaaacgttaccagtaataaaaccataaagctagtctagacaagtaagattctatcatttcaacttccaggcttctgtttaatgcctatgtgccaatggctaaagttaggcttgctctttaggacctcagcagttatcctcatacctcctttgggacacaactgttcataaggcaccatcaaaagccacactgcatctgcacctagcatcattcctcccaggggccacctcctcagaatgcaattttttttgttttgttttgttttttgagacagggtcttgctctgtcacccaggctggagtgtagtggcacgatcttggctcactgcaacctttgcctcccaggctcaggtgattctcctgcctcagcctcccaagtagctgggattataggcacactctattgcacctggctaattttttgtatttttttttttttttttttttttttggtagagatggcattttgctatgttgccccggctggtctcgaactcctcagctcaagcaatccacctgcctcagcctcccaaagtgtgggtattataggcatgagctactgcacctagccatgtaatatttttaaaaagataaaacatagaagaaattttcttaaattacagagaattgatccaggaggtccaaaatagaactactataactaatagtcattttagaataaaaacatatagggaaggacattttcaaagatacagatgaaatttcctagaactgaaggaaatggattttcagactgaaagggcccaccacacacagagcacaatgaataaataaagaactacacatcgtggcaattttcagaacactggtgccaaagagaggattctcaaagtctctagagagaaaacaaagggcctgttcaaaggatcaagagtaaggacggcactgaacttccccacagccacactagaaataaagttatggaggcaatactctcaaattctgagagaaaactgtttctaaacaaaaattctatacccaaattatcaattatgaatgagaataaagacatttcagacaagcaagaattcaaaaaacttactttccatgtaccctttctcaggaagttcactgaaaatatgctccaccaaaatgagaaaatgacacagaaagaggaacaagtgggatgcagaaaacaagggtgaccatagaagacacaagggagcccaggaggctggtgaagggtgccctagaatgtaagtcggcagagaccctgggaaggcatcagctcagactacagcccactgctgaacgaccacctgagagtctttccctcaggaaaatggcattgagaggccataggaggcagggaaataattgtcataaatacacagaaagtcaagcagatgaaagagatgttgttaacacagcagagggagaggtatataaggaaaggagacacagtcatagtacttacttcattcaccaatgaaaaatattgatatactcaatgtaaaccatgaaatcaacttaacccaaaactgtgatctgtctattctaacagaatagaagaaggccaagtagaatcatcttaagtaaaactagtacatttaaaggctaggaacctaaagtcaacttttcaaggtctggaaaggtcatctgaagctccctttcacagctttggtagccttatccaagggttaaaagccaagcactccaggccatgccttcaccctcatgatccatattctacacacgtaccaggctactaccttccagagcaggtaatacactgtctcaccttcatgaccttgttcatgccatcatctacctggaaaatcactgtcaaaatactttttagttgactaggcccagctgaaatattcacctcctctgtgaagccatctccagctcttcctgtcagcatcacgttctttcctgtacctctaaagcactctgttcctacctctagttgccaccagatcagggttggttattcctatatgtactctgctactgaacgatgaactttagggcctaggttacacctatccactttatctcctcagacctaattctatgccttatgatatacaagggctcaaataactagagtgtcatatatgaagagcaaatataaagcactcaaaaaagccaagcgctacctctttagaacttggaacactgctgtgatctttctccattatcagccatctgagaacatttggaatagaggggtttttccatgttggccacggattcacaaatctcccatcttttcctttcttggatttagttacatcttcttctagtctataatccagtttgaagcttttcctagaaaacctagaagaatcacttgctccggaattccgtgctgaattttgacgttttcttactgcttctttaggatattggctgcttgtcatcagagactggttgctttcattttcatccatgtcctttggtgaagaactaaaaaaaacaagggggaaaaatactgagttgaacataaaggcattcaaacataacacaaggtactatttgttagccaataaaaatttctctaaacttataaaaatattatgtctgtattagctgaaactttcttcctgcaaggcacaattttagaatacagtattacttcttgctaaataagaaagatgtgccaggcgcagtggctcacacctataatcccagcactttggaaggccgaggcagacagatcacctcaggtcgggagttcgagaccagcctgaccaacatggagaaagcccatctctgctaaaaatacaaaattagccaggcatggtggcacatgcctgtaatgccagctactcaggaggctgaggcaggagaatcgcttgaaccctggaggtggaggttgtggtgagctgagatcacgccattgcacaaacaaacaaacaaacaaaacaaacatgaaagaaagaaggatgtttgctttacctattaacataactgccaagcccttaaaaaatcctttatctcctgtaatccaaaacaacatatttccccagccagcatgtaagcatattaaattttccatttcaatgacattctgtggaataaattaaggcaccttcataaatctatagtattttcatacatgtatttagaaaacattattgttaacaatgcatagtaaggactgcttcagttccttgagggaatttagtaattcaagcaagtcgaatatatacaccactaggcttagtcatatttacactgaagatattctgtaaccaatgcccccagaaagaacagccagtccaaatccctggaaaggagataacacattaactgagagacatttcaataatgtatttaactgatcaataaaatacatttaaatatatgagaactgccaagtcagtgagtatgtatcctagctatacgaccttgagccagtttcccaccctctctgtaccctgatttcctcacctataaaatggagagaacgttacttccctcctaggtttattaagaagacctgtaatacaagtaaggcacttggaaacatagtaacacacacataaacccaacatcacagctcaatcaatgtcagctgttgctgctgaccttgttattcctgctactactgctactgcttaactcaaggcattaaaatccctgattttgacctatataggactccagatacacaaaagtgataagtaacgtatctgccatgaatttcatttctttcttattctgttaaacatttgctttctgtttcattagtttaaatacagtgcacacacacagcacattttataagtggaaataaggaaatgagcacagtaacagaaagccaaatattatttttatggctacaatggtgtttaaatagaaatactgccccagaaagaaagggaaaaacacaaaccctaggatgaatacgtacacagaaccaaaactttttttccaaactgtctagagtaagcagtctgtaatctagagaagaatcactgtgaagaaaagaaaccccagctgactaaagctaaagcacacgctgttgctcagccatcgctgtatgtgggagagctcaagagttaagagagagtctaacaagatttatactttgggcaaatagcctaccctttctcatcctccattttctcctggtaaactatctacctacctgtggaggtttctctcaaaggatcaaatggcacaggtacataatgtacttggcactcacaaatgctcattcttcttttccctaatcttgttaactggccatacatctaaattgtttatttttttttatttttgagacagggtctcactctgtcacccaggctggaatacagtggctcaatcacggctcattgcagcctcaacctcccggggctcagggtattctcccacctcagcctcccaagtagctgggaccacaggtgtgtgccaccatgcctggctagtttttttattttttagtagagatggggtttcaccgtgttacccaggctgacctggaactcctgggctcaagcaatctgcttgcctcctcggactcacaaagtgctaggattatagctaaattctttaagttattctagaacttaaagtggtctcggagagtaagctctcatagaatcactttttctgggttataattaagttcaggccaaggactttacaaagagcagaaacaatgaccatccatctgaacctcacttcgtttaacagatgaaaatgtacaagtttagagagtttaagttacttctcaaaaagacaatatgtccaacagatggcagaagtgacctcatgctactccttgtcatgataaaacagcttatgagatatctgtatttgtcatatacatatacatatgtatgtatatatatacacatatatatcataattctaccaaatacattaataaatgtttggctcattgttttaaacaatgaagggataagggagaaaggaaaaaaggacactttgattcaaagaccacaaagacaacatcaaaatagggttttgaacaacatctagtggtctaatgtagctaggacataaaaagcaaggaagggccaggcgcagtggctcaacgcctataattccagcacttcaggaggccaaggcagatgactcacctgagacaaggagttcaagattggcctggccaagatggtgaaaccctgtctctactaaaaatacaaaaagtagccgggcgtggtggacctgtgcctgcaatcccagctactcaggaggctgaggcaggagaatcacttggaccctagaggcagaggttgcagtgagccgagatcgcgctgttgcactccagcctgggtgacagtgagactctgtctcaaggggaaaaaaaaaaaaagcaaggaaggtttgtgaaagtcgagactatagagggttaaaagactggacagtaaagatgggactagattgtgagcctggactccctctaaggaggttaggctacactgcaagcaatggggaaacactgaacacacttaaaaggctgtgtacttaagggctggacacagtggctcatgcatgtaatcacagccatttgggaggccgaggcgagtggatcacgaggtcaggagttcgagactagcctggccaacacagtgaaggctcgtctctactaaaaattcaaaaattagtcgggcgtggtggcgcgtgcctgcagtcacagcaacttgggagcctgaggcaggagaattgcttgaacccaggaggcggaggttgcggagactccgtctaaaaagaaaatgatgtacttagggaagacaactctgatagcaggattaaaaagaaaggaagtggctaaaaactggagcttgggagatggattgaatgaaaacagaagaagcctagaacacccaataacactgaaccaccatgccacatatttcacctatttcatttaaactcatgctcctagcaaaccctcaaggtaggtattataatccccactttttaatagtgaatagcaacccagtcaaaagatgaggaggcagtgcaatgagaagagaaaaagcagaataaatccaagagacaacaaagaagatgaatcagtaagacttgagagtatttggatagtcacaaattttggactttgtagggctggttggtcaggaggagagtgggaagagtcagaaatggcagcaccactaatcaaggtggattgtgacccagtgagtttgagaagggtttgaggtcatgggaaagcaagaacccaagagaaagtcctcattgacacccaaaggaaatggattcaggctgctttaggggtaaaaataaataaataaataaaataaaaaataaaaataaaaataaataaattagcccactgtggtgttgcaggcctgtagtcccagctactgggaggatcccttgagcccaggaagttgaggctgcagtgagctgttatcatgccactgcactccagcctgggcgacagagcgagactccgtctcaaagaaagaaagaaagaaaagaaacaaaaagaagagaaaagaaaaaattggtgcagtgatctttcttctctctaaataataagctttttcaaagttgtctattcacacaatctccatttcctcacctcccatccactcagtctttcaccccaatcaatctgtggaaacaggtctcattaccaaatagccatcctctcctaacaaaccccctcccctaacacacacaaagtccagttttcagaaatgctctttaaaaaacaaaaaacaaaaaaatctgatacaaacaaaacgaaaaaacctccaaagggttttttgagggcaaaggtcagcatgatggttcacagggtctgtgtttctaaccttacccacactctccacactctcctctgctccataaacacggcctgaaactatttcctcagatgtatcatgtacccacttcagggcgaccaactgccacgttgtcatatccttggggtatggggaaatgtatagtcacaggattatggactgccatccatgacagatgttaaagcaacacaaaatgatcaaactatgaaacaccatttcacacgatgcactgttgaaagggcaagaaggagcagaagcacgtaaaacctgagccttgaaactctggactggtttttctggaggaaaaatactgggagcccatttgctgaatgtgcaaaatgacacgctctgccaacaggtgctccagtgacaaaggagcctcagcccgagagtgggtcacacaagaacgctcctcatgcccagtgtcttctgggcactcagaagaccacagataaaatgacagaaaaagtaggaatgaggaagagtgggttgtctgtatggtcctgtgttaactagctttgagctcttcaagcttgacaaaccccttaacatatctagctagagtttctgtaattaaatgtggcaaatttcaaactatttcttgttatgtaactgtttccaaaattaacaatgtaaatgaaaataatccacccttgatttcaggccaacaccaactgaaagtagatgtgtacatgaatacacaaaaactgtaaacaacctgtgtttcaaaaagtgctttaaaacttgataaagatctttccattgtactgattttgattcaatttaagatccatgaattctgaaagagcaatctaaacaaataagtaataaataaataaaaataccatgaattgtaaggcaccctgatgtgtcatgtgccactaaggaagtaaaaatgttatcaattatagttaggtcacacgttatacatgacatatagtgatatcagtggtgttaaaatgtgaataaaatgtctatctcaaaatggatgaaatatagcattttgtgttggaaaataaatacgttgggacaggagtgaaaacattgctcttgataattaaatataatcagaagcataattaattgctcatcctctttccctctgtgaacaacagttagttataaacataccaaatgctaaatttgttctagaaaactagaatccagaagaaaatttaaaggtaacaaacccctgtgacaattgtattttaaatataaaatacaaatgttctagccaggcacagtggctcatgcctgtaatcccagcactttggcaggccgaggcaggtggatcacctcaggtcgggagttcgagaccagcctggccaacatggtgaaaccccatctctactaaaaatacaaaaattagctaggcatggtggtgtatgcctgtagtcccagctactcaggaggctaaggcaggaaaatcacttgaaccctggaggcagaggttgcagtgagccgagattccagcctgagcgacagagtgagactccatctcaaaataaataaataaataaaaataaaaaataaaacaaatgttcttttttaaagaacaatgtattacaaaaaggacaacataaagtccatctagtaattatcaaggacattctctacattttttgaagattaattgcctatttaagagcaaaaggacttatccctgtgtctccaaccaaagagaggtctgggctgtgacatttggtgaagacaagtcagccaagtacaaatattttctctcaataactgcacatatgggtaaaatgctttcaaaaaataagaattctctatttcaaaagcaaatgtttcatgctttcttttttcaacatttaagatttgccaactgcctagaattcaatgcactgctttatcatgtaaacagctaaagaaaaaaatcacagtagtaaaacatacctttgggatttcaacacactcataaattatgaagcggcaaatcattcccagagtagacatttaataaatactaattgagttcttgtccattacgtaacaacaaagatgctgatgttaaatctggaaagtattcagaagtgtattttcagatatctctgactaaataacattaaacttactattctgtatttgctctccttatccttattgaagagaaagggcccttttgatacaatgctagataacatggctaatgaaactacgtcaattcactgaaatgtctgcaaagggcttcagtgggggtaaaattaaactgttcccatccttcacattcaataagattccaggcaatactggtattactcccagaggcatttagggaaccagtgggagggcagatacatccaagcacaggaagtacactggataataagagggagaatgttctgtgggaggtatgtatacaacattcatcaaccaaaaaagtattgcactgttatcactgaacttcattcttaccacactttattgacttagcaaaacaaccagttttgctaagaagctaaaagaaaacaaagcaaacagaagcttaatatacaggatctgagagtatgacaacatttaataataattattgcatcaaaaatagaacatacacgcataatatacatttagatatatgtacatataaatctatatatatatatatatcaccaaacaatttatcttcactagagtggaaagaacactagttaggagtcagaaaaactggactccagttctactattaactagagatgttagcttgcagggagtaactcagcctctctaaacttgggcttattcatctgttcaataaagattgtaactcctaaacgttgttttaaatgtctgttagtcatttaaggagaccatgagttagtagtttaaagtgctatacatatggaaattgctggctagttgtggtgcctcatgcctgtaatcccaatactttgggaggccaaggacaggaattcgagaccagcctggccaacatggcaaaaccctattaaaaaaaaaacaaaaaacttagccaagagtggtggtgcatgcctgtaatcccagctactcgggaggttgaggcaggagaatcacttaaacccaggcggtggacgttgcagtgggctgagatcatgccaccgcactccagcctgggtgacagagtgagaccccacctcaaaaaaaaaatgcaaattgttgaggctgggagcagtggctcacacctgtaatcctagcactttggaaggacgaggtgggcagactgcctgagctcaggagttcgagaacagcctggctaacatggcaaaaccctgtctctactaaaaaaaaaaaaaaaatacaaaaagaaattatctgtgtatggcagcccgaacctgtagtcccagctacttgggaggctgaggcaggagaatcacttgaacctggaggcagaggttgcagtgagccaagattgtaccactgccctccagcctgggcgacagagcaagactctgtctcacaaaaaaaaaaaaaaaaaatgcaaattgaagagtaaagaatatatgataaataggaccttttgatccaactgagttgtttttcaggtgaaagataaaacattctagaatttcatatggctttaaaagcctaagttactgaatttttttcatttttctttccttaatttcacgtaacaagactataaaagtaagtaagttttgttaccttttaaaaaaatgtattttcttttgttaaaacttcaaatttgtcgcaaagcattcatccaattatagacaaaaaattattttgacaaataattcacaaagaaatgccaaccaaccaaaagcatttaagagtccaaataaattgtttgtttgtttgtttgttttgagatggagttttgctctcattgcccaggctagagtgcagtggtgcaatctcggctcactgcaacctccacctcccagattcaagtgattctcctgcctcagcctcccaaatagctgggattacaggtgcccgccaccatgcccaactaatttttgtatttttagtagagacaggtttcaccatgttggccaggctggtctcaaactcctgacctcgtgatctgcccgcattggcctcccaaagtgctggggatcacaggcatgagccactgcttccggccccaaataaatagttctgagaggaaagaatgcaaaacgcaatttgaatctttgggatacagtatattaacagactttaagtcaccaaaatacataaacactctagaagcttcctctataataagaggttttccccatatgtaagaaagcaaagctttcattagaatcaaaaagaatgaaacaagagaaacagctggcttaagaacaaagcctatttatgaataccttttacgactggaatccttagggtgatcaaattaaaatatcatgttacggtaaatttggaaaacatgcataaaatatttattgaaataacatagttatcatctctttaataccttaaaaaataatagcaagcacaaagtgcaggttcatttccggtataatcaattatacctaaatgatatacataagtatttaattgaaaaggtcaggccaggtgtggtggtgcgcatctgtagtcccagctactcaggaggctgaggtgggaggactgcttgaacccaggaggtaaaggctgcagtgaactgtaattgagccactgcactccagcctgggtgacagagcaagatgctgtctcaaaaaaaaaaaaaaaaaaaaagaaaaagaaaaagaaagaaagaagaaaagaaaggaaaaccaaaaaaaggttgggggaggacaaggtaggaggaacagtaagttgatgcctgtggaacttgaaatgcgtcctaaatatgtcagatgatctttcttttttgctttttttctttttttttttgagacggagtcgcgttctgttacccaggctggagtgcaatggtgcaatctcggctcactgcaacctccatctcccaggttcaaccgattctcgtgcctcagcctcccgagtggctgggattacaggcatgcgccaccaagcctggttaatttttgtgtttttagtagagatggggtttcaccatgttggccaggcaggtagatgatcttaaatgttcatttactgttcctgagccaagattttaaccaaaaaaaagcttccaaaatgggactactttctctctactatctccatctcataattacgtatacaaaaagaaaaccttccaatttaatgcataacctgtaaagaaacggaaaggagaaacatgtcttcatagctcctggacaggacagagaaagagggaaaaaagcacacttttcaattctttctgacttcagtccagttcccactttgactctactgaattctacagcccttttttttttttgagtcagagttttgcttttgttgcccaggctggagtccagtggtgcgatctcagctcactgcaacctccacctcccaggttcaaacgattctcctgcctcagcctcctgagtagctgggatcgcaggcacgcaccaccacacccagctaattttttgtatttttagtagagacagggtttcatcatgttggccaggctggtcttgaactcccgacctcaggtgatccacccgcctcggcctcccaaagtgctgggattacaggcgtgagccaccacacccagccttctgtagcctttaaaaagtcacttaacatcattgagactcactttcattcatctgtaaaatagaggactgggatgtatctctaaagtctctccacctctaaaattctaacaatcttcggctgcaccaaagagccagctcaggccactaaagagctgtcccctctaactcagccttggccaacccctcctatttccactccctcaaataaaattcccagctcaggtccagctgccttccccaggctggactggcaagggataagcgaagtatttcacctgagaacagcatagttatctactggaagaaagtgcaatttcacaggtttatcaggtaggctaggaggttattaagagccaggacatataaatctgatacaaatagccattagattttcaaacttaaaaagattccagatattacctgtaagggcttctacttaaagcattttaaaagttgcatttaacaaacattgttagaatgtctactttatctaagtcctagctctccagttgctgtggagaatatgaacccctgacctccagggattcaaaatccattagggaaaaaaatcataagaaaccatatagattttggctcagtatcacatttacagaagtgtcagctctgattaatgaaaatggtatagactttagaataaggcatttccaaaacatactggccaaattctcaagatggtgaggaatacttttccttaagtgctgagcggtccacagtgacagcaagagtcctgtgatccagcaggtcagagacactgaaaagctcagaactttctgaattcagccaacaagttaaagggcgctgatggcaacagagagggtgatggaaagaaacaaagtcactagagaggttacttgaaccctgattcactcacaaatgaatttggcaaaggggcagacatgttattctgcccgcagtgtcatgcgtggtccatcctctgggagaaaaatgacaaaaaaataaacgaacagtgagacttttacagggaaacaaggcccaggacatgactacatcagaccctgttcagccatctcctgagtcttctgtacactgtaaataacagggtcagagtgaggctagagatatccccaaaaggttaatagaatcttgaggttctaagggactttaagatccctgagttcaattcagtagcctctgtttaagaatagcagaaagtttgtagcaaattataaaagcatattaaaaatgaatataactaaaatatgcttgaatgggttatcaggaaaaaccacattaccagaagatggggcaaaagaattgaaaacatcttaaaataaatgcttcccaactttgcccctcatcatcctaaacctcagtttcataattcctagcccagtctctggcacacagtacatagtaagcactgaataactaagccactgtttcattatgctataaacagtaacagttttaatgagatagtaggatatacatgtataccatttttgcatttctacactaatgtgataaggaagctgagggaaatggtatgaataaactgaagcagaataaactctggaatgtgtttttgttctatttgagtaagagaaggcctgatcttggaattcacagaactctttttttttttttttttttttttgaaacagagtcttgctcagtcgcccaggctggagtgcagtggcgtgatctcggctcactgcaagctccgcctcccgggttcacgtcattctcctgcctcagcctcccaagtggctgggactacaggagcccgccaccacgcccggctaatttttttgtatttttagtagagacggggtttcaccatgttagccaggacggtctcaatctcctgacctcgtgatctgcccgccttggcctcccaaagtgcagaactcttaattcaaaacaggattcctacccgacctcatagttccttgtggcctcactaaccctcctggagtcaccagaaggctctcattagctcagaagactcattgatagtctcctgattctgaaaataataatctacctgacttccctttatctcccttcactggcccaaggagcagaagctgaaaactcatgatactaatggtggccacatgcagactcagcacttttcccagagcttgaagctccagttaaacagattcttttgctcaaaggaaaaatttcccacaatgggagctggcaaaataggcaagcaaggccagctctacataaatcacgagtaaataagtttcccctaaagcatttcagtattcttgcctctcttacccaagtgactctactatcatattgttccccccatctgctttttccatggccaaaacaggttttcaagaaagatctgatttccagtgtgtgacagataaggaacaaagtgcaaatcctccctagatcatttccagtccacatgggtacaagccctgaaacctcaaatgtacatcagaattacctgtggagttgtttttttttttttttttttttttttgcaagcagataaaggcttattttactttaatggctgatctatgtaatcacggaggccagtatgtacacacaaaggggcagcttttatttcttggtctcttcctccttggacaaagtcttgatgatctcctccttcttggcctggaggtgctcttcatagctcttgtgtgcttccttggtcttagatctgcgggcctcagcctgatcagccaggagcttcttgcgggccttgtctgccttcagcttgtggatgtgttccatgagaatctgcttgttttttaacacattcctcttcaccttcaggtacaggctgtgatacatgcggcgatcaatcttcttagattcacggtatcttctgagcagccggtgcagaatcctcattctcctcatccacgtgaccttctctggcattcgggcattggctgtacccttccgcttacctatgcccatatgcctgcccttccggcaggccaaggtgtttttccggcatcaagcgggggaatggaccatcacaggcttgcggatgatcagcccatctttgatcagcttccggatctgctgacgggagttggcattggtgatttcattggtctcattggggtctaaccagatattcttcttgccacagcagaggacactagaggcaagcctcttctgaagcctgagcatactcaaggctgcagccacagcagcgaaaggaaagagctcccctgtggagctttttaaactacaccagaggctactgaatcaaaatgtcaggtggggcagtttctctagataatttttaaaagttctgtgggtgtttctgatatacaggcagggttgagaaccactgctttaaatcattagtcatttggcacaaagtaagacaagcatttaggaaggatcaaagggattttctggtatgccagaatttatgctagcctggcagctgcctaccgtaaagccaactcttacttcctgttcagcactccaagttagagaggcagcatcatcctgaaactgctatacagtgggatgggaagactaaccacattgctaggtagaaagtttaacaggggccaggcatggtgactcatgcctgtaatcccagcattttgggaggccgaggcaggtggatcatttgaggtcaggagttcgagaccagcctggccaacatggtgaaaccccatctctactaaaaatacaaaaaatagccaggcatggtggcaggcggctgtaatcccagctacttgggaggctgaagtgggagaatcacttgaaccagggaggcagaggttgcagtgagccaagatcgtgccactgcactgcagcctgggtgacagaaaaaaagaaagtttgacagggcaaggcttgtactcaatccaactgagtcacaaatttgactctgtgcccccaggaagccaagtcaaaaaaagggaaatataatcagtaatgattcacattgtcaataacacaaagcagcctgtacacaatgagtgcacaatatttatggaatgaataaatgaaaaaaccagagcttaaactcctaatcactcttcattaggatacagttaattgttttttaaaagatctcctgctaggagtcaaataatagaagcaaaaatgaccagaagacagagagacaaaagtcaacagtggagatccccaccaactctgctaacaaaaattaaaactggccaggtacaggggctcacacctgtaatcccaacacgttgggaggccaaggcaggcagatcacttgagcccaggagttcaagaccaccctgggcaacatagtgagactctgtctctacaaaaaaaaaaacaaaaaaacaaaaaaacaaacacacacacgcaaaaattagccaggtgtggcgggctgagataggaggattgcttgagcccaggaggtcaaggctgtagtgagccgtgatcatgccactgcactccagcctgggtgacagagcaagagcttgtctaagaataaataaataaacataaataaataaaaatagaaaagtcttggggaataattgagtagttaaattctatgtggtaaagcggcagcacagtggtaaagacgaaaagatgcctgccataaaatctagtgttctttaatctgtcatgtatttagaaaaaaaaaaaatcttctcttccttttcttctcagtaacagaacccgttttacttagggtaactatgcatcagctaaatgatgacatttctcagccttctagctagggatggccaggttggtgacactttgaacaatgtgatacgagccttttatggtgcttccagaagtctccttaagggaaagggaggcattcttctcgatttgtcctgcatctggctacctggagccatcttgagccaggagggtgccacatccaaggaatggcatcgaggagagccagaaggacttcagggcccaccataccaagcctgaactgtccaactttggacttctttcatgtgtaggaaaaacatatttgagcaatctttcaaatcacaacaaattaatcctaactgatacgattaccgtaactgggaggttcaggtttaggggagctataaaaacaccaatggtaacaaatgcccaaaatacagctttcctaatccatatgtgggtgccttgatcaacacactgcagccttgaactcctggcctcaagcaatcctcctgccttgacctcctaaagtgctgggattacagacaggagccacggcacctggtccatttatcatttactaagcatttactatgtaccaagcactttagataattattatcctcatgctataggtgatgtaaaagaggctcacagagtttaatagcttccataaagcaataaagttgttaacagttggatctagggatgaaacccaagttgaccagatgccaaagcccatgctctttccactaatcatgttgaatctacaaggaaaattcaataaatttatcttgagtagatacctaggttctaaagttagtagcattttgcaaacagttatggtctcactgacaaggctcaccttttcttttgttttgtttttttggctttcaacaaaattttctccccttttgcaaagtaaaaggtacttgggagatgctcaataaatactagttctcttataaatataattgcccctttaattttacatgaagaaggtttcaaatgctataactttcattactcaatttttctaatttacagttacattgaaaagaaccatcaacaaataattggttctgtattttagtcacataaacaaaatacacatggtaccttgaagacatttcctttgctttcaaaaggtgtctcagtttatccagcataaaaccacctaacatgttatctttcaagctggggagaatggctagtcaagtcccataaagagaaactgtcaggtaggaggatcaacatatctagtttgcctgaggatttcccagtgttaacatttaaagtcctgcatcttaggccaggtgtggtggctcacacctgtaatcccagcactttcagaggctgaatgaagcaagcagatcatttgaggccaggagttcgagaccagcttggccaacatggcaaaactctgtctctactaaaaatacaaaaattagccaggcatggtagtgcatgcctgtagtcccagctactcaggaggctgaggcacaagaattgcttgaacctgaaggtggaggttgcagtaggctgagattgagccactgcactccagcctgggcaacacagcaagactcttgtctcaaaaaaaaaaattcctgcatcttgggaactcccttggttctgggaaaacctggagggttgatcattctatgtctcaggtgaccatataaatgcatagtcatatcttcaaaaaaatttataaatgtgtgcgcagtttaaactaaattgaagatgaagattataaagtaagatgtgaaggtattcgggtggctaagcaaaagaaaaaaattataatgctatacgtaatcaggcttaactaagacaatgttgctaagaataccaaaaaagtttattagatcaaattcttcattctgatgatattcaatatgtgcatcatcagtattagcgttcacccagctaaaaaagaggctccaaacagcacatgtacatttatatacaatcggcatttagtctacacataaaagtgagacactatatgaggaaagattgagaaagaaaatcaactttcagccaagaattgtaaagtatttcatatctgtgaaatggtggaaaagcctaatttcaatgtttcaattttgaggtaatcatgacaggctaaactcctgtgacagcagaaattaaaaatatgcacattaaagagattggaccaggtacattccctctaaggtcccttccaacttgaacattccatgacagaagtcatcacttgtgtgacccttttacctaatcggtaaaccaagtcaggccagagagttacatgacattccaaggatctagctctggctgatgatggagcctggactacgtatcagccatgctgtcaccctaattatgcttaaaaacacttggaaccgaaggggcatacaatcagcataggaagataaatgacacattttactttatgtggggtattttacttagtttggcttcaagtttaaaaaaaaaaaaagaatttgagtccagaaactctttaagctttcattggctacttttaccataaaatagcacaacattctggaaaacacacacacacacacgcacgcacacacatatatgttcagaatatatagacagcttagtttagagagctttccatgagctctctaaacaaactgaaggaacaaacacagtaacttgaacagagaacatctttgtaattgaaggaccttcaaaatacagaaaataataactttcaaaactaatgactgctgtcatccgggtgtcctattaagatgtgaccagttttagctgggtgtggtggcacatgcctgtaattccaacttctcaggaggctgaggcatgagtatcgcttgaacacacgaggcacaggttgcagtcagccgagattgccccaccgcacgctagcttgggtgacagagcgagactccgtctcaaaaaaaaaaaaaaagatgtgaccagttcaagagtgctagtgacaatgagaaagcttggtgtttctctattcattcttgtaattgagagagattacaaaatcacgcagaagcctacaggcattcagtgttaaatcaatatattactgtcccttaatctgggaaggtgcccaaattagataaacacaagagtctgcaccttcaaggggaaaaatggattgttccaggtagcaggcacaaactgagttgtttttcaatcaagattttgaattatgctgatccatctacatgccagacctgtgcctccagagccaacagcactggccattcacaacctgttacccacaggcaggggtgcaatctgtgagtgtgttgctgaccaacgcttgctaatccacacccctccactttcgcttcattggaaccccgctgtaacaagagtctgcagtgtatatattctgctgaaggctggggctgctgagctaaggttccttggccaaatcaccagactctcccaggctcttggtgtcctattttcctcatctgtggaacaaggctcatattttatgtctataaaatcaaactctctctatatatatacatatatttaaaatatttgaaagagctttgtaaatgataaagttataatacattatttaaccagctgaggttgcagaagactatctctaacataaaactgcccctggggatatatgagttcgtatgcaatctgtctccaaagtctgttagtaaaatacttaaatacacaataaatggttaataaattcaaaagacaaatcaagcaaagcactataaattgtagacagaattattcagtagtataggcgttagaatgaaatattacttgaatcttatgctggaaatcacatgggtgatattttaatgccagttttatgcatgccctcactggcctccagaataaaagtgctctttaacgattaattatacatacagttcatttccctaataatacttcaatgaaaacactttttatgtgtatgcatttcaacctaaaaagcccagatcaacagtcctccagctatagctatattcttatttacaaagtgtagaaagcaatggaaaaactcactatatccacagctatccatcaccacaaagaaaaagcagaatgaaacaacaaaattaaaggcaaatactgcttttccaaacacagactaaatgttcataaaaatcctctcagtttaccaaactcacaaatactcaaagtaacataatacccctttcgaacaaacacaagaatgactgtatcaactaaagtataaccaaaaccctgtgatggaatgcttatgctaaaatgttcttcatatagttataactggactaattttaaaattagaattttgtaacatagaatttctacaatataatttggaattctgagtgaaaataagggtatgagaaatacactaagtatttttatctcttggagacttaccataattcttgtagcaggaaagcctgcagaatgttaacaaaacaaaatctctgaaaatcctgactatattttcagttgacttgaaacaaatttaacccctcaatctctccttaaattattattttaaataagtacttttaccctaaatttcttctttaacagacccagtattttcttgcaacaaaaatcacactattgtgggatataggtaatcttctttttaaagattacataacttctttctaaacgatgtccatgtctgcggctaattcataaccaatgtaactgaaaatagaaatggaaatgttagagatttccattttttaacaaacatgggaattatttctcaatttgaagaactgcatctcaggaatgacttcctggacaaattaatcagaattatcaagtagcaaacatttcatgctaagccaaagccaaccaggtgagtcagtcatattataacatgtatatataacaacgtacagtaaaggcaaagacaagaactaaatgactttttaaaaggctgttaaactttactcactcccttaatattttccaggtttaactgacgtataatgaatgcatgtgatcccggaacccatggaagagtatctaccatatcgagctctagcttgaaaaaaaaaaaaaaggaaaaaacaaacaaacaaaacaacaacaacaaaaacctatctgaatacgtgttctgaaaagcccacaataatacccaatttataagaagcaaacaaccacagaacagaaaactcaagaaagcacagccttccaccacccctccccagctagccccatttttttttttgctcttcatttccattccatagttaaataagtacacttattccaaaataaaaggggagaaacctgttggaatggatttttagaagataaacactatagatgaagcaacaataagttgctcggaggaagttgtcgacccattcatttacatacaaccaaaagaagataaacccacatgtattcctatcagtgaagatgcaacctggtaatttgcagggaagataggatctcaaatcccagacagctactctcccaaagagaaaaaaaataatgctgtggctcttcaccgaggcagcttcagagatgcaggctccgcaactcgcgaggtgcgaaaattcaaatgaagccctgtcgctcacaagtgcggcatctccgagatgagggagggctcggggacgggaaacccactctcagcccgctccacttcgccgaagaattccaaaccaccccaggctcagcagtgtggattgctccgcccagagaccgt

SEQ ID NO: 1534 - DNA, 49547 bp, Homo sapiens; identical to SEQ ID NO: 1533

SEQ ID NO: 1535 - DNA, 100223 bp, Homo sapiens
gggagggaggcacaggcgcttgctttgcaggagtcagctctgccttcctcggctggagtgtgggtggcttggtgagccggtggtcaggaattctctctcctccttgcaattttcctttctgtctgggtaagtgtctttctcttcttgccttttctaatttgtggctttaaggggaggaccggtaacttctgcactcacattttctaagtacctctacttcagggtcaagaagagagagccagtgcaccccgtcgcaggcaccctttactgtggaaaacagagcaattagttctgggatctgtatttctttgacgaggttttatgctcaactaacattttatttcccacagccgtggtctttgctaagtgccgtttagcaccctgcggcgtgtgctttgggttttagccctggtctcatcgtggccccagggggccccccagtcagtggactgatgtctgcaagtttcatgagattctcagaaacgaaagcctcccccgaggagagggctgacttataaaggtgtgaaataataaaactggatattttcttaagggaaaaaagagtcgagggtcattcagcttagacctagcctatattatccacggtatgggaaagagaacaatccttgtcaggacttgcaagtttttgcccaaaaatgacagcgttcttacggctgttttcttctttgtgctgttgggtgtgttgtgacccttcagacttcttcagctccactccgctgatagaggctgtgccttctcagggcgtgctcttgaaatgcaacctgctggagaaagacagtggggctgggtggttgcacgtggaaggcaccggaggcaaacggaaggaaggggtttgccatcactgggaacacctggccttttctaattctccatttcacattcctttcttactaagtagaagtaaaacaggactcaaagaaagcgtggaacaaagataatttaaggcgttatttaataaaccaagtcccaagctaaaacttgtcttgggagccaagggcttagccacttgtggcacaggccaacgctgcttgtctgggagtccctttcccctctagaaagctttaatttggtgtatttattgactttgacatttttaactgtagaaacaatttccttcattaagtggaagtcaatgttttgtacttcaaacatttttgcaaattaaaacccatcctggtgacatgaggaatgggctccacacgttgtttgcaggaaggaattaggatggggatatcagacacgtggtcccctgcactggaggagaggctcgcgtttcatcctggtgtcatgattcctaaacgtgtcaggagcattccgggagtggccggggagctgggctgtggtggaaagtgggctggacgctgtcaggagagtcagctggcacctgggttcggccgtggccctaccggtgacccgggcgagtcatatttccctggggacggtctgtgctaacagtacagcgtggcgccaggattatctacacacaggctgtccaagctgggggactgttagctgccacctcactcagccccctgttttacagcagagcaggtggaggcccctgagctgaaggtcagcaggtccccactggagtctcagcctcccaatgcgcctgagccccagggactcacatcaaaaactaccctgcgaggaaaagctgctttctttctctctctctttcttttttcttttttttttttttggttggtgtgtgtagggggtatttaacacatgtctgagatagttccttaaaaaggaaaacagctttctatgtagacagtagagggacattggggagctgatcggcccaggtcctgtcattttctttatagtgtcataaatagtacaggttgatcattccaaatctgaagatcagaaatccagaatgctctaaattctgaaactttgtgagcgctggtatgactctcaaaggaaatgcttacatgagcatctcaagtatccaatttctggatttgagttgctcaaccagtaagtataaatgcaagtattccacagtctgaaaaacaaatcgggaattggaaactcttctggtccaagcattttggataagggatgctcgacctgtagggtgcatttggcaagtcctctccagggttccctccactcagaagggccctgtgctgccagggctgcaggcacccagcacgtgctgagtcagtggggatttgcttgcaaagacgtcatcacacccggccaggaggtggtggcccaggctgggtgagggacactggggaagttctaacataggaagtcccccaaggagtgaagagattgcggaggggacacacattcagggtgggtgaggctggacgtgcagtcctgctggttttctgggttgggcatgtgattgataaaagtggagttgagggcacattggcactgggagtcaaatgcgcagaagacttgagcttgctactctcccgagccaggagctctaaggtgttttcattgttgaaatccaagggttctgatttaggcttggctggcacgttgcaagtgaccccatacttgtggaatcaactgaggctgatggattctgcaaagcctctgacacctcctgattttggtggtcctgagcatgaagtgagcagggaatacatgtggggataaacgtggcaaagtgccctgttacccccatccaaagacttcccggggagacttccacagtaaggtaccattggagtgaggattgcaggaagtgtgcacacgtgatcccagctctgccttgctaagcactacaaagtgtagcccctcacacatgaagtgtttgaagacttccaggcccacaggaccggatgtcacgtcagtgatacataggttgcattggacaggacgttacagactggttgacggatagctagtctgtgagctctcaagacctgagccgtttcacattcttccaggtcttaggtctaaggaggaggatttccatccagggcgattctcctcttatttcaatgtagctcattctctcctttgacctaataggtcacattttgactcttccctttaccaagaaatacaaacacatctgaggtttaactcaacataagtgtaagtagatactgtgatgacacatgagcccctgctgcaatagcaggtactggggattgctcatgcgtctgctggagtggaattgcctggtattcgtcaggctgatcccagaagaaccttggataggaaaccggatggaagctgaaacgtcttccccaaccttggtccaacttcatttcagtgagctcttcccagcaccctgctggtgaactccagagagagtaaatgggtttctgagcaggaagcgtttcttgaagatccaccttgattaactcattggaaaatcccagtgagctgcatctggggagatttcaaatagtgaagcaatacatagattttctcagataccttttcctgtctgcagaattcttgaaccatgataacagcagcagcataacagagacagcaaccgatttcggtaccagggccagggccaggcatgatgcagattcaatatggaacgccagagctagaggagctagaagctaccccaggcctcatcagaatgctggagtcagaattcgatcccaggtctaccagacatcaaaacctgggcgcttgacctctgcactatgatactgccttcaatatcagggcgggtggaggagatatgcttttatttatttatttatttattttattttttatttttattttattttttttttgagatggagtctcgctctgtcacccaggctggaatgcagtggcgcgatctcggctcactgcaagctccgcctcccgggttcacgccattctcctgcctcagcctcccgagtagctgggactacaggggacccccaccattctggctatttttttgtattttttttagtagagacggggtttcaccatcttagccagggtagtctcaatctcctgacctcgtgatccacccgccttggcctcccaaagtgctgggtttacaggtgtgagctactgcgcccggctgcttttattgtgttctatgaggtgcaacgttccgttatatccctggagtagaatgcatgctggtgcactctaaaacacggctgggccctcccagggtggggtggttggtcgactagttgggttttcagaggcaatattgagagagttagtgtggcagtgtgaaaggcccagaataaggatggccttggggcaggggtagcctcttctacatgcttttggggaagaatttctcctttctggccctcgtgtcctgttttcttccctgtagaataggagtttgggtaatcgctagtgatctttccaagttctacaatactgtgattctcggagattacagagttcaaaggaaacagctcataaggagcaatttatgtactgtggtaggttttctagcacgtaccctggagatctgaactatgagaaattcatctccgagcagcccttggcattttccacccaagtctcatacccatggcccgggatgtgggtggcacccctggggctgtgccatggggcctggcctaggagttctgtctttaaataaggacagatcctcgtcatttaaacagaaaagtaaaaaatggagctcaggttgtgagtccttttgcaccttgtttgggaaattaatgactgcagagatttaggaatacggtccctacgtaactttgccgtgatgatcaagtcactcagcacgttggcattttacgtgttttgggtgaacatgtacagcagattgccatgtctaatacctgtaatgctgcaagttcccagagaaaaagatggaactcactcatctcctgtttggggagaatttcatccacactctcgaatttccccacatccctgaggctttcatgccaggctctgtcctcacttttcctgctcacctcctgctacgcctgtctaccgtaaccagtgagacttcagacggcagattccagggggcatctccagccagtccctttttccacatccccctttgcatggtggagagactgcccgttccccaggcagacacccgccacctccgcttgtggctgcgtctttccagagtgatttctggtcacacccacccctgcaagtctcccatgatcctggattctcctgcccgacctttgcttatgggctgccctcctttcccacctccgcctggcagtcccacctgtccaccgagcctcctctcaaatgtcacctgcctcgtgggccactcggccgtcctggcctcctgccattcccaggacaccttctacctgccccgggctcttggctcttatcgtatgttctcttgtattctaagtgtttgtttacttctctaatctgctttaattatttttgtacttcccacttatattgctttgaactttgccctgaacacaccaggggttctaggaatacttgttgagttcacaatgaaatgaaacagcagcccaatcttccaactgttgtggaagaaaacaaaaaataaagttgggtccctgggaagttaataggcttcctgactgctggtctaaggtgatttctggccatgtaatctttcattttttcccttcccaagggggttttattaactggagttcattttcccctttggaatgatgcagaaatggcagaggcctcatgatgcttgcgagggagctcagtgttgtgtgtgactctctttgtaggagcacgccaagatgtcccttgtgactgtccccttctaccagaagagacataggcacttcgaccagtcctaccgtaatattcaaacacggtacctgctggacgaatatgcgtcaaaaaagtaagctgacattcgctgatgagacgcgcagagctttgattatgggggtctgacatttaaaggcttttccagttccgtcagccctggagaggcactggtttgcagggagtcagagagcagagatggcagcctctcccgtgcccaggtcctgccacggagcagcactctgtggagctggcgtagtgttctggcaggtcctgctggccgagttcagctcctgatcgaggtggggaggcaggaagtcctttgtatgagctcgttgattttactgctcatcacatgccttccagaactaggatctaaaaataaagccacccaaaataaaaagcaatgagattgaaactggtgggaaaggctgtcggtaggagagaagttaatgggtggcagagtaaagacagaatgggaggcaatattagtgatttggctacatcgatcatggatgtgccgagatcaagaatccctgcctctggggctggtgtgcacctgcatcttccggaagcttctcggggatggcctcatacaggatggcagctcacgcccccatggacactgtttgtgtagcagcaaatctgcaatcttaatgggctgattggaaggctgtggtgaagggagggagggaccgcgggcaggcgttctgcagcccaggtgcctgcctcatgtcacccacaccctatgtttagaaacgcttagggtacttttatttagttgccatcccttgtgccaaacaaagccaaacatttgcagcccctcccagcagccttggggtgtctcaaatccctcaagatatatataatcctggcgtggagccagaaagactgtggccggcactggctggctctgaagggaggtggcaccagccacagtgagctcagggagaaagcaccccagggcgggcatgtgcggggtatgggtgtgggcacacagggacacaggcttgggtttgcctgtgtgcaagtgtgtgtacacttgtgtaggtttgtttatgtgtgcacgcgctgtgtgtatgcgtgtgcatgtgcttgtgggaaggcgtgtccttgcatttatgcatttatttgcatacacatgtgtacgcatgtattgtatgtgcatatgcatgcatgtgtgtgcatgtgtgcatatatgtgtgtaggtgcatgcctctcatatgcctgtgcatgtgtgtgtttgtgtgtgctctgcatataccagtggtttggggtgtgtagagagaaagtgatgtgtgtcaggataaatttccatactgtgcctgagcatgcatctcctaatcgtgtccatgttcctgaaggcgagcttccacccaggcatcttcccagaagtccttgagtcagcggtcgtcttcacagagagcctccagccagacgtccctgggaggaaccatctgcagggtctgtgcgaagcgagtgagcacgcaggaagatgaggagcaggagaacagaagcaggtgagcacatggcttccctgactccacttgtgccctgcgtggggtcacagtggagggacagtggggtgaggagggaagagcgaccttagctgagagggaagatcaaggaacacaggccatgcctggggtgagagggagaatgctgctgtttcccaatcacctgcttctctttaccatcattatctcaattaatctgaacaagaaaactactgggcaccagcttcccaccattttgcagaagagagcgttgctgttcagagcgctcacgccactgcccaggattccatgtctcacgcatgtcccagctgggcttagagctccagggtccgtggcttccaagccaagctcagtccctttccagacagagcaggataagcacacatgaaaacatcaagacctagcagtgtgagagtaattctgaatttccacttgcaacctctgtagctatgcaggaacagccgtggaggggtgcacattcaagcaaggtcatcttcctaagcgggagccagggttttaaacagttgtcgtgtggaaactaaagagttgggaagggattctataaattgtcatgctttacatttcaacagaggcagctcgtggggtgaaatgtcatgggaatgggatggattaataaaaatgccagtcttaaaattatttccagatgacggagaaacaggtggtgatatggctttgatcttttaaggacaaagtgaacagttaaacgttcgcgggtgccttgttttatacctgctgtattttttccctcatctccccctgctacttctgggaattttctctatatcttcaaagcatttaaaacctgaaggaaaaataagatttgagtaaacatctttcattttgaaagtttcagaaagatgaagtcatctgttgaatataaacaatgtatagccaagaaggttaacgaaggttaacatttatttttaaaaaattgaatttttttaaatgtcataggataattttgccatgtaaatgaattctagtgtaaagtgaagatttcttttgtgaaagaatctctttgaaatgtagatgttaacacaatccagatttttatgtattggattaaagggttcttctacctatatttaggttttgggggctacaatagaatacttgagcttatcattttatttttatcatttaaacattgatgtgaacttgaacatattgcataaacttcctatcgctcaatttccctgctggtaaaatggtaacagtgagtggcttactgtgattcatatggttttggcagcaatgactttcaagacagccttggctgctggaaattgtcctaaaacacattggtctatgctcttgcaataccaaatctgactcaaagaagggatttgagtgactggtgaaggggttatgttctcacggcacctctgatcctcacgttaaatgccagtctgtcttagacgtagtagagacgggggacgaaggctaggcactttctcagctttgtgtggagcccacggctcatgctctccatgagattttcttcagcagcccccgagtgttgtattctcctaacccatgtgcatgtcttccatggggaagatcgttttgaaatcagttctttcctcctttaaaggtaaacataagtcgtggggatctcagtgagttgggcaagttctaattgagatttattgtgaagcctgctctatcaccgtcatgcagaagggcccaggagggatgagtgagccccgtgctgagtgatgtgagcagctccatggattccagcccttattagaattcaccactctcacgggctgcaagcatcatcacaagcatgtatttatccctgacctcccaacgtggatattagtttagcgtgctggacaagttggtcctttgcaaaagatgaaattgtgggctcactgatgtgagttactgctgatgtccctgtgtcaaataaatactgaagagacattggcgctctgaaggcactcaacacgtccttctggaagatacgaccccggtgctctgaaggcactcaacacatccttctggaagatatggcccattggaaatgtccctctgacatcttccttcagtcccagtgaaaaatgggcctccctgaatcttgcaagccacctgtcccggggcttgtcatttacaatcagtgcatgacaaatgacgttactgtgcacacgtgggctgaagtgacggtcaactgatcatcagccggcagaaatatttcctcaatgtcctgacttggggttggctgtgggaggaattccagaccaattagttattctgaatcatggagggttagaggatagtggtgctattgacctaagaataagctgaggctcttgttactcaaacataaagagcccatagaaaagtaaacggtgtcaagagaggacatctgaacctttaaactcatcacagtgctgcgtggcgcagaccaagctttgtcttctcgatccctgcaatttggtgggattcactcccctgtaagaaggcttgttccctgcaggacatctgacgccatcgttcatttcttgaacacatattcctagaactcctcctggcacctggcacctggatactggggaaccaagtacctggatactggggaaccaagtacctggataatgggggaacgaagtacctggatactgggggaaccaagtacctggatactggggggacgaagtacctggatactggggaaccaagtacctggatactggggaaccaagtacctggatactgggggaacgaagtacctggatactgggggaacgaagtacctggatactggggtaaccaagtacctggatactggggtaaccaagtacctggatactgggggaaccaagtacctggatactggggcaatgaagagggcattttcccgctttgttgggattcagagttacaggacagggctggtgtcattcaacatgcacatgcatgtgcttatagaggtggcacgtgctctgcaggaggaggatgaggacgtatgaaagagacccacagggctgtgatttgagggtggccctaggggagaggctctgagggagagacccctgtgctgaaagcaggaggagcagaagccagcccattagaggttgggaggaatctaccccaggcaagagggcatgcagaatggctgaggcccaaacagactgttccctaaacattgtagggaaaggctgtgtgtgtggtcggagcggggacagggaggtgcgaggtgaggtccccgattcctaaggagataaatccacattcctttcatggttagattttagggttcctcccacctcatttctgtacgaagaggctgcagacttctgcaattctgattgcgaacttcccaaatgcctaacaccaggccttagtcttaatcgctgctggggaagcgctggtccatcggagccgtgtggggttgtggaagcacctcggacagaggccctgcaccctgggtctcggacaggccttaccgccaacctgcagcgggtctcagttctccccaggtctctggacagccgtgatgctacggtcccctccagctccgataccgggactttctgtgcgatgtggccctggccaagaagcctcttggtggctcgtgcacagtgccacaggcggcgctccggctcagccacctttccctccaccgcctccttcccaggccgtctgtgcagcttcctgtccctgccactggggaacgaacctcccccagcctaacttagactactgagtatttatgagacatcttctatgtgctgaagctggggaatacagaggtgagaagtagccaatcctttctcctgggaaggataaaatgtatgcaaattacgatcataaaggccctaagagaaataacaggaggtctggcgttcaagacacaggggagaggattagggatggctccgtgggagacatggcatctgagatgggtgttggaggaaggatggagttttgattgaaagggatggcagtgagatgtttctcacgagtgggacagaatcccaagaggggagcagaacagcgagcgtcctaatttcagtgggaccttgggaacgcgatggtgagggaggttgatgaggctgaaagagctgctgcagggtttccagagcatctcagagcatggaggcaggccaggcctggccgtgttggggtgcgatttgtggggttcacaaaatggcatgtgagccgcgacgatgtgaacatttctgagtccctaaggactgaagatgctgaatcctttaatcctttatttattattattatttttagtattcagacattcctatctgtatatttttaaactcaaaatactttaattcagttttaaaatcactcagaaactgcatccttctcaggaaaataaatggcttttatttgctgccctgcagaggaaaactcacacatggggagctcaccattttcctacattttcaaatcatggaactgacttcaatagcaccgttagcccagtagcacctaacagttttgagtctcagacctgggaaagcatcaagccgtttatcggataaatccacagaagttccctgatttcccgagttgccctgtctttactgagcacctgctgcatgtgagtttctgtgcacacgaagatgagtaacaatgtctctgtttttaagagcctcagattaagttcccgactctctgagtgggtgcctgttgtcttttgctgctcacggtaattctccaaagcatctcttagggcctccaagcggtttgcagttgtgcactgtcagtggtgaaagaaagttggggcaggcacttcctgtatttttttattaataaatcacatacatgttcttctttacaacttcatcatgcatggcattcacacaccaaaatatactcttgaagatagattcaaatgagcagaagtagcatttctcctgttctcttcttgaacgcacttaaggaaaccctagggagagaatgggcatgccctttccggccttcgggggccacgtggttttcttcgtgactcctgcaactgaggctgcttctcggctcctgcaggtaccagtccctggtggccgcctatggtgaggccaagcgacagcgcttcctcagcgagctggcccacttggaggaggatgtccacctggcacgctcccaggcccgcgacaagctggacaaatacgccattcagcagatggtaggagggtctcagggtggctgggtgtctgggaagcgtggactagatcttagcttgtctgcatggtgctcaaggggccgagggtggagcttggctcgctgcctgggaacctgaccatccttgcttctcggggcagatggaggacaagctggcctgggagagacacacatttgaagagcggataagcagggctcctgagatcctggtgcggctgcgatcccacaccgtctgggagaggatgtctgtgaaactctgcttcaccgtgcaaggatttcccacgcccgtggtgcagtggtgaggggctctgttcccagggggtgaagaagtccattctgcgttttctttcagaaagaccccagttaaggagacaaacgccattgaacctgtgctggaggccacttaccttgaaactctaagcagaaatatgtttatagaagctctgaacgttcactttaactcatatgcaaacatttttattttcatgacattgagtcaacaaatttttcagagggtttttttttttttttttttttttttttttttttttttttttgagatggagtctcgctctgttgcccaggctggagtgtgatggtgtgatctcagctcagtgcaatctccacttccctggtttaagtgattctcctgcctcagcctcctgagtagctgggaccacaggtgtacgccaccacgcctggctaatttttgtatttttagtagagatggggtttcaccatgttggccaggctgatctcaaactcctgacctgaagtgatccacctgcctcggcctcccaaagtcctggggtgacaggcatgagccacacgcctgaccagagtgtattgtttaaaagtcactaccctgaaatgatcatggctgttgtcctgtttgcaagagcacgtgcatgattgctgactgtacacaaaactggaaagtctgcttttcaatatggaaaactcataagtggaaagcataaactctaaagttttgggactgcagatctgcagttaatgaagctgtggtaattgaagaattacatctttaagccctcaagaccctttttgtatcaacatatattgctaaagttatacgtatatatctatgtgcatttatatgtggggttgggactctgagccacagaccaggcatatcgtggctgatggctggatcctgaggttctttggaagacaggcttgggaggctgaggctcgcctgctcttgatgcggaggtgctggggtggatgtggtcctgcctcctggatggagccatgaagccagcttcctttcaccagggtcagtgcgttaggtcccgcagaactccctgagacactagctacactgcagcttaagtaggcgggtccgggatccagcacccagtgtttcttatggaatgacaagtcctgaattcctaacaaaggtcaggcaggtgtttgatctgccgaatggggaatcccctgagagtctgaacgaggaaagcgctgctctcgccttagaaagcaaaaccagtgcgaactctgggcctcaccgtcagggctctgtcctcctcccgcctgaggctctaagggaaacctgcagaaatgggcagcaggcgcgggggagctggggcagaattgcacacacacaaaatacaactctgcctttaaactaaaaacatgcctccctcatttaggtacaaagatggcagtctgatttgccaggcggctgaaccgggaaagtacaggattgagagcaactatggcgtacacacactggagatcaacaggtatggctgtggtgggggctctggacgctggcgtccagtaatcagcattgcagaccccaaagaagaagtcagatgggtaactggaggccaaatcacacctgtctgtttgcaccccgggtgactttaaatagcatttatgagttaatggtactggtgttggaagcttccctttgtttttctttagtgtctggccagaggaatgcaaactctgggaataaagacagtagatagttcagggaaaggtaatggcatctgggtggaaaggctgccatgcagtgcaagaagctttcattgacacctcctgccaggttcgagaaacacaccctaagttcagactcttcaaagaatgataacctttattttcttttataacaaatcaaaaaagtatatgaaatgtagacaaataaaagaaaaacaatcatctatacatccagcacccagggtcagtatgttgctgtatagctggcatttcttttttcctcacgcgacacacacactttttttttttttttttgaggcagagtttcgctcttgttgcccaggctggagtgcaatggcatggtctcggctcaccacaacctccacttcccaggatcaagcgattctcctgcctcagcctccccagtagtggggattacagacatgggccatcacgcccagctaattttgtatttttagtagagacggggtttcaccatgttggtcaggctggtctcgaactcccgacctcatgtgatccacctgcctcggtctcccaaagtgctgggattataggcatgagccactgcccccggcccacacatttcattttttaaataaaagtgagacactgctgttctttttctgtttctgtgcatacacggtttttacttttcacaaaagaccctgacattacacaagtcagcttttttcagcagtagtatcttgtggcaccttcctatggctctcatgttaatttttccagtgaacctgactgcctgtttttgaacttaaggagcacacgcttgtccaggagccagaaggccacatttaccatgtgactttggataaaccattaacgcctcctgaaaacaattatcaagagacagatagtaacaattttatcttctctataggactaaaagagttactgtgagactccaataagaagatgcatgttgtgtttacatatgtttatatatataacgggaggtgtggggtgtgtgtgcttgtgtgtgtagtcagttatatcaaatcccttctaggaaaacatgagggatgtttgtataaataaggtaaaaaataagtgagacattggaacatacgattttattgattttattctgactaaactgtaaagcagtgagtgcatcattgttaggcctctgttcttcagaggaaaaggtgcctgctaattcccagagggagctcagaggagctcaggagggtgaacacaaatgttgattgatcatcctgcctcccctccccagaagcctgcttggaaggaaagtcttgctctgttcgtttgtttgttttttaaagcttttatacattggatcctgttaaaaagttatcctgacactcgttaaggacattaaggaagacttccttcaaggaccacagggagggattcttgctctgggggagagaaaccgggctcagctctgagtacagcaggaaagtgggagtgagaccaaggagtagggtagggcggatgggaaattactagggggagatgggggtgagggggttccggccgagcctccccagcagggttctggctgaaggcaggctggggccatcagacatccctggggatggaggggtgaggagcccatctgctatcgagggaggggcttgagttgggctgagctggtgggattcttactgttgagggcccaccaagcctggggcctggttgggaagagggttgaaaggagctgtctccggtttagtgagggagggggtctctgtccccatccagcctggtgtttagtgagggagggcgtctctgtccccgtccagcccagtgtttagtgagggagggtgtctctgtccctgtccagcccagtgtttagtgagggagggcgtctttgtcccctccagcctggtggttagtaagggactagtctttgtccccgtccagcctggcagaaagttgggctctgcctggcttctctccctctgtctggctcctgccctgtgccctcccccagcatccttaccaactcttcctcttcctgccttcccttcctcctgttcccgactctacctggggcggtggcttcagccagctcttcctgatgctcatcctggtggcctgagcatggcttctgcccggtggtgcccctccccgagtcagggggtccaccagctcctctgtgtgtgggactccctcctgcttcctcctcccaggagcctgcatggggcctggggcctttgtcctgctggaatggtccaccctctgcagattcactagagttgggtgttgaaaggcaataattgagattgaaatttgcagggcatcctacctcatttctccagataaatccgggtttctctaggaaagctctccttctggcgggctccttggccctgctcacagagagcttgctgtgtgcctggtgctatcctggatgttcgagaggcttcaggggccaagacaaggatgccgccttccaggtcccactctctggcatcaggaggcaattgatgagtgaaggacacagccagccacagcagctgtgggtgaggggagggggctgtggcccgttgtggtgtgaaatagatgccaggtggaccttcatggagatatcacatgagcaaggcttgaaggccagtagaggacccagagctgtggagtgggtgggccccctggcacaaaggctctgagaggtgcattgggggtcctgggctggggggttggcaggggacaagctgtcacaggcatagccagtggccctgcagatcacggggaccccgtgggccattgtaaggacattggctttgctggagggaggcggggagaccccagagggctgaggggagaaggaaggatgtaacattgacctctagaggatcactctgactgcagacaggctgcagggcctggcaggcctggtgggagcccttgctagaatccgggaaggaacacaggcctgggagcgggagggagcaggggagtgggaagaagtgggtgctctgggcagcttttgagggtagagccagcaggatttgctgctgggctcgactgggcattagtgaaagagaggggtccaagtattctcagagctgtggccatcacagcggggtaggcctgggttgggcagtggagttaggcacaggctgcaaaggatgcctctcctggggccctctccaagtttttcagagagaaactttctctccttggatttccaaaagttgtgggagttttaatagaccgtaggccgtcatgtctagaaagagaccacctgccttcattttggacagctcatgggtgtgtggggctgtctgctttctaccctgtgtgtgctgtgaatgtttaggggtaagtaggttggtctgagttccagatcagcttgttcccaagctgtgttctgataattgttttaaaaagaaaagaatgatatacctttctcaagaatgaaaaacgttgcgttgacatcggtgttggcaacatttaaactttacattgggcaccacatgggcttcgaacggaatggactaatttgtgagataaagtcgttgaatccgccccggaataccacaagtcaatgatcccctaatataggtctcctctgatggacttggattttgcttgcatatgcaaatatttgggaaacttgggaaaaggaaacttccaagaccaccttttgtctcagtattcttgttggtcctaggaagctccaaacagatgaaatgttaatattcttcgggaaaagagcaatgagataaacccacaaattacagcttgtctcagctgttcataccaaactgctgagccgccggtcatccgatctgtggccattttcagtggcagaatgtgttggcacccacctcttgattggctcaggaatgagcttttccttctgtgacatgagtgacatttattcctatgaatattccttggccacggtagctggattcttaaagtgctgaaaaagaagctcccccttggtactattttattttaaatttgtaattgacactgttttatatgctcataagattttcccatgggactcatgatgtgagccctcattcttcaaagaatatgatgttctcatatttttatgaaagtatttataatagaacaatctatctggttttctatcagtaacatgctcactccccattcattctttgctgagtgattttagggtgaaacgttttttgtactttatttttagagcttgatgtttaaattttgatttaattaaattataaatccagcgtcatcaccacttataatttgaggacatgaggccccagctgcccatgagaattgatatggcacttaaccttatggctgcccatctttaagacaggacagaaccagcttctcccaggaggttgttttaggggccttcaaacagagactctgggatgccaaagggcgccatggacgtttgtataaattgagaccagagaagactctctccatctattctgggaacctgtcagaacaggaaataaaacccttgcctctccctcacttgcttgcaagttctcacagcatgaagcaaaggctggaattagactgggggtgagctgagtgcctgtgtggggcctcgggaaggggaggaagacgggggtcctttggaaactgcccatgggccaaagctgtgatttgcctccaaatcccaagtggacacaggctaagctgaggaagtctccgcgagagtggccgcccttcctcctgcatctgctccgtcgtctgcccaggccccctgcttcccggcctcggggcaggcagggggcaaaccctgggaggcagggcaagggtgcccttacctccctcccagggcaggtctttgcgtttgtttataacctacacagggacctgtgttccaacacacttcatacagtatgaaacaaggtcgaaagagaaaaggtgagacagcgggaaccataaacagaaggcctaacttacccgtgcccaccgtgggggtgaccgcgagctccttagcggggcgcctcctgcatggagtggggccaccgccgtcgtcagtgggtcgggatctttgctccggtgacgggtttctttacagaaggaaggagagcgctctcttcggagagcccacgtgttttgcagtcgctgcgggaggccaagcggatggagggcttcttcccccagtggctcctgcctctgagcaccaagtgctaattggtgacttgatgagctaatcagtgctaatgcgcgaggttgcactcccctgggatcttaatgcctgaagtcaattgaaaaacaagctccttgccctttgggagaggctgctggctggcgaggggggccgtggcctggggaacacatctccctcctccttctcctccatccccctcctccttctcctctcctggcaccagtgatcttatttcctacattcttagacaaggtttatccccttcctgtacccctcccagctatcccctgcccaggagctgtgaaacagcaattcattgcagttctcaaaagacttagaaattgtgttgctttataggactgtaagggcaaggagggatttccgtagaggagaggccagaaggaatcatctttgaacttttggttcaggaattcagctattatttcttagttactaatatataagattaacattatatgataaaaccacaaaatgttttcaagtacattgttttatttaatcatcaaagtcaccctagtcaagtgtgggtgctcaatacatgtattctagaagtctaaaatacccacaatgtgtttattatatagtcagtagataagaatgatcgggctggtctcatgaaggcaccagtttggaaggagaatttgaggctggcagctgcaggtgtgtaaaagccttggcaggccaggcacggtggctcatgcctgtaatcccagcatgttgggaggccgaggcaggtgaatcacgaggtcaggagtttgagaccagcctgagcaacatggtgaaaccctgtctctactaaaaatacaaaaaattagctgggtgtggtggtgcgcacctgtaatcccagctactcaggaggctgaggcaggagaattgcttgaacctgggaagcggaggtttcagtgagccaagatcacgccactgcacttcagcccgggtgacagtgtgagactccatctcaacaaaaaagagcctcggcaactatttttgccctggattttcttcttatttcttcttattgcccagtgtttcttcttattctctattcttctcattgcccaatattgaaaaaaatcctgaatccaagacaagtagtttcaaatgaaaacatttttaccttgacatctcagaatattatccaattacatagaggtagtaggagaagctctgcctgaggccccggtacccatgagttaagtggctgcgtaaggttcatgttgggcttcgtgcctgacaggtgtgtgatgagctgagtctacactgacaccacagtttaaaaacggctaaaacacacggaggaagaaatgtgcagcacacgggggagattccagttgagagccgtggggcgcagtgtgaacgctgttgatgttacttaacaggcagcagcagggttttcaaggggttggctggagccctgtccatgtagcccacactcccgctcctcgagtacaagggtgggtcaaggcgttcacccttcctcactgaggaactggtcatgacggtgacctgctgggcttggggacagcccgtgccctggtccagccgggtcacatcccgtgagtcctgccctggtccagcagggtcacgtgcagcggttcctgcacgggaactgcccgtgcacctgctctgtgcttctctggtttatggctccctccttgagaatctgagtccacctggcttgtgcgttcacaggacaggctccaggtcagcagattccgatcaagcagattttacagaccgccttgctcacttccatatactctggcattcgaatccttccagcggtgcctgtgggaggctgtcgcccttgtttctctcatctgctgtgttattgctagtgggggtgggatcgttgtagaggaagggttaggatgaatcccaaaagaagaatatatttgggtttggagaatgcatttttgaaaacataatggttttattatttagaagaagtaacatgagcacaaagtaaacaaacaaacaaaatgcagcaatgcccacgggtcctgcagagaagcacctcctccttccaccgcggaccccagtcccaggcatgttctgagaggcagcagcacaatgcgctccctgtggggatgcgtatgtgagtattatgtgtgaattatatgggtagatcagcacaggttgttaatgcttagcattggagaaagcctctacttatggggtttttatgtgttttacacacactgttgctttgcacctggggacatggctgtgcctgtggtgatctggaaataggacagcagcgtagcttctaatgagttcaggctagaattgtagctttgctgatggctttgtagttcggcttgtattcctccacggtgaactagaagataatgttcttggtttgaaaatctacccagactgggctctggtgtgtgatctgtcccttgagcaacggcagttagggaggtcagatggttttatctgacatattgaaactggatttgaacttcagcaggaggggaaagaattctcagtagatagcacagttctcggacacgttctttcccttttgttggagaaacggaaatttttgatctaagaaaatattttcagcacgtatagtggaacagagaagaaaataaaattactaatgacttcgcaggaatggattttgtctctggaggcactggcttcttaatgcatttgaaaagtgagacttgagtaactcttgcttttctcaaaagtggggactttttgtgttgtttcttttcccacgttaagattctgctcaggtgtccatggcttggaaaggagctaccagaaagaatgcaattttggagtcacgtggaccttgtttacctagcttcttaccttactgtgttgattgctcaccatcctagtgggatagtgatgtctgttttccaggctacttgaggatgaacgtggaaatgctgatgtgaagtgacttgaggagggcttggtgttgagtaaaagctcagctgatcttagtgcctcttccttaccccctcttgtctccatttcctggggaagctggtgggaagacagttcacagccaagaagagaagttttagctttagtaccatggatatggggaagcagaagacccacccccacaggtacttgggttttgtgagcctggctattcctaagtcatgttttttttgttttgttttgttttcccagggataaacacacatcagtgtctcaggtggagtccaactcagacatttcaatacacccttgagtgggtgattcatgtcttgggatcatattactttgggattctggatgtagcctcttattagcatgggaatcctactggggagctgggtagggttgtagaatctgcttttggaacagggagtttgtcacttagaagttaatcggtctctgcaccttggaaccctctgtgtacgccaggtacaagctgtgttgagggcttcgatgggttttcggtggtttcatcccaggattctcatcccaggggcattaaaggatggagagcatcgtgggcgcagctcttcaatgctcgtgtgcgccaggcagagagcataccggggggcggcagctcttcaatgcctgtgcacaccaggccgagagcatcctggggacagctcttcaatgcctgtgtgcaccaggtggagagcatcccgggggcagctcttcaatgcctgtgtgcaccaggcagagagcatcctgggcacagctcttcaatgcctgtgtgtaccaggcggagagcatcccgggggcagctcttcaatgcccgtgtgcaccaggcggagagcatcctggggacagctcttcaatgcctgtgtgcaccaggtggagagcatcctggggacagctcttcaatgcccgtgtgcaccaggcagagagcatcccgtgggcagctcttcaatgcccgtgtgcaccaggcagagagcatcctgggcacagctcttcaatgcctgtgtgcaccaggcggagagcatcccgggggacagctcttcaatgcccatgtgcactaggcagagagcatcctgggcgcagctcttcaatgcacgtgtgcaccaggatcacctggagagtggagcaaagctcaagctcccggaccaccttagaactcgcatgggatggactgccccatgggaacgactccctgtatgggaacggctcctgcatggaatggacccccccgccatggttcagggcctccctgaagcagcactctgccttctcctctggcagcatcctggctcctacacggagcaggtccacggctctcccaggcaggctctgtatcatcccatcacgactggttcttctggagcttgaggtcacgggaggctgtccattgacaagatgaaaccgcgcattccatagaggtagaaaaaataggaccagaatggaatagagacttctccttgagaatgaacaaaggattttcaggagtgccagtacctttttattcttaaggccgaaactgcaccatcttctgggatcaggccttcatctgtgtctataattaataccgagtgctgcctcacctttccaaggacagagctggcattgttcttgcacaaatcactcatgaacaaataaaccacgccatgtgatttgctttcgaggaatgcttttgtgcaattcgggtcactgacttttacacaacagtcccgcagactttctcttgtttttttctctccaagggcagactttgacgacactgcgacatactcagcagtggccaccaatgcccacggacaagtgtccaccaacgcggcggtggtggtgagaagtgagtgccgggtgggctttcacggggcacctcccgcctccttttctcttttctgctgcactcactttgctgtcttgcagggttccggggagacgaggaaccattccgttcggtgggactcccgattggatgtaagtgggtttttgtttcttttctgtgtggtgaaatgtttagtgacatagcagacaatttgaaaacatggtttcctaagggccaaatctttttttttttttgagacggagtctcactctgtcacccaggctggagtgcagtggtgccatctcggctcaccataagctctgcctcccgggttcacacctaagggtcaaatcttttttacaaaaatcatttcagagagctcctccaagtttctcctggccagtgttagcatgctgacaatttgttcccatgtaattctatggctaggtggtatttttagactggtgaaaacatcacttggagagactttacgtttttgaactggaaaaaaagagacacatccaaattcttgacctgaatgcatcatgttgctgtttcgtgtttaaggagatgttttttttttctccaaaagtctcttggtccttgtaacaaatgacttcaggtcaaaacaagggcagtgcagcaggctttggtccagagacccgccccaggcctaggacctgccctggccctgtaatgaggcgaagccctctctggccctgagctggcttcaccctagcagtcccatggtgctgggtgacccatgctgggtgaggtgaggcggtccccatgagggcatctggaggacggggacatgatggatgccctttcgaggcagcttgtttatggcttgggagtgagttttagaattggcctgaacttcccaggaaggaaccgtacattccgatggaagcactgattttactgtaatgcgaggcttagttgctctgggccacgtgctgggagtggagagttgaccgaagcaacgatggagggtggagcctcctggcagctgctggccgctgtgggcgtggcctctgctcgcgatttctgtgtgactttttttgctgggctacatccaacactcggtgagcccccaagaccaccaaagggcaggcagggatcagtccaaagtgagcctggggagcccgggagatctgggtgtctgtgtgtagctctggccctcaggacagcacagagtctgtgtggagagttgccccaggcactgatgagctgggcaggtcctggcagtcacctggtcccatcccggggtttctcctatctattaacattttatcttcctcattaagaactgtggcgcagttacagcatagatcaccatggaagaatgctcatgtgttcaccacccgtgtttgacagagggaaatatcttgctatttttgcttcagttgtttttcgtcgaagtcaaatttatataacacgacattaaccattgtacataacacaatgttaaccattgtacagcgtacagctcagggtagcttcaattattttccaagaactgaaacaatgacagagatgatggaagcagccagtgctgctcctgcccgtctcccacaccgtcctggcattggcagtggctttttaaattttttatttttatttatttatttatttttgagacagggtctcactcggtcgcccaggctggagtgcagtggtgcgatcttggctcactgcagccttgatctccctggctcaaggaatccttttgcttcaacctcccaaatagctgggactacaggcgtgtgtcaccaaacccggctcgttttttctttatttttttatttttatttttttttgcattttgtagagatgcggtttcaccatgttgcccaggttgttctcgaactcctgggctcaagtgattctcccaccttggcctcccaaagtgctgggattacaggcatgagccactgtacccggcctgcagctgttgtttaaacttccctacatgcatgtgtctgtaaaccatacagtttttttttggttttaaaaattcagtatagatttttttcctgacatgtatgtacttctccccctaccacacatatttttgaaatttaaccaggctgacgcttctggatctagttacttcatttgggtgaactctaaactctacggatgcaaataccaccgtttgttttgaggaggaggcagccgtggcttccaagtccatgtgacttgccagaagccacagtctggggctgaggttggacttaaacctttggtcttcacacacgatcaggttctcagccctgcctctgacgacaccgcaaagtcgactttgtgacatttaattcttccgcagtggcttgtctccgctccggctgctggaacaacacgccatggccggggcagtttacgaacagcaaacacttatcctctctgttctggaggcagaagcctgacactcagcaggcatggcttctggtgaggagcctcctcccgggttgctgacggcacctgctcacggtgtcctcacgtggaaggaaggaaggtctggcctcttcctccgcttccaagggcgctcattctcccctggggtcccactctcacgatctcatcccaccctcatcacctcccaaaggccccacctccttacaccgtcccattgagggtcagggattcaacactggaattctgggggggacacagacattccgtgtggagcacggacctggctacgggtgttccatgctgtggggcggtgacaaagacgtgcttttgcggtgacgatctgagtgtgtctgctgtcaaagatgctctctgccctaatggcgtgaacccgggaggcgaagcctgcagtgagccgaggtcgcaccactgcactccaacctggacaacagagcgagactccgtccccccgccccccgccccaaaaaaagaaagatgctctctgcccttcggccctgaaagcctccatcgtttctgtgcagtgcccctgtcatcgatgattccgtacacgcacttcgacgtccagtttttggagaagtttggggtcaccttcaggagggaaggcgagacggtcactctcaagtgcaccatgctggtgacgccggacctgaagcgggtgcagccgcgcgccgagtggtaccgcgatggtgagtaggacacggcccagacccgggcacacaccaggaggcttttggacggaaatgtcctttaaatgtgggtgtcaatgtggcttttgtctctaccactgggtcagctccagacagcgaaacaaactgagggactgtagaggacttggtggcccaccgttcgccttgaacttcatccaggagaatcctggagagggagaccccgaacctagagcagccacttagagactgatcgctggtacagtgacagaaagaatgatctcgtgccatttagattcagtttaatgcacattactgcatggaaggggctggttagcagcttgtgtactatttctagacagaaatgctaccttagtcgtattgagattcttttcttccttccatccagtcattttgtttttagagtttgatgatatggagggtctatgctgggttctttggagatgtgacagtagccccttcagctgcacacccctgtaatcccccacgggcgggaggaagccggttggggcagtggccgtccagcagagaagcagcgggcccccaggtgaacccagtttacctgaggacaaagctggcggccgctcgcagcacgtcccactttgacccactcaagtggcagcctgtgttctgggctgtgggtgctcagttcacgcgtgtgcttccacgaagtgcagctgttgggattttaccaggctgaggctctgccttccgtggtgtccagctcgactgtcctgtcccgctctgagacgacgctggtgtccccgaggctttctttgcctgctggggtgattttggatgcaaaccttccgtgttaacgctctttcagacgtgctgttgaaagagtccaagtggacgaagatgttctttggagaaggccaggcctccctgtccttcagccacctgcacaaggacgacgagggcctgtacaccctgcgcatcgtgtctcggggcggcgtcagcgaccacagcgccttcctgtttgtcagaggtgcgggcagcagggttctcagggtgcagaccttgtgtgtgcccggggaggggaggcagccctgggaggagggaggcgctgggaaaaggagtccagagggtgtgagaccactttgctccttggagaccccatgcggccccgattttccctcagtgcatgggcacgccaggtgcttcctgccgatgagcagacggaagaatcgggacacaatccggaatagaccagaatcatcatttttttgtctcttgaatcgttcatatagtcattagcatttgaaaaacgattcccaagagtgagtgccccagatttactcattctcagggaacgtagcccgaggatgaagaggggcacagtgttggagtcccagggaagagcttccttactctcctgccagcgactcattccctctggactttggcttaagagaggcagatgtgatgatgatgacagccagtgctgtgacctccaccacccacttcagtgaaactcgtgcttaagacacttgtggccatgacagctgtcatcaccagacgctttatgtcaggcagtgtgctggggtcctacacggatttcgtcttcacaacagactcactagggaagcttcactcattccatttatgaaaagaaagacaatatttgtgatatacagatatatatatttataaaatgcctattgtatacagcctataggtgtgcatgtatgtgcctatacttacataaacatccatgtatatataagctggaattcttacagtgatagcaaaaggaaatactgttctcagttttccagatgaatccatggaggctcagaggcaggagaaatgtctctagggtagagaagctcagatttaaattttgctggagcctggaacctgagttcctgctataactttgtagtgtttttggcatcatgtgactgagcagaaggggcccacctactcctactcctcctttttttttagttttgtttttgagatggattaacactctgtcgcccaggctggagtgcagtggcgcgacctcggctcactgcaacctccgcctcctgggttcaagcgattctcctgcctcagcctccccggtagctgggactacaggcatgtaccaccacgcccggctaatttttatatttttagtagagatgggatttcaccatgttggccaggctggtctcgaactcttgatcataagtgattggcccccccactcggcctcccaagtgttgggattacaggtgtgagccaccgcgcccggccccacctacgcttttatcagtgtctgtttcactcccctcctgcttctgccctgggctgcacctcagcagcctctgggtttaggggcagcctccttgctgaggcacagctgacctacaaagaaggcgtcagagcgctcctgcgccatgtagctgctgctgctctccgggtccccgggctcccggctccatcccgatcagccgggcatccttacctgctgcccaagttctcaccttcccacctgcctccagctccagtggggtgcaggacgcatccatacatcttcatgattactttttccattgcatccattagatcagagcttaaaggaaggactgtatcattaaagaatatttcatctgaaaagaaagagaagaaatgtcaaccaaacgtatctcaccctcctcacttcccacacgatagcctgagcttgcgagtctgtgaggttagacactcccgccaagtttcactgctgttgttaggcgggcgttaaatgtcccttccgtcttctgcatgtgcctgctggtatgatgctcagccccataaaaaggcaataaatgcaacacggctcaaatcgccttgctcactcagcaccagcaacaggaggaaaataaggcaaaggtggggagtttaaccattttcatcgctttctgaggcttttgaatgtgagaggaaaccatttggctcaatgtcaggaaatcctcagcttttaataccctgaagatatgtgagcaggaaactggatagtgctcaccctgctaagcatgcgtcacagggcagccagggctgctgaataaatacatagtttagataagaaggttcacattcagtgtattaactttctatgttgctctgttggttttcatgcagctgtaattaaacctaattgcattagggtcatcaatagactgagaaacgaatgatgcaatattgtcccaaatatttgctcaaagttggcgaaaagagtaaatcgcccaatttcctaaggattttgaaatagaagagtatctcaggtgatatttctcaggtgttagaaatgccagattattgtcactgtttcatccgcacatttttgccaacgtgccgttatgcaccatagcaggaccaagagaagatgacctgtaattcaggatctaatgacgaaaaattgtagactcagtgttttatcaaggattctatgttttgaagctttttaattcatacataattttatatttcttgtcaccaacccgccagagtaagaaatattctagtactttgaacatgagaattaaacagtggtcaaatcaaggggatagaattggagcttggaggagctgtaaacaggctttgcagtgaccccagcctttaaatgacaggcgtgtgccttttctatccctgccccaagatgctgacccgctggtcacaggggcccccggtgcacccatggacttgcagtgccacgacgccaaccgggactacgtcatcgtgacctggaagccgcccaacaccaccactgagagccccgtcatgggctattttgtggaccggtgagcgtcttgcattctcccggggatgggaacgttccgcatggaatcttaccatggacaatatattgagaaatctttctcaacgcaggttgacgttcccattttttgattggctctaggtacatggctaattggttgtataagttcctatttaggtaattggtaaatacggccaagtaggctgagcccagcataaccacactgggtttctttttgttgaaagtggaggctcgtttgcctgttgcacacccagtaaccaatcccaccaacgtcttcaggctcactctgagccccgcgctgtggttctgctgaggtccgggctgtgccccgtaccggacagggccctggctttagcagaattaaagcttggaactgtccttccctcctgagagacaaagtgctgcgaagaatgccagctcatttctaacaaagttctttccttttctctactgaggaataaggtgttcttcttgtttccaagtgaaaaatcttgagcttcgaaatactggagtttgtgtttgagttgataacttacatttaggtcatcgttggagccagtggagtttgaattctttgacttcccgtactggggacagcgcttggagcctgggaagtgtactgcacagagccagtgggtttactggatatgtaatttatgccctaaatacaaattccagttcttggagtaaattatagttgaagaaaatgaatttagaaattagacagagagtataagaggatggttctggctgggcacggtggctcacgcctgtaatcccagcactttgggaggccaacgcgggcggattacaagttcaggagatcaagagcatgctggccagcatggtgaaaccctgtctctactaaaaatacaaaaattagctgggtgtgctggcatgtgcttataatcccagcttcttgggaggctgaggcaggagcatctcttgaaccagggaggcggtggttgcagtgagccaagattgcgccactggactccagcctggcaacacagtgagactccaccatcaaaaaaaaacaaaacaaaacaaaaaacaaaaaaacaaaacaaaaaaaccacaaaggatggttcctggtagaaatgcaaaattttatatgtatattaaacagaaaaataaggtgattatcttaggaaaaaatgagggaattggcttttgtttgtttgtttgtttatgctgattaaattctcttttctcttccaacaaaactacttgtttggctgagacctgtgccatcaaactaatattttgatatgctagagacagttctgcagggagtgctgttccgggcttaccttgaattaagcaactacagcaagaaaaacaaaccctcaaaacgatcttcttttctcctgggacagctgataagttttcccgccatgttgacaaaaaccatttcctgcactgtctcagctaacaatccacgctcctcccctcattacaaaaagcgcaaacatgaaattcaaagcaacggaacactttgggaatgagggtgcatttggaagtggggggtgcagctcctcctctgcccttcctttgggcttacgacttgccagctgttgcctgaagttgcaggttttcccatcagacttttggttttgacctgttgttctcttcggctaaaacagcccatgacatgtggatcagacagctttcattaaaagtgctggatacttaggaggagagctggttctttcccagatgaaggcaccactctggggttgaagtgctccctcccaacactgattttctgaactagctcttttctcctgggaatttcatgtgaaggtttttttcttacatttttcaacctgtgaaaaacagaggttaatctttcctatatttccaggtttctggtcaggaattaatattttcaaaagacttctaaattccacatgagaggcattctagaaagaaatgtcctaacattattctaggagactgtaagccagctttcccagggacctgggcccttggtctcacagagtgggacgggagctggaggcagagggggctgagcctgtttccccagcctgggcctcagacgggccaagccgcagcttaggggtgccgtgactatgtcacgtaagtcggaacaagaactgttcaggatgcgtctaaaataattttttgaggagatttttgcctaaatgtgtttgatgacagaaattgatcttcagctataaattattaagattcatgggcatatattacatatataatagatattacatataatatatatattgcattttctaaatagctctgtcttctaatgtttatctatacaagtcaatatcttagcagcaaagattttactggcgtgagatattgtcctgttataatcagtgtgtgcatatatgcatatacctatgtatatttagtaggttgccacatttgctattctctgttgtttttctttttttaacttgaagatgtgaagtaggaacgaataattgggtgcagtgcaatgatgcaccggtgaaaatctgcaaatacccggtcacagggctttttgaaggaaggtcttacatattccgagtgagggcagtgaacagtgcgggcatcagccgaccctccagggtctctgatgcggtggctgcacttgaccccttggacctcagaaggttacaaggtaagctgctcacgcctaagtatccactgtgcccaggaagctttggctgttttgtgtgtgatttgttgtctctttccctcccaactcgatgtgagccctgagaatgccctgtgtgcagagcatagcacaggctgttacaacgttctctgacatctccaccaacatcactacaggaatgaaaacgggctgacgtacactctaaaatgaatgtgcctctcctccagaaagctctttgctggcatccagttaaattggctcagaattagaccttttttttattccattggtgatataatttcaacacataatgacacttagaaggccatcctattctgagttttaattttgcatgacacagattccttaatgggactgggcccttcgttatggttgtaagcgagccactatattttccttacgcacatggtcctttgcatccaccaccaagagctgagaagtgctaactgttaccaggacacttccagaatcagctctgatgcccccagaggactcacaggttgtagtcctaatgcagaggagatgcagagctggcacagaatgagggaaaacgggcttttggggaaaacttcgcatgtcaaatcgagtgtcaacctttctctccgcagccgttcatttggagggagagaaggagattgccatttatcaggatgaccttgaaggtaagtagcacctcatcaccccagctgctcagcccctggggatttggagttgtaattagagatgggagagatggacagagaacgccccctactgggcacggcctctgcatggaaaaatgaaaaccgcaggtcaggcctgcaagcccagtgtccatagaagttaaaaaaaagaaaaaatcaagcaagacagagtgagagggtgggagaaagggtgaaggattggtgactcttagactcacctttcatttggggtttacaaaggcgttctttcagggacttgtagagaagaaaccaaactaaagctcagacttggttcctgggtgatgtaagatcctttctcacagattgcattgtgaaatcgatttcattttacattttctaagcaaaaattttattcctgacattttaactgaaacggattgagtctttcctgccaaatgatgttcttggtccttatgtatatttgattttgtggatatttcttcttcctgatattccttttagagacctttagaaagaatgacgtgttaaggagaatccaacattattaactagaaatcaaaaggttttaactggacttagagttcatagagtgccatgggtgaaaacataaaaagaaagatttcaaatcagtgtggagccactggctagagagaggtgattttgagctgctcgctaaaatcacagccgtgttctctctcctagagctgcagactcaaaagcgttttctggattggttttctacatctgaagcagatggatccccaactagtatccacacattgcatgttctgccacatgaagatttttctctaggatctcaaaacaaacgtatgtcccaatgtttcccatgagggacataaactcccaaaagaagagcgttgagagttctggtcaagccaagggaacctttaagccttagtcaaatcctctggctgcagaaggacctagaactcaggaaggacactcaatacataaggaatgaaagtgagggatttgaggaggacaacttcttgcagtctcctgggcatctggctttttgagtcagcctggtattctgtctcatgcatgataaaccctccccatttttcggatgattaaaacatggatatttgaatgactgaaaaatggctccaaatactgttagaaaagaaggcctgcttgaggccgacgagcccgtgtagaatgaggttggttctggcctccgggaggaacaggcagcccagcccgtgtagaatgaggtttggttctgatctgcgggaggaacaggcagcccagcccgtgcagaatgaggttggttctggcctgcgggaggaacaggcagcccagcccgtgcagaatgaggtttggttctggcctgcgggaggaacaggcagcccagcccttgcagaatgtggtttggttctggcctgcgggaggaacaggcagcccagcccgtgcagaatgaggtttggttctggcctgcgggaggaacaggcagcccagcccgtgcagaatgaggtttggttctgatctgcgggaggaacaggcagcccagcccgtgtagaatgaggttggttctggcctgcgggaggaacaggcagcccagcccgtgtagaatgaggtttggttctggcctgcgggaggaacaggcagcccagcccgtgtagaatgaggtgggttctggcctgcgggaggaacaggcagcccagcccgtgtagaatgaggtttggttctggcctgcgggaggaacaggcagcccagcccgtgcagaatgagatttgattctggcctgcgggaggaacaggcagcccagcccgtgtagaatgaggtttggttctggcctgcgggaggaacaggcagcccagcccgtgcagaatgaggtttggttctgccacgtgggaagaacaggcagtcccccttctcactcctcacgagcagacagatcagggaggaggtgggcagcccggatcacgctgagtggatgtgtaggaatccagcctggcaaaaatgacccacggtgagaaggtgtaacttgctttataaatgtcacttatctgtgatgaaatttgccttctgtaaaggccattgagaagagcactggggaagggaaatcatgtaatggaatgaaccttccccagggcagaagccctgcctttttggagagagtctatctttctagtgagacatgattgtggtggggtacacgaagcccgctgttcatgaggtgtcaaatgaagaaagagcgcgtgtcctgaggcttggtttgccagttgataaagtggaagtttggcatccagacactgtagctctcatttcccgttggagtaaagacacagatgctcttttccatggtctcgtgttttccttgctttcagcaaggcaggtttctggctgactgggcctgtgtcctcctccgttggaggcggttgtgaatgtggcaggatttattcatcctcaggggacttttccaagtctgtgtttatgcggtgggttatgggaggctgagggtgagacttagatggaaaattgcttgacgagacgtggacactgcctgaggctcagcctccccggcttcagttctctgacgtgacgctttgtgtgcattgaacaggcaatttccatggtcagaaacaaactgggtatgaaattgaaattctgctgtgttgatatggggttttggaaagtttatctgttcacctcagccattttaaacaaggaatatgtcctctaacttaaaaaaatctttagccaaagaaagagatctataatgtttcgaagcgaaccatttcgggattcaagaatttgctattaggaagttcccttttctacctgtgtcttttttcttcagctgattttttttcttttaccattgctttagctagaaaatacttggtaaatgccccttgttttaatgaaacagaaactcattactgttgctggctaaaaatggctcctctgctatttttgactttttgccgagtttttctcaccattttaatcttgggcaatgtcttccttcacacatttgaatggctatccatgcgcttgccttaccatcaacccaacttgcccagtatttgttgaattgctccgttgaaaaatggacactgtatttttggaaaggccagaatagaccctcacagaatataataagagcgtttttactctactgttctactgtgttattctctcctaattatgtatgcaagcattggctgtgctttcctgggccggggcatttgcagcccacttgctcagtcatttgctctgtgctctgcaggacccttcaattctgtcaaacctaaaataaactcggtgtttcatttacttagagaaaaatctcctggggaggttgtagtttccttaggtggatgagggaacaaaatacagaagttggaaccagaagacctaagcctcgaccccagttcagccacccagtagctgtgcgatcttaggaaagtggtatgtttttatgagatcaatttctggatttttaagtggaggaaaccaatagtatcttcctccacacatgaacagaacccaaaataagatattgaatgtgaaagcattttaaaacaatcatatatattatatattaataatgcatataacatataataatacaaaaagcatgtgtgtttatatatctctcactggttcatttagtattgacttggcccaatactcaattgggtgagggcagcgtcagtgccctgggggtagaaccgttggccagtgtctagcctttgcttagcagtgtctcatgtgtgtttagcagtgtctcacgtgtgcttagcggtatcttatgtgtacttagtggcatctagcatgtgcttagcggcatctcacatgtgcctagcggtatcttatgtgtgcttagtggcatctagcatgtgcttagcggcatctcgcatgtgcctagcggcatctcgcatatgtctaatggcatctcatgtgtgactagcagcatctcacgtgtgcttagcggcatcttgcgtgtgcttagcggtgtctctcgtgtgcttagcagtatcttacatgtgcctagtggtgtctcatgtgtgcttaacgttcatttgttttccctcggctcccctctcagggcagggtcatcactcatgcccacccctgtgcttccctctccctggctcgagggacccttttgaacccttttctcctctctccatggttggagaatctgcaaatccgcaaggcttgtgtgatcacattgcccaggctgatgaagatgtgaagaataagtcagatgtcttgccccagccggggatcccctgctgacaaagctgtgttcttccttctcaccttgtcatcaaaggaactgtctctcactccactttctcggggccttttgctacatgcaggggcaaaggcagcaagacagttccgaaagtgtgaacgagatgctgctgtcagcggctcacacctgcttgctgcttctgttcattgccttgttccttctgtccccttggtttgcttccctcatcagcacctctgaaataaaccaggattcagttttggaatttcggcaagtgttacagaaagatgagttttctgcatcttctctctggaatgcttttttctgtgggtatctaggtgtggacacggtgcacgggtggagagcaggcctgtggggtgtcccccgccccagttaccctctgcattttccggagacacactgactccttgtgtgaaattcagcaccttaccagaatgagcccagctcagcctgcgttgcctctgacctgtaatgcgctgtgcaacagggctcaggaaacgaaacccagtcttgctttgtactatttccatgttcagttcctggcctgctacagagtcctgagggagcaactgggttttgagaatggctcagagatgtcccggggaggtttcagaccgttttaatcatgtgctaatctaattgaaggttcataatattttttatcacaatttcaagaactgtgggtctggaaaaacctccacctccactccttatgaaaatctcctataaattcaaacagaaatccccacacctcatagtatatttaaaaaagatgtatgtcagaagagaggcatatggagcatctctgactgcaaatattctagcataagttatttgcaaaaggcttatcaacatcactccagaattcaaacatgcagacatagaatacagtgcctgtgaatatggtactgagcttttgagggaggagcaggcaaggtgttttagaagtagatgtgtcatttaagtgctctgagggcacatggtataaagaaagaacccagaggggatccttagaggtggggccgcctccatccgcggtgcttctgtatttcagaagacagactgtgaatatgttctctgcacagattcccaacacagtcagagccccatttcgggtgcaatgcctggtttcttctggtaaatccttccccctcttccaacagaatctctggaagactttcgggtgagattcctttcctatgaacaggcttatatctgtattggaagcaaaactaactggctgatctttattggtgccttatcctctggttccaaggaagcatctttggggtttgtttgacttccccaaatagaaacaaaacaagttcaacacccacgtggcagagtcctccagtgccccgaggtgggctgcagcgaggctgatgggggtccttcagcactcaccgaatttattattcctccaggtgacgcccaggttccagggcctcccaccggtgtgcacgcttccgagatcagcagaaactatgtcgtcctcagctgggagccacccactccccgtggcaaggacccgctcatgtacttcattgagaaggtaaactccgggcccgtgtcctggaaaagtagatctctgcatggccccccactgtcatgatctctgtgtggcccaccgctgtcgtgatctccgcgtggcccctcactgtcgtgatctctgcgtggccccccactgttgtgatctctgcgtggccccctactgtcatgatctccacgtggccacacactgtcatgatctctggccccccactgttgtgatctctgcgtggccccccacagtcgtgatctctgcgtggcctcccactgttgtgatctttgcgtggccccactgtcatgatctctggcaccccactgtcgtgatctccgcgtggccccccacagtcgtgatctctgcgtggcctcccactgttgtgatctctgcgtggccccactgtcgtgatctctgcgtggcctcccactgttgtgatctttgcgtggccccactgtcatgatctctggcaccccactgtcgtgatctctgcgtggccccccacagtcgtgatctctgcgtggcctcccactgttgtgatctctgcgtggccccactgtcgtgatctctgcgtggcctcccactgttgtgatctttgcgtggccccactgtcatgatctctggcaccccactgtcgtgatctctgcgtggccccccactgtcgtgatctctgcgtggcctcccactgttgtgatctctgcgtggccccctactgtcgtgatctccacgtggccacacactgtcatgatctctgtgtggccccccactgtcgtgatctctgcgtggccccacactgtcgtgtttgctgtgttttaaagatgacctactagttcatcagtgggtccagaccctgcaccgttgctggggaaaatgaggttagggctgtggtcacacggcagcaggggcggaaattggcaccagggggctgggttgcgtcctagctgggcgttgcccctcggtgtgagcagggagtcgcttccctctctgggcgcccgcgttcttcactgccgtgtggaggactgagcttgagggttctagcgtctccttcctgctgcaacattccaggcgcctacatgctggggattccagattcctcgatggccatgcttgtgcacaagccgtatggccactgggtggcaatcgtgtagaggaaatgcacacaagacgcagaagggttagactcgccagatatccaatagaaagctttttttttttcctgaatgcatacaaagaaatacaaaagacattgtatattgcagttctgcaatcacgtatatgtatgtaacctacagaatttcacaaatgataatctcacccagcacacattctctttttaccctgtccggtgacattaaaggcacaggttgtgacccactaatctgacttggtgacgaccccctgttgggttgtaggccatagttggataagactccaatgtcctacaaaggctgtaactagggttttgcgatacaaaatttatatgtaatatgtaatacaatatgtagtatgcaagtaacagagaatataacatatagaagcttatgccacctaatacaataatcgcatctagcaccactcaatgcagcatggcggaaacaggaatggaaacgaaccatatttcagactccagcatggaggaggaccctctggccttctctggttatttgcaatgtatgctatctggggggtagaaactagaaatatttcagggtaaagcattacatcattaattctgggtgacaaaatatagttatttgtgttacgaaaatacaagtggtcagtccctctgtggggtctcctagggtggaaggtattttctcaggcccctcattcccctcatcttccaccaataccagaaacaccaagtttgcaaacacttttttgtttttatttttgagaccaggtctcattttgtcactcaggctagagtgcagtggcacagtcatggctcactgcagtctccacctcctgggctccagcagtccttctgccccaggcccctaacacccagagtagctgggaccacaggtgtgtgccaccacgcccagctgatttttaaattttttttatagagacgaggtctcgccatgttgcccaggctggtctcaaattcctggcacaagcaatcttcctgcctcagcctcccaaagtgctgggattacagacactttagtgtgtttacaggccaggcaagccacaacacctgtcctgcaaacacatttttagagagaggactccaccgtggagccagtgtgtgggcagaactacctgctgtcagtattgatgacatggcaggcacacttttttttttgtaatttttattattttatttttccattagttattgggtacagggggtatttggttacatgagtaagctcttcagcggtgatttgagagattttggtgcatccatcacccaagcagtatacgctgcaccatatttgttgtcttttatccctcgcctccctcccactctttcccccaagtccccagagtctattgtgtcattcttatgcctttgcagcaaacacacatttttaagaaaatataatttcaacttttattttagcttcagggggtacctgtgcaagttctgacaggggtatgttgtgtgatactgatttcgaggtgcagttgatctcgtcacccaggtagtgagcacagcaccccataggtggtttttcagcccttgctctgtctggtaggcctcagtgtctatcgttgccatcttcgtgtgcgtgtgtacccagtgtttagctcccacttataagtgagaacatgcagtatttggttttctgttcctgtgtcaattcacttaggataacagcctccagctgcacccatgtggctgcacaggacatgatttctttcctctttatggctgtgtagtattccatggtgtgggggcaccacattttctctctgcggtccaccattgcagggttgagtccatgtctttactcttgagaacagtgctgtgatggtaatacaagtgcatgcatcttctggtagaatggtttattttcctttgggcatatacccagtaatgggattgctggatggaatggtagttctgctttaagttctttgagaagtctctaaactgctttccacagtgactgagctaatgacattcccccagcagtggataagccttccctttgtggacccatattctgatgtaggagaggaagctctcctatagacacctggactgcggtcgcttggggtcgcaaggacctcaggcccatgacgccctgggggctcccaccacaaacgcccggggcagatacaaaatagcggcttttcactttcaccaaaatgagagaaaactccttcaaatatgagtctgatttctagaagtctgggttgctatctgaaattttcagcaggcttaccagggtcagtgtatatccaacttttactaccacaaaactactttcgaaaaaggcgttttatctctatgtgaaaaaataaaataaaacatgtaatcaaggtttttttttttttttttgagacggagtctcgctctgtcgccaaggtttttaaagtaattacaaaagataaaaattaaacaagcagtatataaaatttgggaaagacagagaagttacatggaatgcaattaaaatgagcaataattccaccatataaaatagccacattaacgtgtggtacatatatttatagtctttttctccatagactttaatgctcttgttgtatcatacaatttgcattctgtattagatttcacaaaataacatcattcctcttattagactaaagatctttatacaataatttaaatggccatgaggtttttaatctatgaacatatcatcatgtgtctgaccgtattgacagccatttagattgctgtcatttaatcactactgcaagtagctgcaatatggtaataactttaaattgaaatgcgaaccactgagttatgacagaattttatgaatatacttctaaattatctttcgttatttgcaggttagttctattttgctaaaactactacctatgtattgattcccttatgttttctatggtttaattatttactttaatggaaaaaaatttattagtaaacatgatcaactttgggtatttgtgacttccttctccaaattggcatcatgtttcataaaactcaaaaaagatgcatgaccatcctttgtgtgcgagacgcagcgggcgcgcctggtggtcctgggatagcgacaacagagcatttcttcctcctccacacgcctctggggacctcgcggttttcactgccagtctcgtttctgtttctctttgtagtcggtggtggggagcggcagctggcagagagtcaacgcccagacggctgtgagatccccgagatatgccgtgtttgacctcatggaagggaagtcttatgtgttccgagtgctgtcagcaaaccggcatggcctgagcgaaccttcggagataacgtcccccattcaggcccaggatgtgaccggtgagctgtcacactgggtggccccaagtcaggatgggctaagagtggggtgacaccaaatagccttaaattgtgtgaataaagacattaatgttataaacgagttgaagttcaagtggacttaaaacttcactttacgagagattaagagctctctgccatgttttgtttggttcttgacatttctccaaagctccatcttcttttcatgaaaccagtaagtgagttgaaaaatatgtttaggaaacggtcacttttattgttttatttaaacttttaaaaaaacttttattttaggttcaggggtccatgtgtaggcttctgacataggtaaacttgtgtcatgggggtttgttgtaaagattatttcgtcacccaggtaccaagcctagtagccattagtgactttgcctgctcctctccctcctcccaccctagaccctctgatagtcccccgtgtgtatttccatctatgtgtccatgtgttctcatcatttagctcccacttatgagtgagaacatttggtatttggttttctgttcctgcattagtttgctaaggataatggcctccagcttcactcatattcctgcaaaggacgtggtcttgttcttttttatggctgcatagtattccatggtatatatgtactgcattttctctatccaatgtcattgacaggcatttgggttgattccatgtcttggctattgtgtgaatagtgctgcaatgaacattcgcatccatatgtctttatggtagaatgatttatattcctctgggtatatatgcagtactgggattgctaggttgaatgatagttcttttttttttttttttttttttttggctctttgaggaatcatgacactactttccacaatagttgaactaatttacattcccaccaacagtgtttaagtgttcccttttctctgcaatggtcacttttaaagtaattcaaattttaagtgcactagacttttttgttgttgtctttttttaattaatgctttttaaaaaaaatttttgttttgtagagatagagtttcaccatattgcccaggccagtctcgaactcctgaactcaagggatcctcccaccttggcctctcaaaatgttgggattccaggtgtgagccagggtgcccagccaggcactagagtttcttgcccatctggcttgaaggtccctcttggaaggtttcaaatacaaattacagaaattttgaattgcaatccctggagtcataactccttcatggatggcagttaactagcatgtaagcggaggcaccctggaaatccccagaagccttcacgggaggcacattggtgtcaggaacgcggttctgagtgcctgggtgccctccaccctctctctgtcgtgtttcctgagaaagccagatacggaaatgaacgaggtcacgaggccggctgcctccagggcatcctcaagtttctatctggctctggttttaactgaagctcttagaactcatacccagaaccacaggcttgacaagaccagctgtctttgagcaaggccctgccttcttgtgctttatgacacatatgagaaatgacagtgtccatcactgagacacactgtggggtgtgtggcccaggtggccggcacagaggacacaggtggccccaaggccttacctgacctcagtccgcagtccactagtggggcctggcaccacatgacaggatctgatggttaggtcatgatggaattttgagtgcccctgggagatttcaacagatctgataaaattgagtcttactttcttaaaattggttaatttccagtccaaaaaatagttgttacccgggtagcctcatccctgctgccaacagagagtcttttaaacagctctgatgggtagacaggaggattcaggatggatgtcatcctgtgtctctaggagttgtgtggagcttgggaagagatcagagagaccagcacctcccaatggccctcgggtggtcggcccggggctcctctcctactcctggaccccttgtctgaatttcttccaaagcccccagtctggctgtccagttccctgtgaaaagggccggaagatctctgctgtagcttccaaagctctgatgccatttcaccactccttttgtctcctacgaaaagttgtcccttctgctccgggtcgggttcttgcttcccgaaacaccaagacgtcggtggtggtgcagtgggaccgacctaagcatgaggaggacctgctgggctactacgtggactgctgtgtggccggaaccaacctctgggagccctgcaaccacaagcccattggatacaacaggtgcggcctccctccccagccctggagtcagccttgcaggagtagcaagaccgttgaggtccctgtggccctggcacagggagtaccatggccgcaaggcttctgcgtaaatgagtctgtcttagccacacacaagggctgtataattttaaagtttgaccacttggatgagctagttactgcacttgctcatgtcgaccgaaacgatttatttatggatgaaaggagagttccagaacctgttttttttcccctgacataattagcacttaggccttttctttgaatagcagagttaaaaatagtgactacgatgtgaaagtcgttttatttttttcgtattgatttttttgaacttgaaagttgctttgttcatgtgcctggtagttctattccccagcacctgatggagaccccaccgggcgccgactcttcgcttgtggtgggggcagcctcgggggatgctggttgctttgcaggagaaagccagtgaccctgcctttggagagacttgctcctgctgcctgctgagtgtgcagggatgtctgaggttattaggcttctctgcgatacgcgtcttaggaaaatgtcagcagctgtcagaaccacccttgtggatagatgatcaattatggctcagccatttctccttttaaaatctgaaaaaaatacactgtaaaaagtggtggctaacaagaagagatgtcattgaaaagaataacaattagatgttcttcacagcccacagcaaatgcagaaagatcgatcagaataagaaacttaaaacatgattccagtacagggaaatggttagtgaatatttattgactatatatgataaataataattgcttacacggactgaatatctatcatacacaaagcatctgtgctaagttgtccacctagagttttccatgtagtgcctgcaatagtgctgtggggtgggaattatcatccccatcttacaaatagaaaaacaaagtcttacaggggttaaggaggttgattaagaccataaaatctgtgaggtttcaaagtcccagtattcgagcctagtccatctgacttccaagtcttggcctgtaaccactgcagtgtaattactgctaattaagttttacatacacgggttcttttagataagaaatggcatactgttggataatagacctctgatccagaggaggcccagaaagtacaaaagcaaaggtgaactcacagaacaagtggctttggcaccacgtgtagtcagctcctgctataattaggtgctgtgaccttactgtcggactctacatgttgagctaattaactagaattgaaaatgaaggatgtatgttatccataaaaattttttatggcgcgttcagggtgatttttgcttctgctgcaggagagaaaaagtggagcctggcagttctgaccctgatccctgtgtttctcaggttcgtggtgcacggcttaaccacgggagagcagtacatcttccgagtcaaggcggtcaatgctgtggggatgagtgaaaattcccaggaatcagacgtcataaaagtgcaggccgcactcagtaagtcactcacaggctgttgtgtgccgattgctcccatacactgtcatttctgcatgaataaacatttgtgatgccatttggaatgtcattgaaggggaaaaggggactaaattcctgaacagagaacttgagtttctttgaagcctcttggttggctgcttgtcttggaaatgacagtgtgagagggagaaatgataatacactaataaaacgcaaattaaaaatagaaaacattgttagaggttacatgtgttgccaaatacctgtactcatgttaaaatatatgctgtaggctggcgcaatggctcatgcctgtaatcgcagcacttttggaggccaaggtggctggatcatgaggtcaagagattgagaccatcctggccaacaaggtgaaaccccgtctctactgaaaatacaaaaatcagcctggcatggtggcgggcgcctgtagtcccagctactcgataggctgaggcaggagagtcacctaatctgggaggcggagtttgcagtgagccaagatcgtgccactgtactccagcctggggggacagagcaagactccgtctcaaaaatatatatatgctgtaggggatacatttctcttttcaaaatatgtgctaaaatacagcaacatccatgacctttttagctgttctcagttctaggaactttagtcacttcagagaatgtcatatttatgtaactttgagactttgttggtaaatagtggtgtttaacagtttttattattttgatcaaacgagacaattgggatcctaaatctcagggaccgtccctagaacagttgctgtatcaagctgtgctgcagcctcgtggctttctgttttctcatgaaatgcacctcaggaagtcagtgcgcatactcagaaacattttgaaacacaaatgccacatgggacacccttggattcacagggttatcttcccacttcagagggaactatgtggctcgttgatgatttttcatctttgactaaatttgcaacattttcagaaattaaaatttatcttctaatgatattgctgttggatttccaaggaatgtcaaatctgataacatctagctaggtacaatagcgctgactcttttgttttaagattaatctcctctcaattttttccaggagggactttcaaacattcccattttctttttaatgtcattcctactaaaggaaaaccactttctttttttttttttttcgacgtagagtctcgctctgttgctcaggctggggtgccgtcgtgtgatcacagctccctgcagccttgagcttttgggctcaagtgatcctcatgcctcagcctcctgattagctaggaccacaggcaccaccaccacgcccagctaattttttgatttttttgtagagatggggttttactatgttgcccaggctgatctcaaactcaggagcttaagcaatcctcctgcctcggtctcccaaagtgctgggactacaggcatgagccaccgcacctggcctgtttttattctatgataagaatcacttaattccagtcacctgtgtctcaggtaacagaggatggccacattgaggtgactcagagctggggcaagcagactcaggcccatccgttctcgacctgttaggagaaggcggtccgtttcaagtgccctgctcaaacagggaaacacggattcacactcatttgaaggaacctgaagttcctctaactgtgcaggaaattaaaacaaactggaatcgtatctgtcatctctggccacagatgcagaatagttattccttatggttgtaaaagtgaaagctccttcgccaagcttctttcaaggggccgagaagacagaacatcttctgctgtgtcaaatgttcataccagatttaaaccgttcatcctatggaagccttagtagatacacttagaaatagcaatacatatatatgagataaatttttatttatttttgtactcatcccctttaaaaaggtgtaaagaccaaggtggttaagtgtgggttgagagggatcagagggcacagtgttcaggcccgtctccacgttgcttcctcctccctctgccacactggagctggctgccccggggacaaagcccccaactgaggccctcggtaactccctggttgtgcttccttgcagccgtcccgtcccatccttatgggattacgctcctcaactgtgacggccactccatgaccctcggctggaaggtcccgaaattcagtggtggctcgcccatcctgggctactacctggacaagcgtgaagttcaccataaaaactggcacgaggtcaattcctcacccagcaaaccgacaatcctaacggtcagttggtttttattccttcgtctatttttgcctgggtggttctttacatttttggcaatgtttctgcgtttgatgacattagataatttgatacagacggaaaaatggattaaaaaatagcatcatgagatcatgaagttttggagctcaaaagatcctaggaatcatattctttttctttctgagaagcagtgaagaagggagctcagtgatggagtgggcctgacagtgagtccatgacctctggtgtgaccagcatctggtcccagtacctgtggtaatgtcccttgttctaggctctgaggccttgagggcagggacggagtctcacgtgtgtgcctgaggggagggtcacgctgagtgtctgtttaggaagagagtaatgttggctctctgcttgtcacccaccatttccctgagacattcttgtatttcaggcctcccagagagtcccttgcctcagtgcccctggtgctcaggtgcagagtgtggcaaggacatcgacttggagctcagagatctggggtcagatccagacacccccttggcagccattgctctgtttccctgtccggcccttgacccctcatctgagcatagatgaatgaccctcatctcacactacagctaccgtccggaccgtggggagccacagacctcaggggagtcacttacactccaacaggagggctttcttttttggagagtgtaaggccttagaagatctaatctttgtctactagaaaattctgccttataaatctatctctttataatatatgttaatattttatacacatatgatgatatataggcaactttctagtttgctgtgacattattgatattttgcccacgttcaacctctgttctgatcccttacaatgtctaaatgttctcaacttaaaaattattttatttttaattgacaaataataattgtacgtatggggtacaatgtgatattttaatatatgtttgcattatggaatgattaaatcaagccaattaacatctccattgcctcccagtacttacaattttttgcagtgagaacatttaaaatctatttatttatatatttatttagttttcgagacagagtctcactctgtgacccaggctggagtgcagtggcacgatctcggctcactgcaagctccgcctcctgggttcaagcaattctcctgccttagcctcctgagtagctgggattacaggcgcccaccaccacgcccggctaatttttgtattatttcagtagagacagggtttcaccatgttgcccaggttggtctggaactcctgacctcaggtgatctgcccgcctcagcctcccaaagtgtggggattacaggcgtgagtcactgtgcccagcctaaaatctatttaaaaaatgtttttcaaatatgtctacaacacattattatgggctaaatcatcaccatgctgtgcaggaagcacgagaactcgcccctcctgttgctgctggaactttgtccctctgtccagcgcctccccgacccggcacccgccgggtctttgtgagtgctactgtttcagattccacatctgagcgagatcacacagtgtctgtccttttgtccctgggtcatctcactcagcacaacagttctttactcggtccgagattcctgagaaaagtacctgcttactttctgagtgcttcacagctagtccagtgaggaggataaactgaagccgtttatcctcagatatcttacttcggaagctattttttgagacagtgtttacccagatagcgtttttgtgccacaagcccgggggagtcgaggctcgtagtgttggtcaaaggcctccctggtgctttgtcccccagccaggcagcgtccctgagggcccggtgggtggccgcagactgcagcaccccagggacctgggcagcccgggggctcttgtcatgcagagtccaagtatgggggacgtggtgggctccgtctccagggtgaccccccttgggtgcagggcagggcccgctcaggggacagtgtgtggcctgagtgcctgtttcctcgaagcctccgcccttgagttggccctgggcaaccgtcgcctctctgggcctcagtttccttacctgccgctggggtatcacctgtcccctacccccgcaggagtgggattgagtgaaggactcaatcactttgggaaatcactttggggattgagtgaaggacacgtaaggtttcatgcggctgcagctcgttggccacatcgaggtccttcctgaaatatttggtccaatttcccgacaaggttccttcctctcatattttatttcacaagccagttataacaactcctccccctcagtgggctgtaaggcatcctttatctcatgtattaatttaaacaaaatctgaataggtggacggcttgacggaaggctcactctacgagttcaaaatcgccgccgtcaacctggccggcatcggggagccctcagatcccagtgagcacttcaagtgtgaggcctggaccatgccggagcccggtgagtcgctgcccccaggacacccgcgttccagcgcacaggctggctgggaaggggcctctgtgggtgcgactctggactcgccagccttcacagcgtgtctgttcctccgacacccgcagctgcagagccaccgtgtgccaggcgccgtgcagggctgtgaatcaggcagacccagcatctagtttgggctgtgcgtggtccagaggccagtgatgagggcagagtaggaggccctgagggtgaggtgggagggagcacaggaggacccagactgtggggagagggacagcttcccatgcatcccctgacctatgacacggatttggcccaggtcacctaccccaaaggagcaggcagagagggtcacaggtggaggagaaggtgcgagccccggacccagctgggaggcgcgacagggttctcattcgtgggttagctcctgcagtcctctcaggccatctggggatctcaggggaggcacgacagggttctcattcgtgggttagctcctgctgtcctctcaggccatctggggatcttggggcttctgcttctaaaaggcatcattgttgcagacctgcatttatttagctcgcactctactggttttttgttttgagatgaggtctctctatgttgcccaggctggtcttgaactcctgggctcaagccatcttcctgcctcagccttatgagtagctggggccacaggttcatgtcaccatgccctgctaacattttctctctgttttcaaaagttctcaagtaccagaccttgatttctttgtctctaacctatcaggaattaagtgcaatggataatatgctcatactttgagaaagtaaatcctgaaagttgaagctgaaaaagttcaaagttcagagtgttttccaatgttatggccagagtatactgcctttttccttttagtcagcgtcttttgacttagcaaatcagctgctaagaagccagatgaataagccaattagaaaattccttccttccttctttccttccttccttccttctttctttccttccttccttctttccttccttccttccttctttccttccttccttctttccttccttcctttccttccttccttccttctttccttccttccttccttccttccttccttccttccttccttccctccctgcctcccgccttctttcctgccttcctacctttcttcttttaatgaaattaaattttggaccttagaaaaccaacagaagaaaaaagtcattctagtttcccgagcctcttttgagggttgataggagatggcctctcaaggctcaaggccacagtgagactagctgaagatggggcggggctgcctctctgtttccctgcaccgcttggtgcttgcctggacctgggcctccgcaccacatgccctcagagttgccgcgggtgttcgtagaggacagggctgcagtgatgtgcttccggccaggtaggcaggctccctgagtgactgtgactgccaggtgtccagccccgtggagggtaacttgagaacctgtcctttcctgcacaccgttcctctctgtgatcgcatctgctggtcccgagaatgcagtgtggacttctgaatgattctacgtagatccacgtaggctgggccctcctccctgacccccaacgtcatgctgagcaccctccttaccctgctctgcaagagaggctgataaacatcagatggggaacagatacggatggtcctggtggggggcttcccagaggagcagtgggtccccggggctgggttgggcggtgggtgtgctggactggctatgcgcgcagcaacaaggtggcatctgacttcacaggtcctgcctacgacttgacgttctgtgaggtcagggacacgtccttggtcatgctgtggaaggcccctgtgtactccggcagcagccctgtttctggatatttcgtggacttcagggaggaggatgctggagagtggatcactgtaaatcagacgacaacagccaaccgttatttaaaggtaagtcttggccggctgtggtggctcatgcctgtaatcccagcactttgggaggtaaaggcgggccaatcacttgaggtcaggagttcgaaaccagcctggccaacatggagaagccccgtctctactaaaaatacaaaaaaattagccgggcatggcaccgtggcaggcacctgtaatcccagctactcgggaagctgagtcaggagaatcgcttgaacccgggaggcggaggttgcggtgagctgagactgagtcaccgcactccagcctggttgacagagcgagactctgtctcaaaaacaaaacacacacacaaaaataaaacaaactaacaacaaaaaataaaggtaagtctttcgtcttggcgtttccctctgtgtgaaagtgctgttgctctctgcgcaagccagcaccgagccccgaggtgaacctgttcagatgaccggggcgtggctgctgaggatgcagccaccatgcgtgttgtggggcccagcagatgacagaacagtgccttgaggacgcagagccctccttccattcacaccaacatgctgtttgctcctggggaactgcgcagacacgcctgttttcttccacattgcagtctaatagctgttaattgtctgttcatgggctatgtctgtgtgctttccaaagggatggtgcctattgtattatgtccttccacttcacgccgggcatttaatttacttaattcatgtgatcgctaaagtccatttgataagcaccacacacagatatacacacagttttcatacatggagcaaaactatcatgtgtgacttcctccagcctctctttctccaaatgtttctgtttttagcacttgcggttcctcagtgactgggtcaggtgtaaggactgagccccaggaggcctacatgctccagctgagttgccaactgccttaacccagaggttttcttctctgggtgctgggccctgtggtggggtgggcctgcttccttccctaaagcacagccacgtctgggtccggcacctgagcacaggctgagagggccttccacgggtgacaccttccggaaaccctttgatgacaggaaacagccagtgtctttagaatgaatgagtcagcttctaagaatcagctacataaatcaactagaagcttagtaaatatatatagatgtttatccaagcaggttttaataagaataacccatgtatgtacaagtagagatggatttaattctgatgccccaatgatgactttacacagttaaatatcacacttaaaatagtatttggttccacagaattatgttaaatataaacaccagattataaactagtcagtatgattttacttctgctttaaaatatgcagagataaaaaaatgaaagaggttccatcagattgggagcgaatgcgtttattcctccaaagtcacattctgcaccactgtgaatctcctcttccctccttttctaactcattaagtatcattttcctaactggaaaaataagctatttttgaaaaggccctattcacaataaaatgtgaaaaactccacagtcatctttattttacctccacacatctggtgtttcctctgttgtttcaaggtctctgacctgcagcaaggtaagacctatgtcttcagggtccgggcagtcaatgcaaatggcgtggggaagccctcagacacgtcggagcctgtgctggtagaggcgagaccaggtaaggcttacaacaaaaactacaaaacagcaatgatttgtggggagagtgtgcatgtattatggatgtatggatgagggtgtgtggataaatgagtgggagagtgaacacgtgttatgtgtgtatgtgtggatgggtctgtagataaatgaatgggagagtgtgcatgtgttacgtgtacatgtatgtatgggtatgtggataaatgtatgggagagtgtgcatggattatgtgtttatgcatgggtgtctgaataaatgagtgggagagtgtgcatgtattatgtgtggatgtgtggatgggtgtatggataaatgcatgtattatgtgttcatgtatgggtgggtgggtgtgtgtgtaaatgaatgggagattgcgcatgtattgtgtgtatggatggacgggtgtgtggataaatgagtgggagagtgtgcatgttttatgtgtatatgtgtatatggataaatgagtgagagagtgtgcatgtattatgtgtatatgtgtatgtatgtatgggtaaatggataaatgagtgggagagtgtacatatattatgtgcatatgtgtatgtatggatgggtgcatggataaatgagtgggagagcgtgcatgtgttatgtgtttatgtgtatgtatgtataggtatatggataaatgagtgggagagtgtgcatgtgttatgtgtatatgtgtatgtatggatgggtatatgaataaatgagtgggagagtgtgcatgtattctgtgtatatgtgtatgcatggatgggtgtatggataaatgagtgggagagtgtgcatgtattatgtgtatatgtgtatgtatgtagaggtgtatggataaatgagtgggagagcgtgcatgtattatgtgtatatgtgtatgtatgtagaggtatatggataaatgagtgggagagtgtgcatgtattagtgtatatgtgtatgtatggatgggtgtatggataaatgagtgggagagcatgcatgtgttatgtgtttatgtgtatgtatgtataggtatatggataaatgagtgggagagtgtgcatatattatgtgtatatgtgtatgtatgtacaggtatatggataaatgagtgggagatagtgcatgtgttatgtgtgcatgtatggatgggtgtacggataaatgaacggatgtcttgccgttattttaaaaagatttggatggcaaatgaagtatgcaattaaatctctgcctgtgcactaatggccctggatgagaaggagagcactttgggtcatcttcatgcttggcaggggttgttcttcgaatcgtcaagccacgtgcaggaaggagggcattttttaaatattactgctggatttttatcagaaaattttaaaaagctgttggtaattttcttgatttcaacgaataaaagttccctggagtcaacctaaaaagggcaaatacttctgaaggcaggacacacactcataggatacacagtctattttgtgttgctgtaacagaacaccgaggctgggtaattgtttttaaaagtttattggggcgtgggtgtggtggctcacgcctgtaatcccagcaatttgggaagccgaggcgggcggatcacgaggtcaggagatcgagaccatcctggctaacacagtgaaaccccgtctctactaaaaaatacaaaaagaattagctgggcatggtgttgggcgcctgtagtcccagctactcaggaggcggaggcaggagaatggggtgaacctgggaggcggaggttgcagtgagccgagatcgcgccactgcactctagcctgggcaacggagcaagactccatttaaaaaaaaaaaaagaaaaaaaaagtttatttggctcatgattctggaggcgggaagtctaagaagcacagtgccgggatctgctgtggtggctccggcagctctggtggctccggtgagggcctcccgctgccccacaacatggtagagaactgggtgtgtgcggaaacggacccagcatgggaggcagccttgctttataacatttactctcactggaactactccattccagtttaaccaaccagcagccgtggttattagcaagaatctacccagtctttccagaaagacacgagtctatcttaacgacctaatcacctcttttaaaaagaatttttattattctgttttttatagagacaggatctcactatgttgcccaggctggtcttgaactcctgagctcaagcgatcctctggcctcggcctcccaaagtgctgggattacaggcatgagtgctgcccccagtcattaatcacttcttaaaggctccacctcccaacaccgttgcactggcttttacatttcaatgtgagttttgaggggatcatccacatccaaaccacagccccagagtgtgacctgagtgtcaggaagcagtgcagcctcagactgtaaagatcctgatggctgtctgtggtggcctcttcatctcaccctgccacctggctttccttgcatctgtgtcttcttcataacccgagagcactgacacttcatggcctcagttccactcaccagcagaggctgagatgtgtctcgtccaattcctaattcctacgacatagattctgccttgcacacggccagatgttcacctgggtcaaaaagtagcaaataaaccacaaacaacccctactcccaaacaagacaaggcaaggccccatggagaaggcagagctgtgtgaagggggagcttcatggtgggcacatggctgctgggcttcccctgagggtcagagaaggagattccagagagaacaggatcttcagggcctggagaggcagccctaagaggttttctgcagttgtatgagatgcagggaaggacgtgtgcagaaatatggtaaattaaaaaaaattagcaacaacaaaacaaccaagcccctccaggtcctccctaaagtgttttctctctcacgattctctcatcagtcctgggtcattaaatgcaactgatgatttggtgtaagatgaggtctctgcattgggtaccccctcggcattagtccgttctcacgctggtatgaagaaatatctgagactgggtgacttataaagaaaagaggtttaattgactgacagtccttcgtggctggggaggcctcaggaaacttacagtcatggcagaaggcacttcttcacagggcggcaggacagagtgagtgccagcagggggaatgccaggtgcttctaaaaccatcagatctcataagactcagtcactatcatgaggacagcatgggggaaaccacccccgtgatccaatcacctcactccctctacacttggggattacaatttgagatgagatttgggtgtggatgcggagccaaaccatatcaccctctcccaaaagagagttgaaagaacaccgtgtccctaagccgctcacctcatactcttcttatgcaggcaccaaggaaatcagtgctggtgtcgatgaacaaggcaacatctatctgggcttcgactgccaggaaatgacagacgcgtctcagttcacctggtgtaaatcctacgaggagatttcagatgatgagaggtttaaaatcgaaaccgtgggggatcagtaagtcaggcctggaagttggatactggaaacttttagaagttcctgcaaacagaaatgatcgacattcacctactcttcttcctttttagctccaagctgtacttaaagaatccggataaggaggatttagggacttactccgtgtctgtaagtgatacagacggagtgtcctccagttttgttctggacccagaaggtaatatttatatggcagaaccttgcctgttttggttttatcacactttcaaagattgacaccaacatagaaaagacttacttgcttagaaaaaaagacgtatgtttgcaggaggctggcggtgggggctatgtatataagccaaaacttgctttagaaattaaacaaactctaaagtttatactgtttccaccaagtagtctctggtcctgatatattgcttgtatagccttcaatttgtacttttaaagttgagtcttagccacattttaatagtttggtatgcagagggtaacatattaactaagaaatccatgaaattaatgagagacctacgggtggaagagtcttcccttccttccaacactgagaaatcagatgatcagagaaaaatttttttatgcatgtaaaataattttaactgacaaagtgaaaatctgctgctgtgttacccatggaagacggcagagagaagtgagaaaagtctgtttagtgatcaaggggaaaaacaatagttttcttagataggttcacaggtctgagttcaccaggcacacagtctcatgcaggcagggctgatttttttaaactgcctagcatcacgtgtatttgtgtggcccgtcatctaccccacccacaggacagcgtcagccttagacatttttaaacgaaggggcagtggtgcagcgtgaactcgtagggctggatggtatcctcagatttctgggtttctttgggtgtctaaggcatttgaatttccaaaagttttctattaaagtgctctccagggatggcataaatgatctccaggggagtcctaaggtttacaagcagatcctttagttatcaatcactgtcctggttgatatcatgcagaggctgtgatctgagaacatccgacccaggatcggtgctgtgggctgggcaggaggatgggcaggtacccacggagggggcagccagaatcacactctcggcttctcgagtgtgcaggtctggctcaatgttggtgaaattcaggaaaactcatgcacatttaacaagacacagccagacaaatgaggaggccgcactgtctcgcctttctggggtcctcagttcaccactcacaggcagggtggggaaggacccaaaatccatttgcatgcttttaaagcagcctctgttggccctgcctccagggtcttgacacagttttgtaccttcacgacatcctgaaggacttctgaaaagctgtgcattcctctgcaccatttcaaagtttccatcttaattttaacttttttaaatacttgcaaaagaaaaaattccaccttctcttatattgtgtatagacttcaaatatatttgaggtaaaactttgcagttgaagatttagttcattccatgtatggaaattcctaccagaaggttgaactgggaaagccagtcctccctgtgaaaccagttgccaatatgaatttacttttgggcagaaaaatctaacttcatttttccattttgaatagacatgttcttgaaggccttggagatcaccatcttctttctgattctaattttaagaaggaaggagagaaaatgaagtggcttagagcccagattttcttaccttgctcttgagactttctcaggaatgcaaaatgcagtgtattttgtttatttatttattttttttgttattttcttctttccttttttttttttaaattcatggtaatacactatagtgatgaaatgagcggtgtgtatatctttctttaatgagattgaagaaggacatcttgagaggggaaggaaagtcacaggccagaagcacgttctcagccagtgcaatcaattttaggaaagagctcacattaagtgcaaggatctggaaaagactccctttaacctttcgtcttccaagtcttcctatattccagggatatacctacccctgcccccaattcctttgtccccatgactgtgccctgccttgtcctcagctgcccctgtactaggtgggttctttaaatggtgaaggttaaagctatcctctatgtccctcagacttgtagtttaaattcctttcgtgtcctccaattaaatcctgggggtttccaatcttgctcgtgtgtcgccttgctgttgtctacaaacttctctaggtgcaggtccagatgaattgaaatactttttcttcgttttagagctcgagcgtttgatggcattgagcaatgaaataaagaaccccagtaagtaagcctccagcccttcccctctgcttgcagctgctggctggagggccgtgttcattaatgcatgagctcttggaagaacagctttggggaaaggatggcctgatttcctgatcccagcttacaggattgaaacctattgatttaaaacaaatattagcttatattatagcttgttgaaacttgcattgcgtacacagtgattagaattttgggtttagtatagctgttgctaatccgagtgagatccaagatttcatttcctatcaagtgaaatcttctgttattgaattgcattaaatatagaaagaatccaggcatctttacttatcgaacacatttgcaaagctaactgagaactcatgtggcatgaggctttagaggcaacaacaggccagctcaagttttattttatatttttagcttccataatctaatactccagggtttcacattctcaaaaatctaataactaggattgatatttccctacaatttgcaggtattcttcctcacaaggattcatgcattattgacttgcgatttcttttcttcctgtagcaattcctctgaaatcggaattagcttatgagatttttgataaggggcgggttcgcttctggctccaggctgagcacttatcaccagatgccagctaccgatttattattaacgacagagaagtctctgacagcgaggtgagttcctgtgtgagtgatctctggctttgcagggagtccacttttgttgtggtaggtcagttactgaatatcaacattctctgtctgtttccatccttttctgagccttaaagattggggcatggaaggttgacaagatgaatggagatggttgattcttacaatgttcaaaggtttggtctgggttacaggagacatcaggagtctttaaaatctgagcctgttggaattaaaaatgactttgagcttgttttttgtgaaaaggtttaggtcaggtgggggaaaatatccttgatgaatcagttcacttattcttgataatggttttgaaggtatctattttttgctgtattgtgagagaggcctccctgcattctccccccactgacagcttcccatggaaggcatccgtggggaataagtttctgtggcttctctgcctgtttgggcagcaatcttggtgtggcagactgacgtgacagtgtggctgtcaagagtgatgttctggccaggcatggcggctctcacctgtaatctcgtcactttgggaggccgagatgggggcattgcttgatcccaggagttcaagaccagcctgggcaacataaggagatcccatctctacaaaaacttaagaaattagttgggcatggtgatgctcacctgtagttccagctacttaggaggctgatgtgggaggatcactggagcctgagaggtccgagctgcagtgagttatgattgaactactgcactctagcctgggagacagcaaggctctgtctcaaaacaacaacaacaaaaaaggcacatgctctgtcacggtccagacaccgcctcggttctgctttcgattgtataaaatgaaccttaacaattatgtcaggtactccttatttgtctggagaatatttgagaagccaatggttgtgtttcaataaatttcctcttttctaattatagcgtgcctgggacccggttaaaggacagccctatttcatggggactttattgttcagtggtggcttggggctctctcagagcccccatctttactgcttctgcctttttcccttaatgcccagtgtagagtgtggttggcaaccttagctgtgtactaagtcctcagtgttgattggtttgttcattacacaagttttaggggaactgtgggatgcaggagcctctcatgctcccgggcagcccccctaccatatttctaagctggacccctcattgcagtccagcctttgtgtctgatgggcatttagcaggactcagttagatgaatgttgatcagacagaagtcttgcaggtaaggatcatagaattttcttctccagtcagtctttcccatgagaatcatgacacactttaagactcactcctacgtgggagagtcggctagaaagtagaaaacatctagcttcttttgggctgcaaaaaagccagtggtataactattgcctatgggagacttactgtctgatccaggtaattggagaaatcttctttgagcagagaccatgctatgaaatgaaagggaatttaggggaatggcactttatttgcgggatatcttttgatgagcacttcctgcctgctgtatagagcttgctttcaggatgggtgccctggcttcatggctaatcttttggaatatggttgtactatttcacttctttaattagcaatgcacaggtgacttttacatttgaagattgatgctattttgtggaagacatataaaagtctgtatttatggcactcataaaatcattcaacttcatcttgctgcataatggcattagcaagaagcctaattattttgtaaaacctgcccagacattgcagcacagcagctaagaaaatggaaaaagctgctatattgctgagaatctactcagtgagaatcatacctttttcttactcagagccagttaaagtaagttcctatcattcattctctactcatagatgtttgaggtgaggataatgtcatacaaataaggacagtgcatttatctgatcaacctgaagtttactcttgatattcggaagtaaacactccacactgtaaagaaatccaaggtccacgggacggtgtatccactggaatctcaggtccctctcctgctcatggtacctccaagagcgacgtcagtctccagggacggggacaaagttgttgtgcttcctgcagttgagccatttcttaaaataatctccctccctcaaaaacagtctgaggtcatgccttctcattcatttctgtcactttctatcattgtagatgtaccaatttcctgtgccagttttctgtttagaaaaagtctcagtgatcttacacaagtatacgctgtgtgatctacatctctgatataatattgtaatttctaattgcgaaggtgatttttgtgtttatgggaaatcaaaacctggggtaggagtggagcagactttattcacacgtaaaccctgaatgtcagattcgatgaaacaaaaattgcagcatccccgggagctgttgggagcttgggcggtcctcttcctttcccagtggacggcagcacctaccctgtacatcacctgttgaatatccacttggccaatacaccagcagggacagaacagtcagatgtgaagttgcccttacagagactgtcacagagtcaaagaaatacaccttcaattagaggaggacagagaagaaagatagaacccaggttatattaaaacagtacagtaaacactctcagaattcagagaaggcagagagttgaagaggctgaagtagtcaggaaggatttcaagggtagagggttattgaaatgggtgttaaggaggtagaaatcatgggtcggggggtgggggtcagggatgggagggagagaatgagacattccaagccgctctagtgcacagagagtggggaatgatcagggaatagcgacacagggaagtggaggggtgggctcaacggagggggctgtttgcctgagtgatcttaggaaatagtgttggggaataggagtggggtcagaagatacagactttgaatgtcaggcagaagaacttagaaacaatgctgaagaaaatgaacacagagagagaaactgaaccaagtggccagtttgctaatatttgtcttctaaagcctctccggtggcactggcatttgcaatatcaaaacagaaatgtaaactcagagagaaagaagaacgtgtgaaaacaaatgcacgtgatttatcagaagaaggttgctgattttctggctaaacttacattgtcacctgcagatagaaattctctgcagtattgctgctaaggcaagggctgtgagaggagtgtggttccaagggctgacggagtcttctcccgctacgcctgcctcatttgccgagcaccacaggttattagttttttgttttgctcatgtggccccaagagcctccttgggtcctgggtaagatcattattcaggctggaaagcctttgccccaattccagctgagatcgatccgacaggtagatgcagatctgcagaaaatattgacagcagctgagactaccgtattggtaacgctgggcacgaggaagccgaggccgggcatccacactcccgtgattctacggtggcatggctggggcgagtcccgcgctggacattggattccctcgacgccatcgtgccttgcattactgctgcatttaggatgagtcacacactgggatgtggtccttctaccgtcaagaccctgctcaatgtcagacactgtatcatccaggtggagtacaacacaatccactagcagccataacacctttcggtatctgttagcacatcccaaaggctgagtgagcagaggtgtggggaaggtgagctgggagcaggtgaaggccttgggaggtctctaccccagatgctgcctggggtggggcttctgtgcccagggtgtggctgcaccaaggcagggaggtcaaagagggtggtgcagggggttagctgttgaaggaagagaggtgacagttgcagccagggatggaggaaggaccgactgggacaggttcatagtttcagccgatgactgatctggaggggaaggtctcagttgatcaagaaggcttctcaggtctgcactgggaaggaagttccggtcctgaccatgtccgcgggctctcacctagaagcataattatcttccaaaattgctcagtgtcacttagtagtgtcagagaccacagccacctcaatgccacagatggcagggtgagctaagccccctccagctgactttctcatcagaaccttgttggacatgtgtttggtatttctcactgccaggcatgatgctgggcacagcgtgaggctgcagggatgagtaaggccatgcctgctctcaggggctcattgtctggcgagacagacagacggcaggtggataggtagggtggggagggtgctcccaagggcagggtgctactgggggaagggaggcagagctgtggaaaccccataaaacaccaagcctcaccccggggcatcagggaagtctcccttggagccagtcacaagggctgcattcgggtgaggtggccacgacaaggatgggcagaagctgcactgttgcagagaggcctgcaagctcagaactttggggcatggccctcagggaactccaaggcatgaaatgtatccctgcattcatcaccaaagcagcagagaggcaggtagtccaggcttctgtggactgttcctgtgatacagtgtaacctagaaatcatgaagtgatgcaaagtagtgttctcagaccaaccaacagccttccagtctttctcctatcttagcaacaagacagctgcactgcaggcagggagggggaactgtgtgggcaaatgtttgtggtttggttgtatgcattatatatgacaaaatttcttctttccccctttttttgagacagagtctcactctgttgcccaggctggagtgcagtgactgtgatctcggttcactgcaacctctgcctcctgagttcaagctcatgcctcagccttctgagtagctgggattacaggcgtgcgccaccacacctggctaattcttgtatttttagtagagttggggtttcaccatgttggccaagctggtctcgaactccccacctcaggtgatctgcccaccttggcctcccaaagtgctgggattacaggtgtgagccactgcacccagcctaacaaaatttcttttttctttttatttttttgagacagggtctttctctgttgcccaagcgatcctcctgcctcagccttccctgtagctgggaccacagggatgtgacaaatttatatactgctacacaggaaaactcgttttcagaattacaaggaagagatggtctaatatattaagaacatatattggcaaagaccaataccatatgaaattggtttgaaacagttctaaaaattacacaggctgattgatgttttgaaaggtttcattagaattagagttatttaagtgaaaaagtgaaatttaagtattaatattaatttataactttaataattatcaagaagcacaaaaaggtaaaaatatcaagcccccaaataaggcaaccagcaaaaaaaaaaacaaaaaacaaacaaacacaacataaaaaagagaaataagcattaataaagatggggaaaatggttttagtgaagttaaaaagttaataagtaaacatcacaaaatcagagggaaacaaaagatcaaatttgctcaattcatctgtgtgttagagaaacacttgttctttgacttgtaggattacctaaataaaacacattcatatgtatctgtgcatgtactgtagaataaaatgaaacatttaaaaaataaaagcgatcaaaaaagtcaacacctgttggaggtccatttatcctttcctcacctgaaacccctgcaccgtgatggaccacagcaggctggggcttgtgggtgctgtgtcccgggagctgaagatgacagtggctgtggagattgcctgttgttgctatccatgtgggatttttgtcatcagctggtgatcgttatcattcatatcaattgcgtatcattttattttctcctgtgaattttatctgcttcacgttagtaactcattcttgggtaggtgtggagtctctgcctagaaggtccctggtttggactctcagatctcctcacacagccaggctttgtcactgagtgacagctcatacccactgtttgatccttgttcacccagaggtttccttgataaaatttcattttggtttcttcctatcataatcccttgagatctcatggctgatgcaattgttaaatgttgcaagggaaaactaggagagatttccttgtataattctccatttcccttgttttgcttgcagatacacagaattaaatgtgacaaagctactggcattattgagatggtgatggatcgatttagtattgaaaatgaggggacctacactgtgcagattcatgatgggaaagccaaaagtcagtcttctctagttcttattggagatggtatgctatatcgaatatttccacatgtccatacaagataattcaaatgaaattcttttgactggagagaagcaaacatgtttcatatatatttttttaaatattgaatttagcattcaagactgtgctggaagaggctgagtttcaaaggaaagaatttctcaggaaacaaggtgagtttcctcactctgaccggctcccctgcccctagcataaagcaaagacgattggagtatttgtcagaagcagatcttgcatgatcccaagcaaccctaaaggctgttttaaatgattaagaggttaggcttaccaactgcataggaaaggaacctgctttatagcaggggagtgaagaggaaagcgtgcctctagctttaatgtccagacggagtccagcaattttaatgaaaagaataaagaatgggggtagaggaggtggtggcttcatttggctttgaaatgtagagaaggcagtagaggctattcctatcaccaggaaattgctcattctacttaagattgtgggagctgttaaactttctaactacaaacaatatgttttaaatagattgcttttacaaatacatgttaactagatacaaaggaaaatggatacactttagattctcaaacataccccaagggtttattcaaagaattttttttcttttttgagatggagtcttgctctgttgcccaggctggagtgcggtgatgccatcttggctcactgcaagctccgcctcccgggttcacgccgttctcctgcctcagcctcccgaatagctgggactacaggcgcccgccactatgcccggttaattttttctgtatttttagtagagacggggtttcaccgtgttaaccaggatggtctcgatctcctgacctcgtgatccgcccgccttggcctcccaaagtgctgggattacaggggtgatccactgcgcccagcctcaaaaaacatttttatatatgggatttctgaacttcttgagaaaaattagaatgtgaattatgaaacataaaatcaaaacattcatttttattatttttcattgtttttatttctaatagtcacaaatattttacttacttctacattatgaacatttttgggccaactttgtaggatgtatttatgtatatgaaagaagtgacacatactttccaaatctgctttgtatttttgcattgaatggcaaaagggtattagtgtatgacttattcctacatgtattttaaataaaaatgattaacattttttaaaaacatatataaacctgtctttgattttgaatgctatctaaagaaaatgtgttttacaaaattgctaggtcaaactgttgtttctttatctcatatctattctcttatttaaaggtattatttaccatgttgtcgaatgttcagttagacatatactttgggaaacaaaatataattatttcaatagcctcctttctgaagagcaatagatatgagatgtcagtaagaaggagccatcagacgtacgctcctaccaggaagcacagattccagtggagaatcagtgttaacacgtgtcgacatcccaggcctgaaaactatctcagtttcatcctccacagctattgtgttctgccaaaaatgcattacataaatatatataatacattcttatgtattatatatacacaccatgcatatatgtgtgggtatatatatataatagctatatatttatttgtttactttttccttttttatatgttttcttcccttttttcctccctaggccctcattttgctgagtacttgcactgggatgtcacggaagaatgtgaagttcgacttgtttgcaaggtgagaaacccggttctaacaggaaaacaataaatctcattctggttcctatcagagaggcctttcagggagtagctgtggccagatctgtgatgctggtgaggaaacgtgtggtgcctgtgtagctgcggatgggcggagtggcttttgggtcctgtggactttttaatacttggacttcagtgcttatcttttcttcttcacgaaaagattacagtgtagtgggatgcaatggaaggttggattataaaaattttacttaaacgattattaagtgagtttatgagaaagtgtgccctggtgaaatacacctagaagtgctgctcatacgagttcatcaggaaaggaaaggcatgctttggagacaagatacttctttcagtttcgtttaacaatgtagtaatgaaatatgttttattactaaatataaaaatctgttttttaagcagcaaatcttcaatttaataactgcctactatttgactgtctcaggatgaggggatgggggaaaaagatcaataatgcattgtttttactcccaaactagtttcttattgtctactggataagagagaaaagtaaacagacagtttcaataaagagatgattcgtgagctgcgtgtgccaaggggactaagaattatgcaggccagtgagtgggaaaagatggttctaggaagatccagcagcagggagggacagagaagctgaactgtgcacttaaaaataaaaacaataaaaaacccaaggctggtgggcaagtggggcattcccctgcaggacccagaggctggccatggactgagagggtacagagcacctgagggctgttagtgcagtgacacgggctgctggttgacaaggaaggctggaggtggcagggctggaggacgacgcttcagtaggctgctgagagatggtaactccagcagggcagtttcatatccaccgagagaaggagatttaggatacacatccagcagttaaaaccagcaggggctggcaagtagctgggtgtgggtgagagggaagtgtactggaggaccgagtgggtgtgatatttcttgagatcagcactgtacggggagggccaagttttagggttttgagaatacattcaatttcacaaagatttagttatatccgtggaatggtcagtaaggcataaccggctcacgacaggacatgtgaacctggcagcaatgggaaagtcatctggagcatgtggattcatgagatatcgtgtgtggattcatgaggtattgggaatgcttggctgtggacatgacgcaagtgggtcaagctgccaaaggacagcctttagagacaggaacatcacaaacaattggggcattctggaaaattcagattgtcagaggagaagaggagaccagctccaggattattaagcagaaaccctcagagagttcagagggaaagcaagtgacttggtggcctctggcagggagggactttggagtgaagcgctgcgtggccgggtgaggaggggcggctggaggcagcgctgcatggccggctgagcagggacagctggaggcagcacgggctgggtgctgggctttccaaccccactccctggcaaggcagggtctctacgtggtgggctgaggagatgggacacaaggggggatacgagcaggagcccgctgccctctgaggtgctcagctggcagtgagggagagcgaggggagtcagggtggctttgtctttccttctggatggagacgctcaatcctatttataggcagaggggtcagtggaagaggactcacaggtgaaggaaggggagcacatggggacacaggaggggcagtgctggcctggagggagatgagaccaggtcagcacagccatgcaaggggctgcttggcccccagggcagctccctgtgaaggacaatgagggggcgggggggatgccaaaaaccagggcagagcaagcggcagatccatcagtgcagcccgttggtttcacactctttccagtgaagggttggagggtgttgaagatgaggaaggtagcccacagtggggggagtggcaggagtgggctgtgattgccactgaaggaggcaagacagcagctccttattaagaatggaaatcattgttgagtgcatcaacgtggagatagctcgtagtggcccacataggggtgctgggattgatttttccagatgtggccagtgacctagtgtgagtcaggggacagactcatgattggggtcttgctggatggaagttgcaagaagggaagatggaataggaactttgggtcttgtttaactgtcgttagttggtcaaccagctgtctaagttgagcaggaaagtgaggccaggcgggataaatggagaggaggcagggctaagccttggtgatctccacttggccacctcagcggggacactggggtgtgagcttgttgatgagcctaagtgtcaggtggggacctgccgtgaagagcaagtgcgtgcctgtggagcagaggtctgcagtgcactcgggagtggacccgggcaaggggatttgcaggaggatggggcatgggggtttggaactaggtggctgttgaacacaccctagataggtgcaggttactcctagaaatttgtgtgatgaaaggaaccgtcttactattctgaccatcctcagtattggtaattaatttgcaatttgatttcctgtatatatatatatatattatattatatataatatatatatattatatataatataatatatatatattatatataatataatatatatatattatatataatataatatatataaatatataatatatatattttaattgccaatctaattgcttactgtctcttaaatcaatactgttttcccttcctctcttcttgaaagaaatttatatagatatataattgataatacattatatatatattagtgataactagagctaaggctttgatttgataggttcgataacatgctcaaggttgtggtaaatttattatagaaaaatacttagatttatttttggtagtgaatttcttgcactagtgtgtttaaaaggaagattcagaaatgaaaacatttataaaagaagagaaggttacttgcaaggaagctgcaagggaagtggtctttagaagtcttgctcaacaaatgaaaagcataatggacatttaaagggaagaatcctgccaggtgactgatgatagcctgtgtatgtagtccattcatgctgcaaaaacaactttctcaaattatttaccctgcacagaaaggtatgtttcttccaaattttagacatcagcactgcaaaaatcagttccttagggagtcagcaactcaaagcccagagcaagtcagtgtgacttggttatggtgctggtttattctttttgttgttgttggtattgttgttctgaccgtgccatacaaggtgtgtgtgcactcccaaggccagtggcgagacccccgagttctgctttccatgggctctgatatcatcttagtgggatagaaccgtctataaatatttaaaattattttaggttccctgactaaagtgattcataaatctttaaacacagatattgggaaaactaatattacttgaggtttgagggttttttgtgcaatttaatacatttgatttacatacttgtgtccctgtcaagcctgtgattcggtgcaccattttgtctacagggtttttcatttaataatgtggtgcagatggttattttaaaaattattaacgtgaaaaaatagatggagaaaaacttttgcaaggatgcagtcacattgtaacttcagagaaaaccatttttaaaagtttcagacacagagaaaccacaatcataaacataagaaaatctgttaaacattccttacacagcagaagtggagaattagcgctgactcttaggaagtgtgagtcaggcatgggccatacgtagcctaagaggtgatgtaatcatctttcctagacattcatgtgcagtttaggtgcccatattttaaagagtttatggtagagagaatttgagggagtgcagagaagaaacaaatgagttattttggggaattagaaccgtctcccccaattataggacaaatacattaattacagatatttatttcagaaaacagtaattgaaggtcattggaaaggcatttattggaaaggaccagcaatgtaaaatttttttgaagaagagatgaagagaaaacagtattgacttaagagacagtaagcaattagattggcattgaaaacagacaccaaagaaaattttgaaatgttaaagtaaagggaatcgtctgctagagtcgtggagcctcagccgcagtccattctaagatttgttataaaggagtggttctgatttagaaggaagacactactttgcagctcagtgggataccttccatctatgtattccacaaacattgatgggacaacttctgtgtgccaggcaggcagccatgcacttggggacaagtgttagtgaaacagacgaaacccctgcttcacagagattcagtcccagtgctgtcgagaacgatgccatttcccatagcggatgtggaaattctaagctgtgttgcactgttactctagcagagctgatgacactgttgaatcattttcattcttttgtcatcaacatcactcttcttgaattcacatgggatgtgaacatcgaattgtcagacttgtataatctcatgggattcaaacattctgccatgctgaatcagaattcttcctcgtccctcagaccaatgccggagcatgtgaattggaatgctcatttatcttcggagttccgcaaagcttagtttctagccagcgattgaattgtgaggaatttcagtatagggaaggtcctcacctctagtgagcatttttgtgttaagatttcattttctttgtgtccctgtacctgaaatgggatgctgttaaaagagcagctgccaaccagctttacagacccctcagaatattctctattattcagaaatccccatatatattgcttaagacttgtctttgttaatgacatttcatatagaccaaaagatctttatgcctagtctaatttcatggactagaatgacgagaatcatttgtccttctgtgagcaactgtgaggacttaattttcttagaagctggaatttagaaatgtgtttgacgttattgggagcgacagcttttccataagccttcgtctgagactgtctatagtaaaaactaaggttttttgaggggggggctctgtgatttaagattctaatagactttctttttctcatgagtcagaatgatttacacactaaacttaagctttctacctcacaggttgcaaacaccaagaaagaaaccgttttcaaatggctcaaggatgatgttctgtatgaaacggagacactgcctaacctggagaggggaatctgtgagctcctcatcccaaaggtatcaggcattgagtaacacaagaaagcaaaacaaaaacggcactttcaaataactcgtaaattctacaatcctctaatttgcatcctgaatttcggtggtttgcaaagaaaatgtattagagtttattacgttttctaagattgcagtattgactttacataaatatggaatgtgttttctttgtagttgtcaaagaaggaccacggtgaatacaaggcaaccttgaaagatgacagaggccaagatgtgtccatccttgaaatagctggcaaaggtaaaagaaaacctcctttgttctgtgaacaagaaattcctttcaccaacaggatgggatgtattctgaaggcaggtctatgtctagcctcagctatagcacacattgtgtctttagcagtaacactgtagaaaaaaactatttgttctttggttgctttcagagttttttcagtgttttagaataatgtatgatattactctgggtttatatgaaacgtcatttcggtccatcatcagaagccaagcaacgcattactaatgcagttaaaatgatggaaacactgaggcagtgattcagttgaatgtagagttggatttatgttgagtaaaacgttcttgatccttttttaaaagtgaataggttagaaggatttatcgcacacataagtcttttatggataaatattgccattttaatgattcatttttcaactgaacatcacaatttcctgcatcgatttaattaaacattgaaaatgctgctttcggttaaagttacatgtcgtaatggtgcgtatcccttctcattttcagtgtatgatgatatgattttggcaatgagtagagtctgtggtaagtaaatgccttttaattttcaagtcatttggggtgctgaaatcactatttcctgacacgggaagtcactgctgcaaaagagggcaccatggagctgtggtgcgtgttctgtgggaggccctggatggaagggcagggtggtgatctgctgccgatgaagctttttaaaggacttccctcagttttgtctggagtttgagttttactttaagaaactcaggttgggcgtcctgattagccacttcttccatcctgtcttaggttaattggcatgactgctttgtatataattgctatgagcagctttttacatatgttgaatagccgtaatgaatttttaaacctctcactttgcgtcgtacacattaaaccatatgttatctttacaaataaatgcccagaggtgggattgctggatcacatgtcagttcagcttgtttttggaggaaactccacactcttttctatagtggctatattaatttacatgccaccaatcatgcacaagtgttcctttctctgcttgccagtgttttatcttttgtctttttgataatagccattctaacaggtgtgagatgatatctcactgcagttttaatttgcatttccctgatgattagagatgttcagtatttttcaagtatctgttggccatttttctgtcttcttttgagaaatatctgttcagatcctttgcccatttttaatgggttatttgtttttttcctgtggagttcagttccttatggattttgaatattagtcccttagccaatgcatagcttgaatatagtttctcccaatccatgggttctttcttccttttgtcaattgttttctttactgtgcagaagctttttagttttgtgcagtaccatttatttacttttgcttttgttgcctgtatttttgatgtcctatccaagcgatcactgcccagatccatgctgcaaagcatctcccccacgagcttccttccagcggcttcgcagtttcaggtcttatgtttaagtcttttatccaatttgagttgatttttccatgtggcataagttaaagcgccaatttcactcttctgcatgtggatattcagtgtttccagcaccactgattaaagagactgtctttccctattgtgtcttcttggcatctttgttgaaaatcaattgaccatcaatatttagtttcatttctgggctctttatcctgttccattggccgatctgtctgttctaatgtcagtgccatgctgttttggtttctgtaactatatattttgaaatcaggagtgcgatgcctccagctttgttctttttcctaaggattgtttaggctattagaggctttcctagttgcatacgacttttaggattatttttcctttttttttttttttttttttgagacggagtctttccctgttgccaggctgtagtgcagtgggtgaatctcggctcactgcaacctccatctcctgggttcaagcgattttcctacctcagtctccagagtagctgggactacaggcacgcatcaccacacccagctaatttttttgcatttttagtagagatggggtttcaccatgctggccaggatggtctccatttcctgacattgtgatccgcccgcccgcccaccgaggcctccctaagtgctgggattacatgcttgagccactgtgcctggacaaggattatttttctatttctgtgaaaaacaacatcgaaattttgataagaattgcattcaatctttagattgctttgggtagtaaaaatgtggctttactcttatactcatgaaattattttgtgttaaaatatctcataatgtgtccaagggccactcatggataatagaactgaccagaaggtcttgaagagtgagtgtttataaggaaaatgcaaaaagcagagtcctcactgtgtgcttgtcacctcgaagcagagatgcagcggctgaggggacatgcacattatgttgggagttggatagggacagaggggacaggcccagaacttcccatatcaatagggagcctttattctcatgggaaactggacgccatgggctggagtctctccctgacatatcagaatggaagaagtggaaggcatgttgtcaacacactcacacccacacactcacatccccacactcacacagcagtcacacacacacgatttcccactcagacatacacacacactgacacacaccagtgtacccacaccctacacactcacacactcatacatgcacacacttacatgtgaactcacacactgacacacacactcatacacacacttactcatatgggcacacacttgtgtagactcacacactgatgcatacagactcatacacaggagccctgggaggctgggggagcattgggggaggctgatacaggctggggaagcaccgggagaggctgatggaggctgggggagcactgagggaggctgatggaggctgggtgagcactgggggaggctgatagaggctggaggaccactgggggaggatgggggagtactaggagaggctgatggaggctgggggagcactgggggaggctgataaagtctgggggagcactgggagaggttgatagaggctggaggagcactgggggatgctgagggagcattgagagaggctgatggaggctgggggagcactgggggaggcagatagaggctggaggagcactgggggaggatggggaagcactgagagaggctgacggaggctgggggagcactgggagaggctgatagaggctgggggagctgcttctggtctgtgtgctttgctctcaggctgctccgaccctcccgtgttctgcctggttagggtggtgttggtctcatgagtcagtgtcagggaatttgagcagagggaaggggggtcgggtgggggaatatggctctgcagtgtgttgacttcacccagttcccaagctctttttcaagttgtgattccttgaagggtgaactcctgtctccgagtagaggaaacagagtcccacctgactggggaggggagatggtggtcagggatctctgccttacagattttcaataaccctcctgtctgcagccggcccagatgcagggaccctccaagtcctgagctcactcggttccctgcgcactttttggctttcttagccccgcacagttccctagacctcatgcccctccctccacctccagaagctctggggatgggctcaaattctgtcatttcctcccctgttgtccctcaggctcctgggtggtttcctcctttgcagtggactagcggggtttagggaggtgtggaagtccaggcaggcagtacctcggcgtgacgcggtgacgcagccgcaggcaggcagtacctcggcgtgacgcggtgacgcagccgcaggcaggcagtacctcggcgtgacgcggtgacgcagccgcaggcaggcagtacctcggcgtgacgcggtgacgcagccgcaggcaggcagtacctcggcgtgacgcggtgacgcagccgcaggcaggcagtacctcggcgtgacgcggtgacgcagccgcaggcaggcagtacctcggcgtgacgcggtgacgcagccgcaggcagtacctcggcgtgacgcggtgacgcagccgcaggcaggcagtacctcggcgtgacgccatgacgcagccggagagagcttcacgcacaccatctcttcgttcttcctgaactctgtcacggagggggcctttgtttatttatttttggttggtgctctttctttcctcatgtgtatttaaggataaaaggaaaacaaagagcttcaccatcataacagtttctattttggtttctatttctttacatagtcggagtcacaaataccgttcatgttgtttttttcccccacatattttataattttctttgttttatatagatgttatattaacattcactttaaaaaataattacttattatttcatggaaccacatatcatggtttaagctcttttctatagagaaattaatgagtttccattattttaaataattgtacaatgcacacctttgggcaagcaaaggctctttcaggatttaggaatatgttctttgaactcctagaagcacaataactatgtaaaaactaaaagtaattttaagattcataatataaatttcaagttgcttcccaaaatgaaaaaatactatttaaaatgcctctttgttacactatcctccacaacagttggtgatcatcttgttttccattatctgtgctaattatgtaaatctagttttctaggtaactgtatgtgaatgtaaatttccaaggctgaatatctgataacaatctctacttccagttcagagcttctgccttcatcagtgctacttccttatcttctcctttctgacctctgacccatagatcatctacctcaagcgaattagtcttcatttttattccaagtacactgtgtgtgttctcgtttattgcattttcttattgcccctggggtttcttctgctttccttcctctgacccaagtttcatttgtcttgaagaaccagccgaggtgctcccatctgcttgactcccacctgaaagagtcctgctaaatcttaacgtcccttttgcagattttctacgatagttcagcttggggttaactcacgtagcatttgccatgcactgttgttattttgcctccttttcttaagcaaagctgctgaggggcagatgttgaatctttttagacagttctatatcttttacagtattctgcaaagagcttttcagataattctagcatggtaagagcttgtttaatgaatggagacagcatgggaataaagtataagaatttgtggctggccgactttatgagagacacaagtgagaacaggattgcaggtggggacaggagggcttgccgccgcgatgctttctgtgatcacacagcaagcactccttttcctagatctgaggatgttttattttctgcagggaaatctgcttcgccactgaaggtactctgcaccccagaaggaatacgacttcagtgtttcatgaagtattttacagacgaaatgaaagtgaactggtgtcacaagtaagtatgacagcagccgatggaggccatgccatagatggggctgtccagggcgcacagctgggaccaggcgctccctggggaacatcaaggcactgccatttcccctcaaaattttataattttgagcaatgatgacaacctttagctcagggaagggggccctcacggcagtggggaggacgtggaagaaggaggcagaggagaaatgcctgatagtgttacagacaaatttctctagtgtctcagtcaccaaaggtggctttactggtaacacagattttctctggaagcgaacagagagctgaagcagaactaatatataatttgtagaaaccagactccaaatttacagtcagttggtttcccgctagacttgattaaaagtaccaaaacaagcccaatcattaaaattaaaaacagaagaaaacaagaccaagcctgaagacacagcaaggttttctgtatttcatgcttctctgggtcggtacggatcactgagaaaactaccagagacttctcatgcaacccatagcactgggcaggtccctgctgccctgcctctgggttctggctacttcccaggcaaagcacaagccgacatctgaaacaaccaggcaaactgctggctgaatcgaggagtccccaaaacaggactcgcatcagggtcaccaacccctatagatatcaccgcagataaaagtggacttcaggtgggtgggaaggacagacagagcagggacggtggctttttaacgatctcttcgctatccaaaggatgacgtgttcaggccaattatttgatggtgtcaaggcacccagatgttaacgcccgtcagtacactgtacccagggcgcccacaccccgcctttagttaacgcccctcagtacgctatacccagggcgtccccaccgcgcctttagtgaacacccctcactacgctctacccagggcgcccacaccccgcctttagttaacgcccgtcagtaccgtatacccagggcgcccacaccccgcctttagttaacgcccgtcagtaccctatacccagggcgcccacaccccgcctttagttaacgcccctcactacgctatacccagggcgcccacaccccgcctttagttaacgcccctcactacgctatacccagggtgcccacaccccgcctttagttaacgcccatcagtacgctatacccagggcgcccacaccctgcctttagatatcatagttacctaatgaatatttccaaaggaaaatcaatggttatgactatttcacttttaatatcactggtttgcttaggtgactgtaagtaaattgaagagttgaaagcatgtatgttcttagcttttttcctatttcaattttgacatagtgtgcttttttcttataatggagtcagtacatctgtgcttggaatctctcacgtctttaattttactagcctggtttattcaaactcaaatggagtcactgtagatcccatgttaagggatttgttaggaaagtgtattgaaggcagggtctttttttaaaggactgtgataacaggagcttacaggactagaactctggtgagttttgtgatgtaattgtttatcgggatttattttgtgggacaatgagtaaatctatgtttctagctgaatcaaaccttcccctggaaaaggagaattaatcatcagcatctttgagcttccttcttatttacagcatattgtcttgctgtaagttgtacacacttgcaatgtgtgtcctgccatccgtcataaacacgttcatcttctgggaaaggccacccccctcttcagccttgtgtggtttgtagtacaggccatgcgctgtgctgggtctggggggtacagagattaaacacacacccacacacaggattaaacacacgccctgtggatgtgtgtgaccacacaggaagtgtgtgtagatgtaggtcatgttagtgttagcaagcaggtactttgtgttacacgttcaacacatgttatttttatctaatcctcacaaataccctgtgagttaggtatttatacccacattttatagatgtggaaactggggttcagggagagaaacatgtcattttgtcagtcacgcccctactaagtgaaagagcagggatttgaacgctggctggtctggttctcatcagtgctctcccgagaagctccaagcccagtgaagagggtgggtcctagataggcaggcagatcggggcacagctcatgcatctgactcatcagtgaccatggatcagaagaaagcatccctagatacaaaaagagaaggaggtgttattgtaaatcccacagacttgtaaaagtaacattatttctatgttttatcttccccaaacaaattcattatacaacaaaacaggcatttctttctttttttttttttttttgagacagaatctcactctgtcacccaggctggagtgcagtggtgcgatctcggctcactgcaagctcagcctcccaggttcacgccattctcctgcctcagcctcccaagtagctgggactacaggcgcccaccaccacgcctggctaattttttgtatttttagtagagatggggtttcaccgtgttagccaggatggcctcaatctcctgacctcgtgatccacccacctgggcctcccaaaatgctgggattacaggcgtgagctaccgcagccggccaataggcatttctttaacacctttataactaaactataagaccttaacttcttactatttgactattaaacaacatgaaactatattaggtagtcatcatgtatgattgtaattcacttcttgatgactaaatgcgttcttattagatagcaactggaaaaaaagaataataagaaaattagttggaaaatttgttgcaatatactttagccatttgaggctaaataatccacttcacaaaacctatgaagccagggagtggagctgccaaagactggtgctgtgggtcctggaatattttgtgttaatgggtgacatggaatcaatagagtgctatgagaattttgtgaaatgcggacataagcaaagacaattgttctttagttaaaaatgctgagtaatacatcagaggctatagaacatgtcactttaagggaatgttagaaacttattcagcgtgagttagaagcaggcaaagaggaattcagtaaaaatgttcttaagagaaaagattttgttctcttactgaaaggtgagattaatatatcatctagacatggctagatctcaaagtctgaacatattgaccactgaagtcttggaagtatctcagaaactaaagaaattgcagtctctctttctctctctctctctctttttttgagacagagtcttgctctgtcacccgggctggagagcagtggtgccattctagctcactgtagccctgatctcctgggatcaaggaatcctcttgccttggccacctcacatgcctcacagtgtctttatggcatacaaagaagtgcatgcttcaaactccaaatgtgtattttaattcatttcaggagatttcacacgcagagtctgactttgtaaatgctctcctaaaatctcagctaactcttgaactaactgggaggagaggtggctgcctgacaccccagacaccttccccggcacatcttcgtccttatgtccacagggtgggaggggccgtggctggccatgtctacagtgggaagggctggggcggtgacgggacgttccctttgtcctggtcgtggctttagccgatgtgtgttgtgccttgcggtcctggcctgtggcagctgcaggggtgggagctccaggtatgtgcagtcccctctcagaaagcacagggtgtttccagttctctgcatgtgttctgatgttcactatttagacagcagtagcaaaaggctgctgggtatgttaaggtcccctcaggctgtcccatcttgtggggctcttcccaaaggaggtctgcattcctcaacactgtcctctccagcctagaagcaagtatttcctagcttttgggaatttctcccttttatctacatttcccttcaaaaggggagcaagatctaggtggagttgacttgaattttggaccacactgagaagagctcagacaccacagcgctattgaaaccttcagtggacttgacggaaccactgcctcggaggcgccggctctgttcttgtgcttccatctacctgcctccgacagagtcggagtgttgctctgtcacccaggctggagtgcagtggcatgatctttgctcactgcaacctctgcctcctgggttcaagtgattctcccacctcagcctccagagtagctgggtttacaggcatgcgccaccacgcctggctaatttttgtatatttagtagagatggggtttcaccatgttggccaggccggtctcgaactcctgacctcaggtgatccacctgcctcggcctcccaaagtgctgggattacaggtgtgagccacagtgtctggtctgtcagtcattgatctcagacttagtttttagatttttacacttgtgttacttccagccatttattttattgtatataatattcagttacaaatttataatatttctaaatcgttcactgtgaaataattttagactcatagaaaagttgagaagaaagtaaggagttcccttacatcctccaccctcttcccctgaggttaacgtcttgtgtagccacctccaccctcttcccctgaggttaacgccttgtgtagccacctccaccgtcttcccctgaggttagtgtattgtgtacccaccttataaccatcaaaaccaggcgctgaatgatgatgtaatactattaactctgctacagaccaattcagattgcacctttttttccaggaacgcccttttgcatgttcctgtgttgaatctcaggtcccatgttgtgattaggtgtcctggctcctggtttcccccctgtctaggacagttcttcaggctctcctcgtctctctcggcctgggtgccttgaagccttctgtcagtcactcggaagcacgcccctctgtctgggtttatctggtgtttcccatgattgggttggtgactccgttttagctggaatacaacaaaagccatgctgatacctgatcactgggttaaggcaatgtctgccccgtctcttcctgggaacgttattatttttctcttggtaattagtaaatacttcaggacttggcaagtctcttgtccctccgcagacctgtgtgctgggatttgaggttcagcagtgaatctggccttcagcactgatttctgaggggctgaagttcccttttccttttacatttgttctgctgggaggcgctggcctctcctctgtgcatctcctcattcagctgcttggctgtatccgtttggactcagggatgctgactttgttctgtgagctgttactttgctcaaattgttccagctctggcccttgggagctccttccggttgtcgcctgctttttccagtgtgtgtgcctgcatcttcttaggagcaatgccttattttctgggcccgtaaaacattcccaactcatctcatatcttctgccccattgctacaatcccagaagtcctggctcctggacaaaggttggcatcagagactatcgatgtctcagggagccgcgggtcttacatgctctggagacaggactgggtgatgtgtgagtgcacacggaggcacacactcgctcatccgtgtccacttctgcatctcaccgtctgtgtactagaatctgattggatcccagcccaactccacagccttcattcaagccttgttcctttcctgagctgtaaagcctggctctcacctactgttgttgttgttttttgttttgttttgttttcagtcctagtatttacatcaagcagtttcagaattagtaactcatatctctgtgagaaacaaatgtgcatactagagttcagtgtttcctacaattaattcctttcatctttagccatacagtatcaaatcaaaatattgctttccaaagttactttatgtctttacgttctgggtggtaagcaattcatttgcaacatagttatgttcatttgttactgttcgtattttgttttgggttccccttgctttcaggttggtgttcctcatttgttttgggaaatgtgaaaggcagtgtggttgtaagagtctgagctacagaactggagcccagaccttctctcctcctccctgctcacctgcccccgccccttacctgtctccttcctacctaccccgtcacagttgaccatcctgctggttgctttagcacgaaggagcagaaacgtgtgctttcttctatcctccactgtcttatattaatgtgaaccattttaactttagtttggaatgaaggaatttggtcatgttttgtaatcaagtaatacgaagaagaggttttgtcatatttggcccatttatgtctctaaacaacaataataataattttaatatccctatatgtccaagtcattgtctaggtaaggcaacagttataattaattcagcgactagatagtcaaagaaattaacagctatttttgagcactaggacgtgtttggccctcttataagttgctcattcaggggaagccaaatgagtgggcgtggggtctagggtgagaccctgaagctgggagtgggaagctggaaaccagcatttgccctcaaggtgagcagccagggttgcagacgcagggacagcgggagcctctgctggaagctctgctaatggctgtccatgttctgtgtgtggctttgtctgagtcgtatcgagggaacagaattagaacccagtccaagagaagtgtgtgtgatgcaagagaagctggggtcagaacgccaacatgggcagctcgaggctgggattggggttgaaggtggctgctgatccccggctcatggctacctttgtgcagctgcagcccagggaagggtagcgtcccagctgcaggctgtggggtcctggctcagggcatcttgcatgcatgcatgtgtttaccctgatcccagggtggcagcggaggccgcagctgtgacggaggtggggccagaagcatgtggggtgccagaagtgcaccaagtgggccagtgtgtgatttggtgtccagtggacaccattccttcattacagtggtttttacccttcgtcactggctgagatttgggttcaagtgttcttcccccagattgtgtggctgttgtaaagaatctctcgctgaagtagagggtcactttttaaaagtgaaacttgaatgataagtcactccaaaggcctagggccgtcagcatgaggccagtgaagcaattgtgtgcagtggggcccttatctccactgctgcccagccggtgtgtccaattacaccaaagtcaggaggccggtgggacacatttacagctattttatgaatgatcgcgtgaaggtgtacctttttcccttgtcacctatatcaaaataaaattatgtttctttttctgtaagcaagttgctaattgtgtgagtagaatggatcaccactggaatggaacgtagtccagcagaacataaacgccgcaaaggctaaaacgctgccacttcatgaagcatttgcagcgcaactttcgtggcccagtgaatttcacctgttggacaaagctgtggctgatacggtggaaactccactagcttttcttcatggctctaagtctaaacagtgagattttggggctgtttgcaattttaccccacggaagaatttctagtctctctctctttctcacacacacacatatacacacacagagcagaggtttgaacatcttcgtctatacatctaggatgcaatagttttggcacataatttagctctttgaagaagacacatttgagttaatggtgatcaagaaaacattgtcttctccctaacacccacgtgatgtgtgggaggatgagctcacacagggtgatgagctcacacagggtggcagcgattgttgcgtcctcttggtgagactgaccagcgacagcacgaacagagcatttcgtgcaggatgcaagacaccaggcatgacaaaaatcgtccccttctttgcaagcggggagctcatcacaaatccccaagcagtatccaggctttgcagggcagggaagcagggtggggccaggcaggactgagggccttactgatgtgtggaggttcaggctggaatcctgtcccacgggtctgtgtgtgtgcaggaagcacacatagccaagttggctgtgcctggttgtgtgtgtgtgtgtgtgcatttgtttgaactttgaccctcatcagttccaacaagagagggtgacaagatgactaaggcctatcagtgttggcaaaacaagtttttctgactctcaacagaagagttccacatgcttgttgaaccctgtttccttggatggggtacatttagtcaataaacgattacagtgggcccagttccccactgatctgcaatttctgatttgctgattggtctgtaaagtgtccagttgtaagtgcatccagggggataaagaagtctttcttaatcaagctgtgatgtccctacagtgtgtcagtgtctctttgccttcaggtctctgcacagacgggcttcttgctgctcctcacacgccacggtttgggattgagtggctaatccactgcctggtatatgttctgtgcaaggtttttcttttctgcagagctgagaatcaccatgtaaagtctaattttccttttatacacagggatgagtaggtctgagtgctgcaatggcccatcaatccctttagtaatagcgacctgctgtgagctcacaggacggctggtgtggccactgatgctcacctgccctcagacacaccacggatggagactctggcaagtccgtgttgcctttaatgtaagcgccagcctgcagcttgcaaacatggcactctcggcccggccggctctggctgctgagtgctggggcctggggtcatggcctcatcgcttctccttccctctcctgctccccaggcagcccatgctgactgtggactgagagcagctgggcggagcctggggctctgctgcggggtcagccttcgtgaggctcccaggtcagcaacgtatagaattccagatgcgggactgagagattcctgaaggattgcctggtccgattctcccgcctctttccggggaggggcagcttatgggaaaagggagctaattaacatattgtgaagggctaaaggggtcacttttacattatgtgcattctaacacagtttttaaaagtttagatagaaccaaagtgctcacactgccctgccttctaaggcggcacgaactcgctcccacatcggcaacaggtgaggccaacctgattattgtagacaaatgtgtgtcagttatgttccaaagtcgcttcagtagatgttgagcatgtcttcttggattctaaaacaaccgcacatgggcagtgttagatcctcccttctctgtccgggatcccagaggctaagtctcagggtgaagccaatcccacaaaaccatccctgggaacagccatttcggcctctctggcttagtgtgcgccaggatcccactgtgccttcacagaactcccactttctatccggacagactcagttccgacacacactgccagcaccaccaccagagacccgacacacactgccagcaccaccaccagagacccgacacacactgccagcaccaccaccagagaccgggacgcagagccaagcatttatttttacatatatactttttgagacagtgtctcgctctgttggccaggccggagtgcggtggtgtgatcacagctcactgcagccttgacctcctcgggctcaggcagtcctcctgcttcagcctcctgagtagctgagactacaggtgcttgccaccacacccggctaatttttttatttttgttgagacagggtcttgctttgttttccaggctggtctccaactcctgggctcatgtgttcctcctgccttcgcttcccaaagtgctggggttacaggtgtgagccaccacacccggcctgagctgtgcatttattatgggcttaacatatatttgttgaaggaaagaataacagagaaaaaggctatgatggtgaggagggctggagaattccctttcccgatggaacataggcattcttggttgccggcaagggtaaggaaagatgccacaagcaccacagctggctctctgtgcaactgacccagcctgcttccccaagctgcggctgttctggagctggtgcccgagagaaacaggtccacattccagctcttgggtggccctggagtccgtcctgttttcatgcacctgtgactatgacttccacagatctctcaggctccctctaaactgaagtaatgttaggaaataacttatacacttttgtctgcagtaaacagtttggccttatatgttgcagatgtggaaccttagaaggcgggaatgtatgagcaccttgtttttatctaaactttaaaatattgtagcataatacacataatgtaaaagtgagcattttaaccacctttaagggtactgttcagtggtgttaagtacattcacatcatcgtgcaggcaccaccaccacccaggaccttttcatcctcccacccgaaactctgttcccattaaaccctcagtccccattcccctcccccagcccctggtacccacagttctacttcctgtctctgtgaatctgactaccctaagcccttcataggagtacatatttgtctctttgtgacaggcttattttactcagcaaaatgtcctcagggttcatgcacattgcaggaggtgttgggatttccctcatgtatttatggaccacattctactgatccattcatcaccaatggacgcttgggctgcctccccaccggggcggtcgtgaacgatgctacgaaggatgtaggtgtgacaatatctctccaagaccccgtgtccaattcttcggatctacacaagtgcgattgctggatcatgtagtagttctagctttaattttttgaggaactaccatactatatagagtaatgttaagtccattatgtcgtgacaagtatatattacataataatatacctttaaaaattaagtatcatttaattttagaaagttttcagatctgagttactgatgtggtcaatacattcgtaacagccagaataatctattgtgacattggcatcagcagcttagagaaggctgtcacagcaacgggacattgccctgtagacattgtgcgtgtgacatggagaccctaactcagatacgttcctgttgctcttttcaagagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaaggtaagagaattcttctttagcatttaataatttcctatttagaaatccatttagatgctgaagggagggaatacaatatgaatacaggagacaatatgaatttacaattttcatttagagaaaatgaaaaaataaatttattctttttttatatatcagttttcatgaaccagattcactggtataatatttgagtgaataaataaaatctgaacactgaaatggttagtaacgtatgaactatttcctcacagcttttgatgaagcatttgcagaattccagcaattcaagtaagatttgtgtatttagttactatgatatcctgtgggcagttgagtcccagtcgttttggctgcatgtgggaatctgtatggaagcctgggtgacctaaagaaagagccattcctgggacagaagtgggaatttaagcaatgcagtatatggaggggtgggcattctcctaaaccagaaatgcatttataaacggactgtccagagtcatcggaaccccggatgaatttcggaaatcattattgtgagagttgaagaaagagaaaagaaacacgcaaagcagattaacagtcaaagacaggtttattttggagaataaacctgagtggggcttttggccgatttcggtcaggagcgctttcttttacagactaagggtatttaagggttctggctcaggctaggaaggtttctgtgtggaggagagttttattgtgaggttggaatacctctggttggaggggagcttatctcagggttggaatgtttttgattggagggcaggttatgccagggttggtatgtttctggtcggaggtgtcatttgtggtttatggccatgctgacattagcccttaagctgatgtttttgggctggacttaggcggtttctaatcaaggaagacttaaaatggcgatgctagtccaagatggcggtgctgctgctctgccagtcatcatcagggcagcacatcacacacagcaactttttaaggacaattcggggttttcaaatgcaccatcgagtcttcgcacatccgaagctgaccgcagtccttggcccatgctagcttatttaatgaacatttgttgactgggtgcagggatgagcaagatagatcagaaactgacaaattccgaaaatatctcaagtctccagtgcaatctagtgaatttgtgaaaaaaaaaaaaaaatctcttcaacctgtgagctggaatgctaaacttttctgtgggttttagcatctggataatagggcattttccacctcaaaatgggcagtgggaaccatcaggaaaaatcagtgatatccatcctggggtcctgtgacccgaacatgttcttctaagagaatgcaaacgtatctccttcttcttttgcttcatcgctagtgagcctctcagctgtgcattttgttggaagcattttctcatactctcttttcattctctcctttctgtcccctttaacttttagagctgctgcttttgcagagaagagtaagtacctgttggattgtaaccaggatggtgaattatttggggtggggcaaaagtgtccatattttggaggaccaactttgtgtattaaataataaccagcaatcccccaccctgatgtaacaacgccaccaacaccacaccctgtcctggagccccatgtcctgcaccactgatccttgcactgctttcggccttagccccgtcaccccttggacaccctccctccctcctcccttgcagaacctgcagcccagacacccagggccacttcactttctttccctcccttcctccctcccctccccttccctccctccctccctccctcccttcctcccttcctccctccctccctttattctttttttttttttgacagagtcttgctctgtcacccaggctggagtgcaatggcatgatctcggcccattgcaacctctgccttctgggttcaagcgattctcctgcctcaacttcccgagtagctgggattacaggcacccgccatcatgcccggctaatttttgtatttttagtagagacagggtttcatcatgttggccaggctggtctctaactcctgacctcagatgatctgcccgccttggcctcccaaagtgttgggattacaggcgtgagccactgcgcctggccaggaccccgtcactttctgcccaactcagggacacacgcggctctccaggccttccgtcctcggtgaattcttcacccttcaagcccagttcccatctcacatttcctctggagtgtttctcccccaaccccttcacagagtctgttatctcctcatctaccttcccttggctttggtttatccctcaactgtaaacatataaatctttttctttgatgctcgctctctcctgagcataaactcctcaccacattcaccttggtacccactgctgcttacatggctcctgctccgtgggaacgtcccgcagatgttttcctaaccaaggtgctttcccgttgcagatcgtggcaggttgatcggcggcttgcctgacgtggtgaccatcatggaagggaaggtgaggattctaaactcggccggggtgggggtgtcagcacggtgcgatggacgcaaccccttctcttggggcggagcagagggaacccagtgaggggcttctgtgtcctcactcagcctgcagggaacccagagtcccccccacttttctgcccctcctagacggcttggaatagcccctgtattctcaaaggaaggaatcacataacattccgaatccacaaacctgtgttcagaggaacacgttgtgccactcaggcacctcaaggcaagtgctgtggctttgggtgtttctatgcccctgtggccattcacccagaggagcaactgcaggatgaggcagccacactcgccctgacctacctgcgtgtgtgaaggtgcaagccccctgcttccagtgtgaaacagcacagcttttacaacacgaaggaaaaaaaaatctctgctcctattctcaaggtcattgtggaacacatcgtggaagccacttattggagtttaatttgttgcctgtcgggagaattattgatatctaattgatagctgtctggttgcttcagtgggtctaactcaatgtcacagggacagagatacttgagaaaattttattagcccaaaagacaaaaatttatagacgtcttctttagtagctaatggaagcctagagagctcttgagatctcatcttaaggatgtaattgagaaattagcaatcgttttactttatcctaggctgaaagcatgttttaactaagcttcaagaatgcatttttttgcctccaatttaccagttataaaacgatatattcaatgggtttgccagaggaactggtaagagggatccataactctaaatagaaaggaaatttgggagcagactggatatatctactataaaacatagagcttaattaaattactttcaaattctttaattgacttaggctatggataaaagctaagaataaataggacacatgctcactgatttttttacgagctcgcctgtgaagtggtgaacctgttccctgctgtcctctgcctgctctgtccagagcggcgctcatgtacataaaggcttgtttctaaacaaacgattgaaggaccaataaatgtaactgagtgtgacctggagcccaccgtccgagggggtgacatgactttcctttttctaactcttccttctccaccaacctcttccgtccaaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatca

SEQ ID NO: 1536 - DNA, 1431 bp, Homo sapiens
aatgcttgaactttattttggagagagaaatttagaaagacacaaggtacacagagtaaaatgtttttcttttttcaggaccttgaactgaatcttgcactgctttggtttctatctaggaagctcagcgacagcagagtctgtagaggcggccactgatttcacacaccccggagagggactcacgggtagcacaacggccggttcggcaatagcaggtggctcttgcctgagaacctgtggaaagaagagagggtcaggcacagcgagggaggtgggaaaaaggacaagcacagccagactaactgagatagtctaaataagagacactgtatcagtcatgttaggatggagaaaattcatgtctttgtcgtaagtgacaagaaatcttactagctatgtgttagtcatgcaagatcatagtttttttccccatgtgagtctatccaggatgtatttattacctgctccctggtccaacaatatacctctcaacctcagggttacctactcttcattctgcttcatccacacgcctaatcttgacctccatgtgtgatttccaggtcctaacaaggctccctaaagcacctgaatcagtttctgaaatgccgcattgtgcatgctaatgtcatggaccaaatactttggtgctcaaggagtctttgaagactttccaaattcaaattcttcattctctgtctctcctttttttttttttttttttttttttaacattttacatatttacttgttttaattgacaaacaataattgtgtatatgtatgagacacaatatgatgttttgatctaaggatgtattgtagaaagatttaatcaagcctattagcctacatcaaaacacacctataggttcctctctaggttctaaaagcttttccaatggacaaagtaaaacactctctatataactaagtctgcccatttagatctacaaagaactagtcagtgtagctctttctatcttaaaagtagcaaatttcacagaaatatcttggaactgaaagtcttagaaaaaagaaaatcttttagatttatttggttctcactgattaatttatagatgagaaaatcaaggtccaggaagattaagtaaagtcactcaagtgaggtagacctttccacacttgactccagatcctttctccaatcctttttttctagattttgcagatgtgcaagattgatgtctcctacctgaggttctaagagcagagagtccatttcctgcaaaggagatagcaaggtcctggttgtcttccccagactgcttctgggttgtagcctcatcagctctttcctggagtgactcagcctgggcctgcagggccaccaggagaatggcagcaaggatggcgatggtcctcatggctggggtcacctgcaggagggagagcaggagtggatat

SEQ ID NO: 1537 - DNA, 70744 bp, Homo sapiens
gacagacaccatctgctcgctactaccaggctgttgaaagcagatggtggctgaggtttctccaaagctggctgcctcccctatgaagaagccctttggcttcaggggcaagatgggcaagtggtgctgctgctgcttcccctgctgcaggggaagcggcaagaacaacatgggtgcttggagagaccacgacgacagcgccttcacggagccaaggtatcacgtccgtcgagaagatctgggcaagctccacagagctgcctggtggggtgaagtccccagagcggatctcatcgtcatgctcaggggccctggcattaacaaaagggacaagaagaagaggtaaccgggcctggggctgggaggaggcgggaccttgggggatggggttggacgtgccctcgtgtgtgtgtgtgtgtttgtggggggcgccctggctttcttgcctcctcaggtcccacgccacccggtgtgtggatacttcagagagctcggggcacaggcctctttatgagcagcaacacaaaaacaaaactttagttgatttccaatcccataataatttcccttatggaacacttaagagactgttttaaagtgatttaactctcaaaattaagtcgatgcagcagattatttttaatgtacacattttaaaacaatgttatatacattatagaaaggagtataatgagaactaagtcccataatatatcaaattctgagattaaatattcttcagataaaatccaatatgcattttatatcaatgtacccctatgtaaatatgttctttactgaggaaccttagaaggaaactgaaatgggaagatagttcgtgtccttgaataggaagatttatttttcttaagatgtgagctcttttgtgtttatcacttttacccaagccaaataaaaatagtaaagttttaacattttaaaattacacatgctgtcttttactattgtgataaatgtttgtgacagaatggaaaaagacttgctcttccagatatcaaaatgttcatgtgctatttccacaaattgtttactaacagctcaaaagacataaataaatagaacagaatacaaaatccagaaatacccaaatatatgaatttagaacttgatagtggtgatgtttcatagtagtataaaaagatgaattattcataaatgaaatgcatgctgtttggagaaaactagctagattttttatgtcacaaaaataagttcctggggtatacattaaaaattttaaatatacaaattaagaaaagtgccagaaggaaacacaaatgtctatttttatatgcagatatattttatgttcacagagacctaagaacctcaaaaacaagtattctgaagggtggtttggcaaaataaaaattaaaacaccctgtaaataagaaaaaaattaacaaaggacaaaacacttgcaaaacatgtattttcattttacagagaattctttcaaatcaacaagaagacaactaaataaaacaagctcaatttaaaattgggcaaagtacttttttgcatgtctaccaatgacctatgcacataggagaacatagtgttcctgataagagaaggaatttaaattagaagagaaatgaaatactcttttctatctaagttagaagaggaatgaaattctgtttctatccacaaagtttgtgaggatgaagaacagtggtacttatacagcttcttaaggtttaagttgctgtgagttttcaaatagacattttggtggtaagaaccacattttaaaaatgtatatgccttttacccatcaattccattatactgaaatatcttttggaaatagatacatctgcttttcttagtattacttaaatagcagtgtattgagaagaactcatgtaaagattttatgaacaaatttcagtccatccatatgatggaataatatgtaaccattgagggtgtcaatagatacagagataagttgacatgcaaagatgtacttaggtatatatcaagtgagaaaaaaatcagttatacgcaaacagaatctgctcttgtgttagctgaaaatatgtcaaaaatatgataaaacttatttctggggatttgtattgtaagtgaagtttttccctttatcttatctgcgatttctgcgatgaacgtctgaaaagttttagttaagtttcactagtaatgaaataatccttgggaagagaaggagtatgctatttgcataaatacaactaatttctcacattctagtatttatttttctttctgtggatgcgtatcttctgtgaatttttttttttttcgacacggagtctcactctgtcacctaggctggagtggggtggtgcgatcttggctcactgcaacctctgcctcctgggttcaagtggttatcctgcctcagcctcctgagtagctgggattacaggcacgtgccactacgccatgctaatttttgtatttttagtagagatggggtttcaccatggtggtcaggctggtctcgaactactgacctcttgatctgcctgcctcggcttcccaaagtgctgagattacaggggtgagccaccatgcctggcctcttctgtgaactttcattcttttcagaagtagagggaatctgtttacctgttactgtagattttattgtgtatatattttattatataattatcttttcattgtatatagattaacatgtgtaagaagtatggattaattattttagttatatatgaaaattaaaatagcaaatataaatgattattactattgtgaatgtattgctgtactatacaggagttttctttgaaaatattgaattcttcagctgtgtttatcaattctttcaatcgatttattcatcaaacataagccagacacctattatgtggcaggcatattctactatctcttaggatccttctatctttgaaaatttcatgtttccctgccaggcctgagcaaactgagagatttaaaattggactattaggacttaatctcaattgacgcttttcctctctcctttcagaaaaaagcgtttcggaaggtagaaaataataaaacgtaaactttaactgcctttttgaaaatttataacagtcacgggtaaagactagtttaggacttttaagaactaaaacatgatacttaaacagcgtggaatattatgcagccatagaaaaagaacaagagcatgtcctttgccagtgacttggatggagctgcaggccattattcttagcaaactaacccaggaatagaaaaccaaatactgcatgttctcacttacaggtgggagctaaatggtaagaatgcacagacacgtagaggggagcaacacacactggggcctatcagagggtggaggatgggaggaaggaaagaagcaggaaataaaactaatgggtactgggcttaatacctgtgtgatgaaataacctgtacaactaatgcccttggcacacgtctgcctatgtaacaaacctgcacaccctgcagatgtacccctgaatataaaagttgaaaaaaaattccacaaatagtttcataaatccattttaaaaaataaaatttataacaatcttaaatcctaatattaatgattgtaaatatctgatttacatacattctacaaatctaagtattgaaaaaaattagctacacctattcatttgaattccatgttttctttggcttaaagatttttgaacaccaaagtaagaattagtttattttagaaatttgtttttgttttcacctcagccctcttaatgtgtagttcttttaagaactaaaattcatctaaatgtcagtcatctgaccagaactgccccagacctgttatagataccatattctacttaatgtaaggcaccatagattttatgatgccccattattttatgtcacaagaagagagttatttaaatgctgccaattatagtaaattgtgaattataagcggtattccagtgtaagaaatgtgaaaacatggagacaatgaacatcttagaatcaataaaatacaatgttatctgtaatctttaagacatatctcaaagtgtaggtgtaattgtatcatgtcacttatttcaaatagtcttcattaagtagtagtattaatacaaattataatatctgacaattattgagctgttatttgtgttaggaactattctacatattttgtgtagagtctcatttaagcattatagtggttttctgtgagaaagctattttttgcatccccattttattgatgacgaaattgagacacaaaaagactaagcaacagctaggaagtgacagagcttaaaacagttttccagctcaagttgaatggaatccaagggctgcgctctttctgttctgatactctgctctttcattaacacagtgagaataagaggtaataaatagtgtgctttcttcacaggaatattaaatatttgttttgaaggctgggatagcatgctattcagcatttgcaattacatgagtcattggtatggctttagatagtgcattacaatttcctaaaaaagtctctcactctcttaggactgctctacacttggcctgtgccaatggcaattcagaagtagtaagtcttctgctggacagacaatgtcaacttcatgtctttgacagcaaaaagaggacagctctgataaaggtatgcagtagccaactatatcagcatgaggtagatttaagataattaaaaaaatgagttttctcatgtaaatataacttggtgaaatctgtggaatgtttattttgaattcctaggatttacaattgatttcttggtctaatactgacaggccgtacaatgccaggaggatgaatgtgcgttaatgttgctacaacatggcactgatccaaatcttccagatatgtatgggaatactgctctacactatgcagtctacaatgaagataaattaatggccaaaacactgcttttatacggtgctgacattgaatcaaaaaacaaggtacagatctaccaattttattttcaaaatactgaaatacatttgttttaacatcgacttgtgtaagggtcagtttgccatatttggaagctcaagcataacctgaatgaaaatattttgaaatgacttaattatctaagatttaattttaaatattgttacttttaaagaggcatcagcaggtacagctttttttatgcacttgtggtaaaatttttttgaaaacactgaatttgtaaaaggtaatacttattttttttcaatttttcccttccaggttttcttttccctaatcaatgtaaaatgacaaaatttgccctggaagcaagtttttcattaaaactccaagaaaactaaaacatgtttcagtgaatagaaatcttgctgctttggcaagttcctaaaaaaaaaaaagtaatagatatgaagcgatgtatcttttagtggcaaggcttaagatatttctgattccttataaggcagaaatagaaaatgaaaaggagagcaatcagaaatatcgaggccaatttggaaattaggtaatggaggaaaaagaccatgaagagattctgtgtgtgtgtgcttttttttgttgtttgttcatttctttcctttgcgtggtgaaacaaggttctcttcagttttagagaatgacagttttttagtttgggagagggagttagtgggttgtaaactgcctagagattaattttaggagccctctgaggaagcagattggcagtgaataggtggtatgtaatgggaaacccttgagcagagggaatatcagggaattatttgacttattatcctattctggtagaaatggccacttagatagagtctaaactctgctttcaaatctagaatgtcttgatgggaaggtgggagataaagagcttataagtaataagatcaagttggattttgagtttactaggccctgttctaaccccatccaggaaaattaagtggtgttttcagcaaatgagtctctcactctttccttttttttggccaaaagctcaaatgataaagggaattggccatgtgggtgagagatgagactgaagtaattgtctgttgcactagttttcaactagaagtgtgcatctcagtaacttgaggaacattttaaaataatctacaagcctagaccctctcctgaagattttgatacagtaagtctaataaagcctggatatgtccatttaaaaatgtttccttgaaggcaggcatgctggttatggatgccttcctcccagctgctagagaggctgaggtgggaggattgattgagctcaagagtttgaatctagcctggacaacataatgagaccatgtctgtaacaacaatgacagcaacaacaacaacaacaacaacaacaacaaattccttaaaatgcagatacacttctgcttaagaaccactgaatagataagtgtaatatgtaaattctcatatctcagaaacttaagacatctctagaagagttggagttggatatgcgcaatttcctttaaatctttcctttccaataatattagtttgactttctctttctttctttctttctttcttctttctttctttttttctttctttctttctttctttctttctttctttctttctttctttctttctttctttctttcttctttcttctttctttcttctttctttctttctttttttctttctctctctctttctctttctctctttctttctttctttctttctttctttctttctttctttctttctttctttctttctttctttctttctttctgactgggtctcacattgtttcccaggctggagcacagtggtgcaatcacagctcactgcaggcttgacctccccaagtacaggtggtcctcccacctccagtttgtattttatttatttatttatttttttagtagagatgggttttttgccatgtttcccaggctggtcttgaattcctgtggtcaagcgattcagctgcctcagtgtcccaaaatgctaggattacagttgtgagccaccatgcctagcctagtctgactttcttctctgtggttgggacattaaaatgaatattattggtagtatctatcagcttacagaataataccttttccttcctaccatcagttattcactgccattcagaaggtctttagaaatttgcagtgagtattctttcaataagtagaggctggccctctcaggattttgtgtctctttgttattcaagtgcttaagtcagtaagtcattactaagagcagagttttctcaattaaaattgtagcaaattccaaaccatttttgtcaattaaagccatattatggactatccagtatgtctcttaagtttgtagaactttggcataatcaggatggtagtattaaacactaaaaaccatgcagttattaagaatacacatgggaattctgttaatttagtttcagcagtcctatgaactgattatttagttaacaatcaggaaaattaaatataaatagatttcaaatgaataaatatgggaaaaattcttgaaatgggcagtatgagccttaatagcaattttttactgcacattggagcttgattttttgggtaaaacatctgaaactgaagaaatattttacatgcaaattcttgctttatacacaacaatttgtcacagggtttgaggatatagggataaaagatacagaccctgccctcaagaagatttttgtttagataggaaaaattattatcatccaataataccatgtcacaaatgctgggatagagtcaaagattcttgaaaccagtaaatgtttaaagtgagttttcaagatgaccagggttaatgtggtgaggcagaggaggggtgtttccaagggaagagcagtgtgtgggaaagcacggaagagtgagaaggaaacaactacattttatttactttctatgagtataagtccataggatctttatataaagtttccaattcagttgagaaatatataattttttcagttacatattatttttggtttctattgttttacagggtggcctcacaccacttttgcttgctgtacatggacaaaaacagcgaatggtgaaatttttaatcaagaaaaaagctaatttaaatgcacttgataggtttggaaggtatagttatttcttttaatctctgtgttgttctagattgatagcagtcactcaagtcataaatattaaattaataatactaacttatacttattgggacatagttatcagtagcaacacaaatcagttaagtagaaaaaaacagttatttagactgggcaacataaagaacagttttagtaggactcattttattattttgactgatgttatttgttatgtgatgttattggttgtatgttcttatgttagctaaagggatttcatattagttttagaaagtgtgaactttaactttcagttatgactcagtcttgaacttcttaaccctttctagtagtttttaacctctgcttcttatatggttttccactaaatatgctatattaaacataaataggagttgcaaatcattttgtcttttgaataactctgctttaagttgctttctttaaagaatattaatgttagcttatccctacttgacaatcaattgctattcccacatactgtgggttcatcagatttttccctttttatttccagtgtattttgatgtttttatttttaattagtatggagagagggagcgaagatagtcttaagtggatacacttttcctttcatgaaggcaagccataggtgggtgataaagagaaaagagctaggctttagagtcacacaagactgggtttaattcctagctttcttacttgctaggtgtgtgacattgtgaatgttatttaccaccaaatatgttgtcatgtatgaaaaggaggagaatatatccttcaaagttagctgtgcatagtaagaaagatatatatatatatatatctttatatatatctttttatagcatttaattcagggcctagcacatgcttattggtattcattaactgaaaccactatgaccactattcttaccatttgttattactgctttcagcatgcagatagctcttatttatctgatccctagctgattttctattacagtgtatcagtctagggacctgggaagaaaacttcacttaaatctttgtctacttcagataagcagccctagcatagtttcttgcccatcaaaggcctttaaattagtagctgctactatgcaataccccactgagataagaggtttcctttttgtcccttccttttaaccttgatggtactttataaagatgaacccttgagcacccaagatgcttatgtcttttagtacatgtaaatgtttaattctgcatggacgggcaagatattaaattggcaaagtatattgaattagcttttaaaatcacttgaagttcctaagggagaaattatctctatattattttagaactgccctcatacttgctgtacgttgtggatcagcaagtatagttagtcttctacttcagcaaaatattgatgtattttctcaagatgtatttggacaaactgctgaagattatgcagtttctagtcatcatagtatgtaagtgtttacattaaaagtctagttaaaactacattgaggtttaaaataattataatgattgcatcttatatatcaggtgagatgtgatagattgattcaggtagttttagagtggctatgatttagtccactgcatcagctagaaatgaaacaaaaaactagactagttagaagtaccaatgggtgcaggattctttatctcgggacttttaagacctttatccttagagattccaacattgttcatttcattccatgtataacacctatgcatgggataaaaaatagtgccatatctttaatttttctagttagttatttgggtcttgaaatgttcagtttaggagaaagtcttgtactgtcttctggggactgtctcctatatactccctgaattttttgagaaccaaagggattcactaagtccaaggaagacagtcctttttttcaagtcataaggaggagaaaaaaaggacattttaatcattcttttgtttctgttgattctgttgctgcatcgttgccactgaaactggtcctgctgcctggtaatggttggcctttgacatcaagatgcgcttactgattcaaatccctcaagtcttcatggtgatccatacatggacttcaaagttataaaattttttacattcacatacctatgcctatgtgttcagccattgttcccaaagcaccagcaccctgctctggcagcttagcatcctggctttatccacacacaaagtgagcaaattgacccttccacccacattcaaaacctgatgtggaacccacatgttatcctacacttaactgagactgtcatggtaagagatcctttgagtcccatgttggtcttttctctagcagatattagctgggcttgttctaaactgtcagagaggttcaaataatgtggcagaaagaggtcagtgtttgtttattcttctttgctaccatatctgtaccctgaggcacatttatattgtgtatagtaccttaggcagtagaaagtcccatattaaccttccccagagcagtgagcacccagttatagttgaccccttgaatgatccattttccataataatgagaatctcccaagctacttgcatctcttcctcaagatttaaaaatattttcaaattctacctcactggaagatattgaagagatttctcaggatctcaagtaggttagttggacttagagccaaaccttgtcaatgactcatcactgtccatgtgtaaaagtagagctttgtgcttgcttaggcagcacatatcctaaaattggaacaatacaaagaaaattagcatggtgcctgcataaggaggctgaaccaatttttgaaggattccaagttttgtgcagtcactggaaggtcatttgactattttctgactagctccaaggaaatggtgtgaatcaaagcaaaatgggtgccacctaaatattgaaattgtgattttttgctacaaaaatattcatgtaaggtggtctaagagatgaccccagagctgaataatgtgtggggtgttgtgtgaaaaatatattgccagcatgtgacttgaaaattcaagaaggtcaacttacaacttcttcatggaacctaaaaaaaaaaaaaaaaaagtagggttttagtctcccatgtcagctggagatgagcagggagatgaagcatcatcctaacaaacatctgctggtttagagtttgagtctgtagagaaggatcattggtccaagccaggtgttgacatccagtggattttctgcccttgttgtgattggtaaactccgtaatagtgggcaatcatgttttctactttaatgagatatttatgaataaatttagttacaaactatgaaatagttgagattccttgaattataagccataaagagtaggacaactaataaggaaaattaggacttaacatttcctgaaaattacaacatttgcatattagggcctatgaacaaaatatacattgggttttatttgggattctgagataatttcagtataaagtttaggaatagattatttcattgctttactatttttctgagcatttagaaaatgttatattgttaagtctttgtaacaacctagtgaaataacaacctagtgaaataaggcagcaaagtccccactttgtagaaataacaacctagtgaaataaagcagcaaagtcctcactttgtagaagaagacattgagcctaagagaagtaacttgtccaagaacaagttgagcacttaggcataggtatggatcagctgttcattatggagctaggccttatgcagagttgggacactttctattgtgtcaagctaatgcaagttagtttattgagtcataatgcccttgatttatgagtatttcaccttacttttttcttctttaattagaagcttaatgagaggtttgtagaatgtacacagaactgtatgggataatattgttaagttctgatattctgatactgtttgaaatactcaaagaatttttgcatttggtaagcatttttatatcagtattaaaatagtaattttatttattacatttttatacatagaatttgccaattactttctgactacaaagaaaaccagatgccaaacaactcttctggaaatagcaatccaggtaagacttctgatagtgaattactttaggtcagttgtccccaaccttttcgccttcttggcagcagggaccagttttgtggaagacaatttttgcatggactaggtgaaggtgtggatggtttcagaattattcaagcacattacatttattatgctactttatttatattattattaccttataatatataatgaaataattatacaacttaccataatgtagaatcagtggaaactctgagcttgttttcctgcaactagatgtcccatctgggggcaaagggagacagtgacagatcatcaggcattacattctgataagaagcacacaacctagatccctcacatgggcagttcacaacagggttcatgctccaatgagtatctaatgcaaccactgatctgacaggaggtggagagcaggcagtaatatgagtcatggggtgtggctgtaaatagagatgaagcttccctggcttgcttgcttctcaccttctactctgtggcatggttcctaacaagccatggactggtaccagtccatggcctgggagttgtggatgcttgatctgggtggtcctatcacagataaaaaggtaaaagtaaggaagttttgatcacaaaagaagagcgaagcacaggttatgtttcatatgcttgtaccaacaaagtctcactattactgacttcattcctcctaatttgaaattgaaagagatagatttactttgttggaacaagatgtattcttctacctgctggttaattgtcatgataaacagtaattttgttagaacaagatgctttgctgccagtcgccaaaagattgtcataataaatacacaaattgcccaattctaggctcagcagattataataaaagtacaaaaatgtttcacagtaagaaaaatgctagtatgctacctggatgtggacacctaacgcatcgtacaatccagactctataaggacatctttaatttagccctatgtttatcaaagagcttctgtaagttagattgtgtacattgcaagagacaaagatggaatagatgtagttctgatctttaaggtgctcataatagaatacagctgcctctatttcatttctctgccttttcaacagaatttacaaagaaaatatttttatgttttcacttgtccacttaacaaataactataaaatgtcttttaggtactaagcatttttctaatgctagagaacagaaacaattaaaaatacagacaggagtttgtcattatcattgtcatttttattatgttcctaccttattcagtgcttactgtgtgctagatgcccactggaagtttataattatgatttattgtatattatattgattatgtgccagacatacgtgatgaggaatgaaagctttaaaaaaaagtaggtaggatttaaggtaagcatgcagagtgagtagaatttttctacgtaaagaagtagaagaatgatgtttggcagaaggaacatgtaatgagattgcctgttgggaggaagagcagcaagtgcaaaagacaagatgcttaagcgaactttgtagggtttatgagcagttcacttttgctagtacaactagtgtgagataagagaggttgggaatgaggtgaatatttagctaaggcaagtttatgatagactttttaatactgttgaaatgagtaggtcttattctggggaccacgggaaatttaccttcgatatcttccagtgaggtatttgctttggactgcaaatactagatgagcagtggctaaaacagtaggaaccagagttgttttggttgttcagtgatatactaggttccccttgtccctctttcagctgtgcttcatgtctcctttcatggttggctaatccacaacagttccaaacatcttgttctcacaacacaacatcacaagggctgcttttcttcacacatgtcttttaaatagggagaaaccttagaagcatgcagtggacttcctgtaacatattattggctaggtcacaacatatgcttatccctaaaccaggcactggaagagcaaatgtaagtatgtgattagcttagaataatcatttctctttctgaagctgaggagggggattggaatactgtctcagaagacttgtgtttcttctgcaagaaagaataaggaataagaaagaataagggagccagcaatgtttgctgcagggactcattggagaaatttgagcaggggagtcacaagattaaattagagtattaaggccttttggtaatgttgtaaaacaggggttggcaagctttttctgtaaatgaccaggtggggaatgttttagactatgtggtctctgtcatatctacttaaccctgctgttgtgtgagagcaactatggataatatgtaagcaaataggaatgagtgagctccaataaaatgttattttttttttcacttttggcatttttaataggatttttaggcataacatcttacataaccacacagaaactgtttctggtctttttttattattatactttaagttttagggtacatgtgcacattgtgcaggttagttacatatgtatacatgtgccatgctggtgagctgcacccactaactcgtcatctagtattatgtatatctcccaatgctatcactccccactcctcccaccccacaacagttcccagagtgtgatattccccttcctgtgtccatgtgatctcattgttcaattcccacctatgagtgagaatatgtggtgtttggttttttgttcttgtgatagtttactgagaatgatgatttccaatttcatccatgtccctacaaaggacatgaactcatcattatttatggctgcatagtattccatggtgtatatgtgccacattttcttaatccagtctatcattgttggatatttgggttggttccaagtctttgctattgtgaataatgcctcgataaacatacgtgtgaatgtgtctttatagcagcatgatttatagtcctttgggtacatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcactttttcatgtgttttttggctgcataaatgttttcttctgagaagcgtcttttcatctcctttgcccactttttgatgaggttgtttgtttttttcttgtaaatttgtttgagttcattgtagattctggatattagccctttgtcagatgagtaggttgtgaaaattttctcccattttgtaggttgcctgttcaatctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacctttaagtctttaatccatcttgaattgatttttgtataatgtgtaaggaagggacccagtttcagctttctccatatggctagccagttttcacagcaccatttattaaatagggaatcctttccccattgcttgtttttgtcaggtttgtcaaagatcagatagttgtagatatgcggtgttatttctgagggctctgttctgttccattgatctatatctctgttttactaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggcagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctggaagaggtccttcacatcccttgtaagttggattcctaggtattttattctctttgaagcaattgtgaatgggagttcactgatgatttggctctctgtttgtctgttgttggtgtataagaatgcttgtggtttttgtacattgattttgcatcctgagactttgctggagttgcttatcagcttaaggagattttgggctgagacgatggggttttctagatatacaatcatgtcgtctgcaaacagggacaatttgatttcctcttttcctaattgaataccctttatttccttctcctgcctaattgccctggccagaacttccaacactatgttgaatagaagtggtgaaagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaaggttgttgaactttgtcaaaggctttttctgcatctattgagataatgatgtggtttttgtctttggttctgtttatatgctggattacatttattcatttgcgtatattgaaccagccttgcatcccagggatgaagcccacttgatcatggtggataagctttttgatgttctgctggattcgttttgccagtattttattgaggatttttgcatcagtgttcatcaaggatattggtctaaaattctccttttttgttgtgtctctgcccggctttggtatcagaatgatgctggcctcataaaatgagttatggaggattccctctttttctgttgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggaccggtggtgatatcccctttatcattttttattgcatctatttgattcttctctctttttttctttattagtcttgctagcagtctatcaattttgttgatcctttcaaaaaaaccagctcctgggttcattaattttttgaagggttttttgtgtctctatttccttcagttctgctctgattttagttatttcttgccttctgctagtttttgaatgtgtttgctcttgcttttctagttcttttaattgtgatgttagggtgtcaattttcaatctttcctgctttctcttgtgggcatttagtgctataaatttccctctacacactgctttgaatgcatcccggagattctggtatgttgtgtctttgttctcgttggtttcaaagaacatctttatttctgccttcatttagttatgtacccagtagtcattcaggagcaggttgttcagtttccatgtagttgagcggtttagagtgagattcttaatcctgagttctagtttgattgcactgtggtctgagagatagtttgttataatttctgttcttttacatttgctgaggagagctttacttccaagtaggtggtcaattttggaataggtgtggtgtggtgctgaagaaaatgtatattctgttgatttagggtggagagttctgtagatgtctattaggtctgcttggtgcagagctgagttcaattcctgggtatccttgttaactttctgtctcattgatctgtctaatgttgacagtggggtgttaaagtctcccattattaatgtgtgggagtctaagtttctttgtaggtcactcagaacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggatcacaacccctgcctttttttattttccatttgcttggtagatcttcctccatccttttattttgagcctatgtgtgtctctgcatgtgagatggttttcccgaatacagcacacactcgactctttatccaatttgccagtctgtgtcttttaattggaccatttagtccatttacatttaaagttaatattgttatgtgtgaatttgatcctgtcattatgatgttagctggttattttgctcgttagttcatgcaatttcttcctagtctcgatggtctttacattttggcatgatttttcagcggctggtacccgttgttcctttccatgtttagcacttccttcaggagctcttttagggcaggcctggtggtgacaaaatctctcagcatttgcttgtctgtaaagtattttatttctcctttgcttatgaagcttagtttggctggatatgaaattctgggttgaaaattcttttcttgaagaatgttgaatattggcccccactctcttctggcttgtagagtttctgctgagagatccgctgttagtctgatgggcttccctttgagggtaatccgacctttctctctggctgcccttaacattttttccttcatttcaactttggtgaatctcacaattatgtgtcttggagttgctcttctcgaggagtatctttgtggcattttctgtatttcctgaatctgaaagttggcctgccttgctagatggggaaagttctcctgggtaatatcctgcagagtgttttccaacttggttccattctccccgtcagtttcaggtacaccaatcagacgtagatttggtcttttcacatagtcccatatttcttggaggctttgctcatttctttttattcttttttctctaaacttcccttctcgcttcatttcattcatttcattttccatcattgataccctttcttccagttgatcacatcggcccctgaggcttctgcattcttcacgtagttctcgagccttggttttcagctccatcacctcctttaagcacttctctgtattggttattctaattatacattcttctaaatttttttcgaagttttcaacttctttgcctttggtttgaatgtcctcctgcagctcagagtaatttgatcgtctgaagccttcttctctcagcttgtcaaagtcattctccatccagctttgttccgttgctggtgaggaactgcgttcctttggaggaggagagatgctctgctttttagagtttccagtttttctgttctgtttttttccccatctttgtggttttatctacttttggtctttgatgatggtgacgtacagatgggtttttggtgtggatgtcctttctgtttgttagttttccttctaacagacaggaccctcagctgcaggtctgttggaataccctgccgtgtgagatgtcagtgtgcccctgctggggggtgcctcctagttaggctgctcggggtcaggggtcagggacccacttgaggaggcagtctgcccgttctcagatctccagctacgtgctgggagaaccactgctctcttcaaagctgtcagacagggacatttaagtctgcagaggttactgctgtctttttgtttgtctgtgccctgcccccagaggtggagcctatagaggcaggcaggcctccttgagctgtggtgggctccaccgagttcaagcttcctggctgctttgtttagctaagcaagcctgggcaatggcgggcgcccgttgcccagccttgctgccgccttgcagtttgatctcacactgctgtgctagcaatcagcgagactctgtgggcgtaggaccctctgagccaggtgcgggatataatctcgtggtgcgccgttttttaagcaggtcagaaaagcgcagtattcgggtgggagtgacccgattttccaggtgcgtccgtcacccctttctttgactcagaaaaggaactccctgaccccttgtgcttcccaagtgaggcaatgcctcaccccgctttggctcacacacggtgcacgcacccactgacctgcgcccactgtctggcacttccaagtgagatgaacccagtacctcagatggaaatgcagaaatcacccatcttctgcgttgctcacgctgggtgctgtagaccggagttcaataaaatgttatttagaaaaccataagggagactggatttggcctgtggcctatagttttctgacccctcatagaggattgatggaaggtaaccatgtaaagaaaccaggagacaaaggaagatttgctgtagtcagctacagtttccttgtcacatgtccttggactagtatcaatttattataaggttttcacccatccatcgtgaaataaataaagttaggaatctcagttattcattttaaaatgttggcctttttttggtgttatgcctttttcatttgttttgttttaattttttttcatgtaagaaataacattaacagctgggttttttaaaaaaataaaagccactttgtaaatgtttatgttcccagtggcagtgggaatataaaatggaagcagaagagaggtatagtcaatatgatttagtgactgttgaatgagaaaatttaggggacagagagaaatcccagatgattcacaggtttccaggttgtacagtattatttaacctgaacatgaggaaggagtaggaaattttctggtgaatacagaagagcaaagaagagcagctcaagaggaatgactaattatttttctgtgcatgtttaatgggatattcatataggatttttgaatagatcattgaatatcagcatttatagctggcatcctactagtttgactctcagtaataagacttgtcaaagatccaagaatctgaaagttgatgataaatttccatgtgtatcaccatcaatgactgaaagtcagcatccacagaattgggagagatgaacttaatagataaagatgaattggagttgtgtttctcttagagaatgatactctccatgacttgtgtgagtcacagctgccagaaaacaaagaggccaaggaacatattaaagaagcacagcaaattcagtcctagagtgcctctgcttggcttcgtgttatagttctgacttctaaaaaatcactttttggcaaaatatactttgtgtttcttcccctcttgcaaactgcaaccaaacagaatcctttttagcaaggcatttttgtgttctttgaccaaagcaacatataaataacaaaaagaagtaagagaaagaacttttttttgtgtgtataggctagtatttaacataaacttgagagtgagtgccagtattatatttaggatttagggactagataggaaaactggatagaaatctaaagattgctgactcaaacacaatgtggtttctttgctttattttcacagctctgaattcacaactattagttatatttatatgcactataactttagaaagcaccttcccaaaccaaattttatgtgatttcttataatttagatgactttattatagaattgaatttccaactgttcataagaattattgagcatttgctgcatagtatcatctcagctgtgtccacatgagctacctatcaccttgtgttaatgaataatggttcaccaggaatattggttttggcatttaaagtgatctgtatttaatgcagataggaccagggaccactcttgaacattaatgtccaagcatcttaaaattacacagaatgctttcataatcagaattctgcctcactctccatctttagcccttttccccatgtgccctttctctggcattactgaactgcctgcaatgccctactcactcatccttctcttgtaggcaaatacattcactctttcacaccttactccctctcttgctgcttcctggcatactgccaacctttcctgccctctaccccttgtaatctggctagcctcaatatttaagtctctgcttggccatgatttctagaaaaccatccctgacatgctttattttcattctttttaaatcctaatgcctactatgtatgtagcaggactcagtaaaaaattgctgagtaaaataaagaatgtttatacaaaggtgatatgcaagactgtcccctacagtcttggagccgaggggacagacatgtggagcaataacgtacatttgagatggtaaagatgcagtagaaaaataagtaaagtattaaggcagcctcaaggaaggaggtacctgtttatctggggaaagacatgcagaatcaaggaagacttcacatagcattgttttaaaagatgaaaaaaattgtcagaatagtggagggaaacatttaaatattaggaagacattgtacactaataaaggtgtcagcagtgattttggaaatcatttacaaggcactattaggaagtggagaacagtatactgtgttaccttatatgtttctgccgtattttaatattgtgttcctggtggttttgttcatttacgttgggtggatgaatttgtgagtgaatgtttgacatgtttgtatgtcctcaatctggtggactctggtatctccccaagtggtttgttgaagttttggagaattattacttaagtaactatttcatgaaagattaagcttcatttaagcgctcaatttatgaaatgaaatgtcttaaatctatttttataaaaacaatagttttaaattgttctaagtggttcattttaaccaaatatatggatttcacttcagaacaagacttaaagctgacatcagaggaagagccacaaaggcttaaaggaagtgaaaatagtcagcatgaggcatgtaaaattttaaatttaaatttctggtttaatgttcttttctttgctttgataatagtagatagtccaaatgaaattacctttcagactaggctttgataatcaataaattttttaaaataattttttaatagattcttaaagtttattttaatagatttagtgaccttattaacagaagaatcaatagaatctaatttaatatttgatatttaacttaaagattataacccactataaaatttaaaatattcttatttaaaatattcttatctgccttcttgattggcttatagctaatctttccctttggaatagaggcaaaacaaatccagaactttatttgttcttttatttttacaacatccttacatgataaagaaagtaacatcaattattggatcatattatcaagcaattgaaattatgaacaatgtagcagtgatggtccctgagctggattcatggcaaaggagtaatcatggccagtgattgaaaatctgcggttttatattgccagtcagtgatgccaaggttaaagatgaattctacctgtggtctctcactgacctcagggtttctgttcagggagagaaccaggtcttaaaagcaacccaactgcctattacaataatcatatcttgcagaatgagacctttgttgttagtgtacaaacacagtaacattttaacatttcagttgcagaacatcagtacatattatttaaaaatttttatcctctgtcattagtacacattagaatatattagaactggacttaagccgatagtctagatacataacatgatcgtattatagtacataatttcaattaaaatgtaacaatttgcatttctttctgtttggtgttgattttggctcctaataatttaaagtgtgcctacactccagttagtaatcttttaaaaaaccacctaaatgcactgtaggggctcactacttaaggtatggtgaagtaaaatcttttcaagtgagaaaaaccctacaaattacctgctaattcattttggtagatttaacacataatgaattaagtttaatccaaacaaaaggtgacaaagttaagttttccagttcatgtttttcttctttctttggctaaggtgaatttttttatgttttagtcagaagccagtgatgtggcagtagctaaacatagaataaaatgttaattcttcattttagttatttaattattatttctttaattattttaacaggtaaattttaattttaattattttctaattttttattgtccatacttgattacttaagaataaaattattttaaaaacatgtactccaaaagagcagacatctgagaaacacaacaagcaaattaaccttctataattgcatctgcagaaagtgactcaagaaccagacataaataaggattgcgatagagaggtatacctttatattcaaatgtttccgttgaattagatttttacattatgttgtttaacaaagtataataagtttaggcatgtatgattctatcatgtaagtagcataaatcatcagtgaaaaatttagtatgtaactcagaaagctgagttgtgtacattaagttttaaagagagacaaaccctagaaatattcttcattattatggaataatcctgaatggtgccaaaaatgctacgtaatgctactttaggagctttggatcaatcattttatctttcttggtattagtctgattatcaatagataatatggctaaagaagataatttgttattctgtatatcctctagctagaaagttttatggccactgaatgtgaaatttggggagcgtctcatttactggaattccatgctagcacctcagcagttttattctgctttttgtgttgtgggaaactttggttcccatgtttcagtgagcactttcatgtttttgatatcccagcaaccatatgaaaaagcaatgatcacaggcagtgggggagaagaatattttagtgcaggaaagggaaatcttcctttctattcctggagcccgacagtgtctcatcctctaaatctgactgcttaatggaaaatccaggttgtaaagatggaagaagacacattttgcatctttgtgtttttatttgtgtgttcccacaagtcaaatggggtgaatatttatattagattctgaagagtggttgggaataaaagcacaaaatgaaattttgaaattttggaaattttgaaattttggaaaattgttctattcattcaaagagaaataaagcaaactttacaaaaattttaatgatatactaatgatgtaataattacatcttaaaattatatggtaacagttctgtatatatgatcaaatttaagtgtgaaatatttttaatgacaaattatgacaaactgagtcaaatgataaaatcaattaaaacaaaaaggtactttttattcaataaagcaataactgtccttaatatcaaacttccactcaaggttgaagaagaaatgcagaagcatggaagtaataatgtgggattatcagaaaacctgactgatggtgctgctgctggcaatggtgatggtggattagttccacaaagaaagagcagaaagcatgaaaatcagcaatttcctaacacagagattgaagagtatcacaggtaagcctatggcaacatttaacaggagataactatgtgctatcaaactaatccgaatttggactaatattcatgatgaaaaaattttatacttttcctaggatattcagccttgcctggtaatcagaagaatgaaaatcagcaaacaatgagttatattttttccagtcattaatttatttgaaaaataaccagtgttggcaaatgtgagggaaaaagcattttcttttctttttagtgaacttttattttagcttcaggggtacacgtgcaggtttgttacataggtaaactgtatcatggagattggggttacagattatttcatcagtcagataataagaatgatacccaataggtagttttttggtcctctccctcctgccatgctccaccctcaagtaggccgcagttgtctgttgttctcctctttgtgtccatgagttctcattgtttggttctgacaaatgagtgagaatatgtggcatttgattttctgttcctgcattagtttgcttaggataatgacctccagctccatctgtgttgctgcagaggaaatggactcactgaaaaggatattttcatacactgttggtaaatacattttgagtgttaatttagtagcatattcacacacacacatatataacagtaaggatataaaatatatgtatgttatggatatttgtatagatatattacatatatacttatgtataaggacatttattatagcataattatatcaaaaagttggagctagtccaaatccttatcaataggaaatagctcagaaaataatatagtatgcaatcagttttttaaaatgaagttagatctagagtgtactgattatttcacaattaacatgtatttaaagcatttagtttgctgacccatcttaagacaattttgttagaattcttgtagtatctgctgtgttgcaaatggaagctacatgctatgttgacactgtaccttgttagcaacaatatcgctagttattaaattatggttgtcagtgcctgagtgctgaaataattggaccctcaactgaacattgccaaaggattgcacatggggatctgtattttatgtaaatatttcagtatattggataaaacttgtttaaatacatcaaaggatctttgatctactaaaacaggaattggccagcttttttctgtaaagagccagttggtaaatattttaatctttgtggactatatgtacttatttttttgagacaggttctcactctgttgcccaggctggagtgcatttgcgtgatcatggctcactgcagcctcaactttctgggctctagtgatcctcccacctcagtctctctactagctgggaccacaggtgtgcaatatcacacccagatgattgactctatggactataaagtaaataagcatggctgtgtttcaagataccttacttaaaaaaacaggcagtgggctggagtgggcccacaagtgttaatttgctgacccttgtgctaaaaggaaggtgttgctaatgcagtgaatcttatttgtaagtgtcctgcatgcatgacattatccttcctttgaaaaaagaatatatttcagtattcacctcaccatagttttcaagtgacttcatataatttttatattgatgtaattcatgtaattatacttcataaaatttttaaaatttcatttataaaataagattattttctgcatttctcctattttattcctgttaataggactcagtattttactgtgatcaattactttgtatatgtgatgagtatcaactgtcctagatttcactgatttttatcaagcaagaaatactcctcttgaaacttttagtattccttggtctttatttttattcatttatttttattttattttattattattatactttaagttttagggtacatgtgcacaatgtgcaggttagttacatatgtatacatgtgccatgctggtgtgctgcacacattaactcatcatttagcattaggtatatctcctaatgctatccctctcccttccccccaccccacaacagtccccagagtgtgatgttccccttcctgtgtccatgtgttctcattgttcaattcccacctatgagtgagaatatgcagtgtttggctttttgttcttgcgatagtttactgagaatgatgatttccaatttcatccatgtccctacaaaggacatgaaatcatccttttttatggctgcatagtattccatggtgtatatgtgccacattttcttaatccagtccatcattgttggacatttgggttggtttcaagtctttgctattgtgaatagtgccgcaataaacatacgtgtgcatgtgtctttatagcagcatgatttataatcctttgtgtatatacccagtaatgggatggctgggtcaaatggtatttctagttctagatccctgaggaatcaccatactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgaacattttttcatgttttttggctgcataaatgtcttcttttgagaagtgtctgttcatgtcttttgcccactttttgatggggctgtttgtttttttcttgtaaatttgtttgagttcattgtagattgtggatattagccctttgtcagatgagtaggttgtgaaaattttctcccattttgtaggttgcctgttcactctgatggtagtttcttttgctgtgcaggagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatgtggctagccagttttcccagcaccatttattaaatagggaatcctttccctatttcttttttttgtcaggtttgtcaaagatcagacagttgtaggtatgcagcattatttctgagggctctgttctgttccattgatctatatctctgttttggtaccagtagcaggcttaggattgacttggcgatgcgggctcttttttggttccatatgaactttaaagtagttttttccaattctgtgaagaaagtcattggtagcttgatggggatggcattgaatctaaaaattaccttgggctgtatggccatttttatgatattgattcttcctacccatgagcatggaatgttcttccatttctttgtatcctcttctatttcattgagcagtggtttgtagctctcctcgaagagttcctttacgtcccttgtaagttggattcctaggtattttattctctttgaagcaattgtgaatgggagttcactcatgatttggctctctgtttgtctgttattggtgtatgagaatgcttgtgatttttgtacattgattttgtatcctgagactttgctgaagttgcttatcagcttaaggagattttgggctgagacaatggggttttctagatatacaaacatgtcatctgcaaacagggacaatttgacttcctcttttcctaattgagtaccctttatttccttctccggcctaattgccctggccagaacttccaacactatgttgaataggagtggtgagagagggcatccctgtctcgtgccagttttcagagggaatgcttccagtttttgcccattcatatgatatttgctgtgggtttttcatagatagctcttattattttgagatacatcctatcaatacctaatttattgggagtttttggcatgaagggttgttgaattttgtcaaaggccttttctgcatctattgagataatgatgtggtttttgtctttggttctgtttatatgctggattacatttattgatttgcgtgtattgaaccagccttgcatcccagggatgaagcccacttgagcatgttggataagctttttgatatgctgctggattcggtttgccagtattttgttgaggatttttgcatcaatgctcatcaaggatattggtctaaaattctctttttttgttgtgtctctgcccggctttggtatcaggatgatgctggcctcataaaatgagttatggaggattccctctttttctattgattggaataatttcagaaggaatggtaccagttcctccttgtacctctggtagaattcggctgtgaatccatctggtcctggacttttttttgttggtaagctgttgattagtgccacaaattcagagactgttattggtctattcagagattcaacttcttcctggtttagtgttgggaaggtatatgtgtcaaggaatttatccatttttctagattttctagtttatttgcgtagaggtgtttgtagtattctctgatggtagtttgtatttctgggggatcagtggtgatatcccctttatcattttttattgcatctatttgattcttctctcttttcttctttaatagtcttgttagcggtctatcaattttgttgatcctttcaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttaggttgtcaattttggatctttcctgctttctcttgtggaaattttgtgctataaatttccctctacacactgctttgaatgcgtcccagagattctggtatgttgtgtctttgttctcgttggtttcaaagaacatctttatttctgccttcatttctttatgtacccagtagtcattcagaagcaggttgttcagtttccatgtacttgagcggttttgagtgagtttcttaatcctgagttctggtttgattgcactgtggtctgacagacagtttgttataatttctgatcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcattgatctgtctaatattgacagtggggtgttaaagtctcccattattattgtgtgggagtctatgtctctttgtaggtcactcaggacttgctttatgaatctgggtgctcctgtattgggtgcatatatatttaggatagttagctcttcctgttgaattgatccctttaccattaagtaatggccttctttgtctcttttgatctttgttggtttaaagtctgttttatctgagactaggattgcaacccctgcttttttttgtttttcatttgcttggtagatcttcctccatccctttattttgagcttatgtgtgtctctgcacatgagatggttttcccgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattatttgatgcagtttcttcctagtctcgatggtctttacattttggcatgattttgcagcggctggtacccgttgttcctttccatgtgtagtgcttccttcaggagctcctttagggcaggcctggtggtgacaaaatctctcagcatttgcttgtctgtaaagtattttatttctcctttgcttatgaagcttattttggctggatatgaaattctgggttgaaaattcttttcttcaagaatgttgaatattggcccccactctcttctggcttgtagagtttctgctgagtctcatgggcttccctttgagggtaacccgacctttctctctggctgcccttaacatttttttcttcatttcaactttggtgaatctgacaattatgtgtcttggagttgctcttctcgaggagtatctttgtggcgttttctgtatttcctgaatgtgaatgttggcctgccttgctagatgggggaagttctcctgcataatatcctgcagagtgttttccaacttggttccattctccccgtcactttcaggtacaccaatcagacatagatttggtcttttcacatagtcccatatttcttggaggctttgttcatttctttttattcttttttctctaaacttcccttctcacttcatttcattcatttcattttccatcattgataccctttcttccagttgactgcatcggctcctgaggcttctgcattcttcaggtagttctcgagtcttggctttcagctccatcagctcctttaagtacttctctggattgattattctagttatccattcatgtaaatttttttcagagttttcaacttctttgcctttggtttgaatttcctcccatagcttggagtagtttgatcatctgaagacttcttctctcaactcgtcaaagtcattctccatccagctttgttccattgctgttaaggaactgtgttcctttagaggaggagaggtgttctgctttttagagtttccagtttttctgctctgttttttccccatgtttgtggttttatctccttttggtctttgatgatggtgatgtacagatgggtttttggtgtggatgtcctctctgtttgttagttttccttctaacagacaggaccctcagctgcaggtctgttggagtttgctagaggtccactccagaccctatttgtttgtgtatcagcagcggtggctgcagaacagcagatttttgtgaactgcgaatgctgctgtctgatagttcctctggaagttttgtctcagaggagtacccggccgtgtgaggtgtcagtctgcccctactggggggtgcctcccagttaggctgctcaggggtcggggtcagggacccacttgaggaggcagtctgcccgttgtcaaatctccagctgcatgctgggaggaccaatgctctcttcaaagctgtcagacaggtacatttaagtctgcagaggttactgctgtctttttgtttgtctgttccctgcccccagaggtggagcctacagaggcaggcaggcctccttgagctgtggtgggctccacgcagttcgagcttcctggctgctttgtttatgtaagcaagcctgggcaatggtgggtgcccttcccccagcctcactgccaccttgcagtttgatctcagactgctgtgctagcaatcagcgagactctgtgggtgtaggaccctccgagccaggtgggggagataatctcctggagcaccgttttttaagccccttggaaaagcgcagtattcgggtgggagtgacccgattttcttggtgtcgtctgtcacccctttctttgactaggaaaaggaactccttgaccccttttgcttcccaagtgaggcaatgcctcaccctgcttcggctcacacatgttgtgctgcacccactgtcctgcgcccagtgtctggcactctctagttagatgaacctggtaccgcagatggaaatgcagaaatcacccgtcttctgtgtcactcatgctgggagctgtagaccggcgctgttcctacttggccatcttggcctgggacccccttggtctttatttataagcatgaacaaaatgataatcagcttatataatccagaaatgttcacggggtcttttagttgtataatttttttattattatactttaagttctagggtacatgttcacaacatgcaggtttgttacatgggttatacatgtgccatgttggtttgctgcccacattaactcatcatttacattaggcatttctcctaaggctatccctccccctgggccccacactctgacaggccccagggtgtgatgttccccatggtgtgtccaaatgttctcattgttcaattcccacctgtgagtgagaacgtgcggtgtttggttttttgtccttgtgatagtttactgagaatgatggtttccagcttcatccatgtccctgcaaaggacatgaactcatcctttttcatggttgcatagtattccatggtgtacatgtgccacattttcttaattcagtctatcattgatggatatttggattggttccaagtctctgctattgtgagtagtgccccaataaacatatgtgtgcatgtgtctttatagcagcatgatttataatcctttggatatatacccagtaatgggatgactgagtcaaatggtatttctagttttagatccttgaggaatcaccacactgtcttcgacgtggttgaactagtttacactcccatccacagtataaaagtgttcctatttctccacatcctctccagcacctgttgttccctgacttttaaatgatcaccattctaactggtgtgagatggtatctcattgtggttttaatttgcatttctctgatgaccagtgatagcattttttcatgtgtctgttggctgcataaatgtcttcttttgagaagtgtctgttcatatccttcagccaattgttgatgtgattgttagtttttttcttgtaaatttgtttgagttctttgtagattcttgatattagccttttgtcagatgggtagattgcaaaaattttctcccattctgtaggttgcctgttcactctgatggtagtttcttttactgtgcagaagctcttcagtttaactagatcccatttttcaattttggcttttgttgccattgcttttggtgttttagtcatgaagttgttgcctatgcctacatcctgagtagtattgcctaggttttcttctacgatttttatagttttaggtctaacatttaagtctttaatcaattttgaattaatttttgtataaagtctaaggaagggatccagtttcagctttctacataagctagccagttttctcagcaccatttattaaatagggaatcctttccccgtttcttgtgtttttttttttttttttgagagggagtctcgatctatcacccaggctggagtgcagtggcgtgatctcggctcactgcaacctctgcctcctgggttcacatgactctcctgccttagcctcccaagtagctgggactacaggcgcttgccactacgcccggctaattttttgtattttttagtagagatggggtttcaccatgttagccaggatggtctcaatctcctgacctcgtgatctgcgcaacttggcctccgaaagtgctgggattacagacaagagccaccacacctggccccccatttcttgtttttgccaggtttgtcaaagatcagatagttgtagatgtgtggtattatttatgagggctctgttctgttccattggtctgtatctttgtttggtaccagtaccatgctgttttggttactgtagccttgtagtatagtttgaagttaggtagcatgatgcttccagctttgttcttttggctgaggattgacttggcaatgcaggctcttttttggttccatatgaactttaaagtagtttttccagttctgtgaagaaaatcattggtagcttggtggggatggcattgaatctataaattaccttgggcagtatggccattttcacgatattgattcttcctatccatgagcatggaatgttcttccatttgtttgtatcctcttttatttcattgagcagtggtttgtagttctcctcgaagagttcctttacgtcccttgtaagttggattcctaggtattttattctctttgaagcaattgtgaatgggagttcactcatgatttggttctccgtttgcctgttattggtgtataagaatgcttgtgatttttgcgcattgattttgtatcctgagactttgctgaagttgcttatcagcttaaggagattttgggctgagacgatggggttttctagacatacagtcatgtcatcttcaaacagggacaatttgactttctcttttcctaattgaatgccttttatttccttctcctgcctgattgccctggccagaacttccaacactacgttgaataggagtggtgagagagggcatccctgtcttgtgccagttttcaaagggaatgcttccagtttttgcccattcagtatgatattggctgtggatttgtcataaatagctcttattattttgaaatacatcctatcaatacctaatttattgagagtttttagcatgaagggctgttgaatgttgtcgaaggccctttctgcatctattgagttaatcatgtggtttttgtctttggttctgtttatatgctggattacatttattgatttgcatatgttgagccagccttgcatcccagggatgaagcccacttgagcatggtggataagctttttgatgtgttgctgcattcggtttgccagtattttattgaggattttgcatcgatgttcatcaaggatattggtctaaaattctctgtttttgttgtgtctgtggcaggctttggtatcaggatgatgctgacctcataaaatgagttagggaggattccctctttttctattgtttggaatagtttcagaaggaatggtgccagctccttcttgtacctctagtagaatttggctgtgaatctatctggtctttgactttttttggtttgaaagctattaattattgcctcaatttcagagcctattattggtctattcagagattcaacttcttcctggtttagacttgggagggtatatgtgtccaggaatttatcaatttcttctagattttctagtttacttgcatagagatgtttataatattctctgatggtagtttgtatttctgtgggatcggtggtgatatcccctttatcattttttattgcatctatttgattcttctctcttttcttctgtattattcttgcttgcagtctatcaattttgttgatcttttcaaaaaaccagctcctggattctttgattttttgaagggctttttatgtttctatctccttcagttctgctctgaccttagctatttcttgccttctgttagcttttgaatttgtttgctcttgcctctctagatcttttaattgtagtgttagggtgtcagttttagatctttcctgctttctcttgtgggtacttagtgctataaatttccctctatacactgctttaaatgtgtcccagatattttggtacatcatgtctttgttctcattggtttcaaagaatatctttatttcagccttcatttcattatttatccagtagttatttgggagcaggttgttcagtttccatgtagttaagtggttttgagtgagtttctttatcccgagtcctaatttgattgcactgtggtctgagagaccgtttgttgtgatttctgttcttttacatttgctgaggagtgctttacttacaactatgtggtcaattttggaaaaagtgcaatgtggtgctgagaatgtatattctgttgagttggggtggagagttctgtagatgtctattaggtctgcttggtgcagagctgagttcaagtcctagatatcctttttaaacttctgtcttgttgagctttctaatattgacagtggggtgttaaattctcccattattattgtgtgggattctaagtctctttgtaggcctttgaggacttggtttatgaatctgggtgctcctgtattgggtgtatatatatttaggatagttagctcttcttgttgaattgatccctttaccattaggtaatggccttctttgtctcttttgagctttgttgatttaaagtctgttttatcagagagtagaattgcaacctctgcttttttttcctttccatttgcttggtagatcttcctccatccctttattttgagcctatgtgtgtctctgaatgtgagatgggtctcctgaatagagcacactgatgggtcttgaatctttatccaatttgccagtctgtgtcttttaattggagcatttagcccattacatttaagattggtattgttttgtgtgaatttgattctgtcattatgatgttagctggttattttgcccgttagttgatgcagtttcttcctggcatctatgatctttacaatttggcatgtttttgcagtggctggtactggttgttactttccatgtttagtgcttcattcaggagctcttgtaaggcaggcctggtggtgacaaaatctctcagcatttgcttgcctgtaaagtgttttatttctccttcacttatgaagcttagtttggctggatatgaaattctgggttgaaaatttttttctttaagaatgttgataccttacatctacaaccatctgatctttgacaagcctggtaaaaacaagaaatggggaaaggattccctgtttaataagtggtgctggaaaaactggctatccatatgtagaaagctgaaactggatcccttctttacaccttatactaaaattacttcaagatggattaaagacttacatgttaaatctgaaactttaaaaaccccagaagaaaacctaggcaataccattcaggacataggcatggataaggacttcatgtttaaacaccaaaggcaatggcaacaaaaaccaaaattgacaaatgggatctaattaaactaaagagcttctgcacagcaaaagaaactaccatgagacttaacaggcaacctacagaatgggagaaaatttttgcaatccactcttttgacaaagggctaatattcagaatctacaaagaactcaaacaaatttacaagaaaaaaacaaccccatcaacaaatgggcaaaggatatgaacagacacttctcaaaagaagacatttatgcagcccacaaactcatgaaaaaatgctcatcatcactggccatcagagaaatgcaaatcaaaagcataatgtgataccacctcacaccagttagaatggtgatcattaaaaagtcaggaaacaacaggtgctggagaggatgtggagaaataggaacacttttacactgttgggagtgtaaactagttcaaccattgtgaaagacagtgtggcaattcctcaagggtctagaactagaaataccattggacccagccatcccattactgggtatatacccaaaggattataaatcatgctgctataaagacacatgcacacgtatgtttattgtagctctattcagaatagcaaagacttggaaccaacccaaatgtccatcaatgatagactggattaagaaaatgtggcacatatgcgccatggaatactatgcaaccattaaaaatgatgagttgatgtcctttgtagggacatggatgaagctggaaaccctcattctcagcaaactatcgcaaggacaaaaaaacagacaccgcatgttctcactcataggtgggaattgaacaatgagaacagttggacacaggaaggggaacatcatacactggggcgttttgtggagtggggggaggggggatagcattaggagatatacttaatgtaagtgatgagttaatgtgtgcagcacaccaacatggcacatgtatacatacataacaaacgtgcacgttgtgcacatgtgccctagaacttaaaaaaaatgttgaatattggcccccactctcttctggcttgtagagtctcccaagagatctgctgttagtctgatgggcttccctttgtgggtaacctgacctttctctctggttgcccttaacattttttccttcattttaaccttggtgaatttcacaattatgtgtcttggggttgctcttcttgaggagtagctttgtggtgttctctgtatttcccaaattttaatgttggcctgccttgctaggttggggaagttcccctggataatgtcctgaagagtattttcctagttggttccatccttccttgtcactttcaggtacaccaatcaaacgtagatttgttcttttcacatagtcccatatttcttggaggctttgttcatttctttttactcttttttctctaaacttgtcttcgttctttatttcattaatttgatcttcaatcactgataccctttcttccactttagcaaatcagctattgaagcttgtgctttcatcatgtagttctcatgccatggttttcagctccatcaggtcatttaaggtcttttctacattgtttattctagttagccattcatctaatcttttttcaaggttccttgcaatgggttcgaacatcttcttttagcttggaggtttgttattaccgaccttctgaagcctacttctgtcagctcatcaaagtcattctccagccagctttgttccgttgctggtgaagagctgcgatcctttggagggaagaggggctctggtttttagaattttcagattttctgctctggtttctccccatctttgtagttttatatacctttggcctttgatgtcggtggccagaaatggggttttggtgtggatgtccttttagttgatgttgatgttattcctttctgtttgttagttttccttctaacagtcaggtccctcagctgcaggtctgttggagtttgctggaggtccactccagagcttgtttgcctgcatatcaccagtggaggctcagttggaaatgcagaaatcacccatcttctgtgtcaatcatgctgggagctgcagatgggagctcttcctatttggccatcttggaacgtaatattttagttctataattttaagaatataataccttggtctggcatgtttaaatgccattttgtataatttttataacctttaaaatatacaattgttacttaaaatttgaaaactgcaccatttatataaaattataaactactatttcttatctatcactagtccatgactgtggaagaaaattacatcattcactgtcatgactcctaaatatgatgtccttaaaagaactgtctgcactcacaaactgaaattttctttccattcattcttgatcttatttcagtagtcttcaatttcagcactcctccaaagttgtttttctcaagattatcacaacttttattgtgtaataaatctaggcattttttcttacatctcattttatttaatttatcagcagtatttgacccagtggaggatatctccttcataacagcatcttcacttggttttcaagacctcactccctcaggctttttctcctgccttcgtagtccattcatcatggtctgtttttgttgctcctcctcatctttcaccttttgcacattgttgtttcccagggctcagtccctaatcttctttctcatgacttttttttttttttgaggtggagtctcactctgtcacccatgctagagtgcagtggtgaaacctcagctcattgcaacctgtcttgtgggttcaagcaattctgctgcttaaacctcctgagtagctggaattacaggcacctgccaccatgcctggctaatttttgtctttttagtagcagcatggtttctccatgttggccaggctgttctcaaactccggatctcagatgatctgcccacctcagcctcccaaagtgctgggattaaggtatgagccagcaccccagcccctcatgactttttctaatgtgtatatgctagtgatttccaaatgtatgtctctagctcagacctctcaccttaattccagatctctatatcaacctgcctacttgacatctctttttggttggctattgggcatcacacacttgccagatccaaaattgggctactggtgcccttcctgaaatcgacacctcatgcaatctttcctaatttggttagtggccactcttccagttgctctaccaaaaaccttggtgtcattcttgactcatctttctttctctcttatacctcacatccaatctatcagtaaatcttgtcaggtctactggaagaatatatccagaagccagtcatatcttttatatctgagccaccatcatctgtagtctagatgagtgtcatagactggtaatggatagtcctggtttttaaaaaatttcctttaaatctattcttaactcagtggcaaaacataagtcgaattgtgtcattcctctgccccaacccttctgattgccttccatttcactctgagtatgtgacaaaattcctcctaataactaaaaggcagtacaccatctagcatgttttctctcctgcttaaacttctattacttctctcctttgctctgcttcagccacactgaacttctcgctattccttatctatctctcttgctgaacgactccaggtacacctctatacttggcagttccttgtgttcttcagttctttacttaaaaatcccctttctcagcagggacctttctggccatcccaacttttccaccacccttcccctcaaacacataatcatttcattttcctgctttagtttttctcctctaacatactgtatattttgccttatctgtctattgttgtgtgtttatctcattctcatgaataggatttttattgttcactaccatatcctcagtgcctagaaaaaggcctagcatatcggatgtatctacctaacaaatactcgtgggtatattacatttgattgattctcacttaaaaaatgtttgacaaggttcactctaacaacttagcctggtaattatatgcataaattcttttggctctttataataagctacattcttaatattttttcatttagggagaaaatcccaatattgtggttattcaccatttattattttactggtaatcatgataattttaattatggtaaaatgcatcagaggaattgcaaactttactggtattttatctgaaaaatattagggtggtaaatttaatggacttacaaattctttccaacggattatgaaacttcagtatttgaaataaaaaaacagagttggaattttttgcttgctgtataagaggtgtactgatcaggcactgtctgctctgatggagcagctgctgctgcttggctgtctttcagaagcaagctgctcacattgatattggtgggcaagcaagggcagcggtcattgatcgattgactagatttagaacttgccctgggtggcttcttgttatcatggctacaggtcagttcttttctaagtttgtgctgtttaaaggttgccttccattaactattttcaaaatgaaactattttatattccagaattgcatacttaattttaaagttttttcaagatgaattggttaataatagctctcaggaagacctttttttttttttttttttgctacatagtcttgtcttaaccagaagagttctctgtataatttatttcttaaaaataatggttttgtttttgttttcagtgtttttagaagcttttgctcaagtcctaacataaactccaatgggagattttaatctctttgtcagttcatggatgtgtatgatagtgatattctctctttttaaattccttttcttgttcactttcttctttgtacaataatagtgatattcttgtgcatgtttacctcattaaaaagtaattacaattttctgctggcaaatccagctttttatattttgactaaataggaggctaaaagtgaagaacatttaccagattgttttattttcaaacaaaatcataactaatcaaaaattgctatttttgaaatataaataatgacatttagatattttaaaagtaaggatagcccccgatgtaggttggctttgtgtccccacccaaatctcatgtcaaattgtgattcccaggtgttgtgagaaagacctggtgggaggtgattagatcatagggttggtttcccccatgctgttctcatgatagtgaatgagttttcacaagagctgatggtttcttaaagggctctatccccttcacttctctctctcctgccaccttatgaagaaggtgtctgcttccccttcaccttaccatgattgtaagttttctgaggcctccccagccatgtgtaactgtgaatcaattaagcttctttcctttatgaattaccccatctcagatatttctttgtagcagtgtgaaaatggactaatacagagaattggtaccagggatagtggggtattgttaaaaagataatgtgaaaaggtggaagtgactttggaactgagtaacagaggttttaacagtttggagggctcaaaagaagacaggaagatgtgggaaagtttggaacttcctacagacttgttgaatagttttttttaccaaaatgctgatagtgatatggccaatgaagtccaggctgaggtgatcttaggtggagataaggaacttgttggggactggaacaaaggtgactcttgatatgctttagcaaagagactgacagcattttgcccctgcactagcaatctgtaaaactttgaacttgagagagatgatttaggctatctggtagaagaaatttctaagcagcaaggcattcaagaggtgacctggttgattctgaaagcattcagttttatgcattcacaaagagatggttttaagctggggcttatgtttaaaagggaagcagagcataaatttggaaaatttgtagcctgaccatttggtagaaaagagaaacaacacattttctatggacgaatgcaagttggctgcagaaatttgcataaataacgaggagcggaatgttaattgccatgaaatggagaaagtgtctttagggcatgacagagatcttcgtggcagccactcgcatcacaggcccagagtcctggaaggaaaaaatggtttcataggtttgggtccagggccctggtactgtgtgcagcctcaggacttgctgccctgcattcagccactacaggtccaactgtggctaaaagggaccaaggagaaacttagcctttatgaattacccagtcttcagtatttctttatagcagtgtgaaaatggactaatacaccctccctgaagacattttcctgatttcgtctttcatgttttatgtgccacagctacttttgaaattgtatttaaaggtaaacattattatattgaataatagaaacagaaatatagcccaaatctaattgtgattttcatgtttaacagtcatttctcatattcagtggactccagctttttaatatagcattcaagtgtagtgtagattcatctcctattcttagcttccaagtattttacacttttcctttcaagttcttagtaagcatctagacttcatgtgcttaatctttgtgctcacattctgttctctaactggaaggattttctctcactgtttttccctagtgggcccttcttatattttgcctcttctctaaagccttccttgtgctaaaatataactttttaatatatcaactcttacagaacacaatgtattataattgtatattaccttgtttttgaagcaggggatgcacatttccttttatgttgtttgtagttctaaacatttaaaaaattaatcagtgcaatgagatggaaaacagttggagttttacaaaaattgtggtttttttgttcattgtcaatagagttattaggaaacattggctttttatagagtttttaaagtagagcttttgccttgcatatgaagaaagaaacatgaaaataaaaaacggacctcaaaataatctgtgattacacccatatttgagaaggccaatttactaactcatggtctgcaacaagtaaatgatgatagcagtttaagtgaaatagatggtaaagaaggtaaaatttataagtcctttataagaaatatctgggaacaccccctcaaaaagtgggcaaaggatatgtgcagacacatctcaaaagaggacatttacgtggccaagaaacatgaagaaaagctcatcatcactgatcattagaaaaatgcacatcaaagccacaatgaggtaccatctcatgccagttagaatggtgatcattaaaaagtcaggaaacaacagatgctggtgagcctgtggagaaacaggaacacttttacactgttggtgggagtgtaaattggttcaaccattgtggaagacagtgtggtgattcctcaaggatctagaaccagaaataccatttgacccagcaatcccattagtgggtatatacccaaaggattataaatcatgctactataaagacacatgcacacgtaagtttattgcggtattatttacaatagcaaagacttgtaaccaacccaaatatccatcaatgatagactggataaaaaaagtgacaaatataatccatggaatactgttcagccataaaaaagaatgagttcatgtcctttgcagggacatggatgaagtgagaaactatcattctcagcaaactaacatgggaacagaaaaccaaacactgcatattctcactcacaagtgggagttggacaataagagcacatggacatagggaggggaacatcacacactggggcctgcctgggggtgagggagcaaggggagggagagcattaggacaaatacctagtgcatgcaggacttaaaacctagatgacaggttgataggtgaagcaaatgaccatggcacatgtatacctttgtaacaaacctgcacgttctgcacatgtatcccagaacttaaggttaaaaaaattttaaagtcaaaaaaaaaaaaaaaaagaaagaacaaaaaagaaagaaaagaaaataaatctctaggaaagaacgttaacaccaattacttttcctggaactagaataatatagtctcctcaaactggaaatactcaactgtatcagtgctgttgaaagattgattataataaggattagtgactttgactaggagaagtttcaacaaatgatagccatggaaatctgtagtggatgaatgtagacaactcttgagagaaaatttgctgggaaaggcaatatagaaatgggcaataattaaaaaagagtgtgggatttgagggagttttctctctttgtgtttcaaaacagaaatttttagagtttattttttactgttgggaatgatccataagagaagaacatggttatgaaaggtaattttgtttgcttggttgcatgtctaagcattagacagcttgattcattatcttttatggatttttagcaaactaattgcccttagaacttctattcatgtatagttttatgattagagttgttttttcagaattggttcagaagtgtaacatgttagtgtaactgtacatgccgatgatgacctaaaacttaaactgtcatacacagatttttaaaaagaattataataaacattcacacacttaggccatgctgaatagaatttaaatgttccttcataattgcacatcttgcactacctttgacagtagcatcatgaatagccatgatttgcttaggtacttactctaaaatatcaggtgtatcaactttatgattgtttagattctggggagtagggaaggattttgttcatgaagttgagaaaagcaaactattgacaatctattgcagattattacttcaggattataaactcctaaagcatcaaagccatattttcctgggccagcaatgttatcagcatatattgtatgctcaatgagtatttgttgaatgcatgaataaacagttgaagaaataaatgaatgacattgataaatttcttttaaaaactaatttttagttttttgaaagtagtaggtttccaaacttgcctctgtataaagtctttattttttaaaaaagtgcaggattcatgttctcactcataggtgggaattgaacaatgagaacacatggacacaggaaggggaatatcacataccagggactgttgtggggtggggggaggggggagggatagcattaggagatatacctaatgctaaatgatgagttaatgggtgcagcacaccaacatggcacatgtatacatatgtaacaaacctgcacgttatgcacatgtaccctaaacttaaagtatgtatatataaaaaaaagacactgcaattttcaaaaggtgaaaaaaaagtgcaggattcagaaattattagttatagccaaaaacagaatgataatcagaaatttttagttatagccaaaaacagaatgataatatggatttgtctgctatcatatctcttaaaaacacttgaatataaatattaccttcacagcatattgcaaaacacatgttttggagggagaattcttggatttcaatgctgtgtcaattactgaccagctctatgggctgggaaaatttatatggcctttctgggcctagtttctttctttatagaagccctaatattacctacctcaaagaattgttatgatgattaaaatgagcttgacacatgcacagtgcttagaatgatgcatagtgtctgcataataagtcctgaaaaagctaatattatcatttaaaaaagggttcccctcacataagaacataaataatgttttccaaataggtttcagtgccagtaaaagcttgtttttattgaaaaggacagcaatgagaagtcctggtatatgtctttctatcacataatatcagtaacatgtttttccttttgccttgactgtcagaaagcttgatctaaattcaattctttgtaatgatattattattatcatattttctttctcccttaatgttactctttctgtttatagtttaattccccatgtggaaaatagttatatttacattacctgttaaaaaatgacctgaacacttaatggatagaataaataacttataaatgccgagattttatataataaaataatagatttggacattatttgtattttatgtatttgtttgtctaagaagaattgtttcttttttcaggcctgaaaagaaatctaatgaaaagaacaaggtattgtaataagtaaattatctgaaacattattgttaaaaaaacacattataaaaggtaaagtgagaaccttttttaataaagacaattagttagaataaaagggcttaataacaagtacccattgataacggtacccttttaagaaaaatctgttgttttaagaagcacctgtggttttgctcatataaaaatatgaataaataccacttctgtacaactggtatattctatgaatattttgaggacatttgaggcagtattatttatcttacaggtcaaaagccaaatacattcagtggataaccttgatgacataacatggccatcagaaatagcgtcagaggattatgatttgcttttctctaattatgagacttttacattgctcattgaacaactcaaaatggattttaacggtaggaccattgcataagtagaaggccttttaatgtatcccacagtaatattcacacacattgcttagtattgcaccacagagcactgacgtgtgatagggatgatcatctcagaaacgtgtttgacattaaaatagactgagaaataatgtatattgtataccaaagagctatgataactccactgtacctttctcagtgtgaagggcagtctcagcctttttattgactctgcttctcccagatcgggttaccattctctcccactcagaatactgcagtaaccttagaactatttttcctgctaccccacttcctgagaccatggtctactctgaaactataattattaatttaaaaaaattcagatctgatgttgtctcttccttgtaactcagcataccacttgccattgctattaggttaagatctgaatattctagctctctcttgcatcatttaatacccttttttccctgccctagccattgtcttagatgtttattcctgcaatttatagctttagtgaggtataactgatatatgataggctgaatgtacgtaaaatatacgatttgataagttttggcatacgtatgcacatgtgaaaccatcaccataatcaagagcagtaacatgcccatcatccataaaaatctcttcctgtccgtttgtattctccttattaagaaactactaaatgtttaagtatttatactgtattccattcccatcagcagtatatgacaattctcattgtgcaatgtcatcatgagctcttagtattgctgtttattagtttttactgttagccattccaatgggtgcatattgtgcgtgtcactgtggtgtgaatatgcattgacctaaggactaagaatgttgaacatcttcccgtgtgctgatttgccacctgtatatcttctttagtgaactgtcttttccaatctggatagcttataaagatttaaaaattagatagtttttattcttatttgctgagttttaagagttttttaaaataaattctggatatcattccattattatgctttttcagaaagattttttcccagtttgtagcttgactttttgttttcttaataatatattttaaagagctgaagtttttcgttttgatgaaatgtgatatatctgttcgtttaattacagactttgctttttgtctcatgcctaaaaaaagtctttgtccagcacagggtcccagagatttttctcctctgctttcttgaagaatttttatagttttaggttttatatttagatctgtgatccacattgtgtacatttttgcatatgagtgaggtgtgatgtaagttcattgtatggatgtggatatctatctgttccagcagcatatgttgaaaatgctgtcttttctccatacattgctattgtccctttgtgaaaagtaagctggcatatgtgtgtgtgtctatttctggaccatttgttgtattccatcaatctgcgtattcttctagagttatactgatgaaccaatcataatttgaaaatcaatttaataccccaataaacccattgtacagttgaaaaattctaagtagaaccatcttaaactggagactatctctatctggctttcttcatgtaggtctagcatccctaatccaaaatccaaaatcagaaatgctgcaaaatccaaaactttttgagtgccaaaatgatgccacaagtagaaaatttcaaactagacatcaggtacacaaactttcatctgcaaatttactaaaagtgttccataaaattacctttaagccctgcatataaggtgcatgtaacataagtgtattttgtgtttagagttcgattccatttttgagatatctcattatatatgtgcaaatattccaaaacccaaaacacttttggtaccatgcacttgtagagatattccacccatatcacactgtttcattactgtaaatttatactaaatcttgacaccagcccttcagttttcttcttttttaagggttattttgattatgttggatcttttgcatttgcacttgagttttagaatcagattgttaatttttttttgtagttcaaatttaactttttaaaaaattttatcattattatactttaagttttagggtacatgtgcacaacgtgcacgtttgttacatatgtatacatgtgccatgttggtgtgctgcacccattaactcatcatttagcattaggtatatctcctaatgccatccctcccccctcccccaaccccacaacactccccggtgtgtgatgttccccaccctgtgaccaagtgttctcattgttcaattcccacctatgagtgagaacatgtggtgtttttttttttgtccttgcaatagtttgctgagaatgatggtttccagcttcatccatgtccctacaaaggacatgaactcatcctttttatggctgcatagtattccatggtgcatatgtgccacattttcttaatccagtctatcattgatggacatttcggttggttccaagtcattgatattgtgaatagtgctgcaataaacatacgtgtgcatgtgtcttcatagcagcatgatttataatcctttgggtatatacccagtaatgggatggctgggtcaaatggtatttccacttctagatctctaaggaatcgccacactgacttccacaatggttgaactagtttacaatcccatcaacagtgtaaaagtgttcctatttctccacatcctctccagcacctgttgtttcctgactttttaatgatcaccattctaactggtgtgagatggtatctcattgtggttttgatttgcgtttctctgatggccagtgatggtgagcatttcttcatgtgttttttggctgcatgaatgtcttcttttgagaagtgtctgttcatacccttcacccacattttgatggggttctttgtttttttcttgtaaatttgtttgagttcattgtagatagccctttgtcagatgagtaggttgcaaaaactctctcccattctgtatgttgcctgttaagtctgatggtagtttcttttgctgtgcagaagctctttagtttaattagatcccatttgtcaattttggcttttgttgccattgcttttggtgatttagacatgaagtccttgcccatgcctatgtcctgaatggtattgcctaggttttcttctagggtttttatggttttaggtctaacatgtaagtctctaatccatcttgaattaatttttgtataatgtgtaaggaagggatccagtttcagctttctacatatggctagccagttttcccagcaccatttattaaatagggactcctttccccattgcttgttttttgtcagatttgtcaaagatcagatagttgtagataatgcagtgttatttctgagggctctgttctgttccattgttctatatctgtgttttggtaccagtaccatgctgttttgtttactgtagccttgtagtatagtttgaagtcaggtagtgtgatgcctccagctttgttcttttggcttaggattgacttggcagtgtgggctcttttttggttccatatgaattttaaagtagtttttttccaattttgtgaagaaagtcattggtagcttgatggggatggcattgaatctatgaattgccttgggcagtatggccattttcacgatattaattcttcctacccatgggcatgaaatgttcttccatttctttgtatcctcttttatttcattgtgcagtggtttgtagttctccttgaagaggtacttcacgtcccttgtaagttgtattcctaggtattttattctctttgaagcaattgtgaatgggagttcactcatgatttggttctctgtttgtctgttattggtgtataagaatgcttgtgatttttgcacattgattttgtatcctgagagtttgctgaaattgcttatcagcttagggagattttgggctgagacgatggggttttctagatatacaatcatgtcatctgtaaagagggacagtttgacttcctctttccctaattgaatgccctttattaacttctcctgcctgattgccctggccagaacttccaacactgtgttgaataggagtggtgacagagggcatccctgtcttgtgccagttttcagagggaatgcttcctgtttttgcccattcagtatgatattggctgtgggtttgtcatagatagctcttattattttgagttatgtcccatcaatacctaatttattgagagtctttagcatgaagtgttattgaattttgtcaaaggccttttctgcatctattgagataatcatgtggtttttgtctttggttctgtttatatgctgtattacatttattgattttcatatgttgaactagccttgcatcccagggatgaagccgacttgatcatggtggataagctttttaatgtgttgctggattcagttggcggtattttattgaggatttttgcatcaatgtttatcaaggttattggtctaaaattctcttttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttagttggtaaactattaattattgcctcaatttcagagcctgttattggtctattcagagattcaactcttgctggtttagacttgggagggtgtatgtgttgaggaatttatccgtttcttctagattttctagtttatttgcatggaggtgtttatagtattctctgatggtagtttgtatttctgtgggatcggtggtgacattccctttgtcattttttattgtgtctacttgattcttctctcttttcttctttattagtcttgctagtggtctatcaatttttttgatcttttcaaaaaaccagctcctggattcgttgattttttgaagggtttttttgtgtctctatttccttcatttctgctctgatcttagttatttcttgccttctgttagcttttgaatgtgtttgctcttgcttctctagttctcttttattgtgatgttggggtgtcaattttagatctttcctgctttctcttgtgggcatgtagtgctgtaaatttccctccacacactgctttgaatgtgtcccagagattcttgtacgttgtgcctttgttctctctggtttcaaagaacatctttatttctgccttcatttcgttatgtactcagtagtcattcaggagcaggttgttgagtttccatgtattttagcagttttgagtgagtttcttaatcctgagttctactttgattgccctgtcatctgagagacagtttgttataatttctgttcttttacatttgctgaggagtgctttacttccaactgtgtggtcaattttggaataggtgtggtgtggtgatgaaaaaaatgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacctgcttcatgaatctgggtgctcttgtattggtggcatatatatttaagatagttggctcttcttgttgaattgatccctttaccattatgtaatggccttctttgtctcttttgatctttgttggtttaaagtctgttttatctgagactaggattgcaacccttgcctttttttgttttccatttgtttgttagatcttcctccatccctttattttgagcttatgtgtgtctctgcacgtgagatgggtttcctgaatacagcacactgatgggtcttgactctttatccaatttgccagtctgtgtcttttaattggaacatttagcccatttatatttaaggttaatattgttatgtgtgaatttgatcatgtcattatgatgttagctggttattttgctcattagttcatgctgtttctttctagccttgatagtctttacaatttggcatgtttttgcagtgtctggtactggttgttcctttccatgtttagtgcttccatcaggagctcttttagggctggcctggtggtgacaaaatctctcagcatttgcttgtctgtaaagtattttatttctcctttgcttatgaagcttagtttggctggatatgaaattctgggttgaaaattctttctttaagaatgttgaatattggcccccactgtcttgtggcttgtagagtttctgctgagagatcagctgttagtctaatgggcttccctttgttgttaatccgacctttctctctggctgctcttaacattttttccttcatttcagttttggtgaatctgacaattatgtgtcttggagtttctcttctccaggagtatctttgtggcattctctgtatttcctgaatttgaatgttggcctgccatgctagattggggaagttctcctggataatatcccgcagagtgttttccaacttggttccattcttcccatcactttcaggtacaccaatcagatgtagttttggtcttttcacatagtcccatatttcttgaaggctttgttcatttctttttattcttttttctctgaacttctcttctcactcatttcattcattttgtcttccattgctgataccctttctgccagttgatcgcatcagctactgaggcttgtgcatttgtcacatagttctcataccttgggtttcagctccgtcaggtcctttaaggacttctcttcactggttattctagttagccattcatctaattgtttttcaagatttttaacttctttgccattggttccaacttcctcctttagctcagaatagtttgatcttctgaagcgttcttctctcaactcatcaaagtcattctccgtccagctttgttccattagctagtgaggagctgtgttcctctggaagaggagaggacctctgatttttagagtttccagtttttctgctctgttttttccccatctttgtggttttatctacctttggtctttgatgatggtgacatacagatggggttttggtgtggatgtcctttctgtttgttagttttccttctaacagttaggacccccagctgcaggtctgttggagtttactggaggtccactccagaccctctttgcctgggtatcagcagcagtggctgcagaacagcggatattggtgaacagcaaatgctgctgcctgatcgttcctctggaagttttgtctcagaggagtacccagccatttgaggtgtcagtctgcccctactgttgggtgcctcccagttaggctactcagcagtcagggacccacttgaggaggcagtctgtccattctcagatctcaagctgtgtgctgggagaaccactattctcttcaaagctgtcagacacggacttttaagtctgcagaggttactgctgcctcttgttagtctgtgccctgcccccagaggtggagcctacagaggcaggcaggcctgcttgagctgtggtgggctcctccgagttagaacttcctggcagctttgtttacctactgaagcctgagcaattgtgggtgcccctcccccagcctcactgctgccttgcagtttgatctcagactgctgtgctagcaatgagtgaggctccgtgggcataggaccctctcagccaggtgtggggtataatctcctgatgtgccatttgttaagcccattggaaatgcaaagtattagggtgggagtgacctgattttccaggtgccatctgtcacccctttctttcactaggaaagggaattccctgaccccttgtgcttcctggtgaggtgatgcctcaccctgctttgcctcatgcatggtgtgctgcacccactgtccagcactcctctgtgggatgaacccagtacctcagttggaaatgcagaaatcacccatcttctgcatgtctcacgttgggagctgtatactggagctgttcctatttggccatcttggctccacccctctcccagatagttaattttttaaaaacctgctgtgctggaaattacactgagttagtgatgaatctatacattaattgggggaagatttacattttaatgagaatgcattttttgactcctgtgaaatggtttctatttatataggtcaaatttaattttctcagtaatattttatagattttaaaatatggctttcctttctttttgagacagtttcactccaggctggattgcggtgcctcgatcttggcctactgcaacctctgcctcctgggttcaaatgattctcctgcctcagcctcctaagtaactgggattataggcatgagccactgcacccagctaagttttgtatttttagtagagatggggtttcaccattttgtccagagtggtcttaaattcctgaactcaagtaatcctcccggcttggcttcccaaaatgctgggattacaggcatgagccactgtgcccagccttggtgtttccttattttatcagattcatctgtatctcattttttaatgaagttataaatgacatttaaaaaaatttcaagttgattgtttactgctaggatataggaatacagctgatttttgtatgttgatttttgtatcctccctccttgctaaacttagacttacttattagttctagtagcttttttggtagatttgatcagattttatacatacaacaaagattatcaaatcttttcattctcaaactactttcttactatggataggaagtcttttagacttgtggcaaagcagtctctgttgcagctagtcaactctgccattgtagtatgagagcagtcagggaagttacctacattaataaactcagctgtgttccaataaaactttatttacaaaagccagaagctggcccagaggctgtagtttatctgcccctattatgtgatcatggttgtgaataaagacagttttacttcttctttccaacctggataacttttatttatttttcttgtctgacagcactggctagaatcttcagcacaatgcttactaaagtgttgaaagcaggcattattgtgtcattcctgatacggggaaagcattcagtttgtcatcatgatacacattaactgtaggtttattatagatgctttgtatcatgctgatgaagttcatttgtattcttaggttgctgagtttttttttctttttaaatcaagaatgaagttgaattttatcaaatgtctttatttactgagataatcataaggttcttctcttttagtgttttaatggggtgaataactgatattttaatgttaaaccaacctttcattttagaataaaacttattttcttaggatgtaggcttttaaaaagtatatcattggggccggacacggtggctcatgcttgtaattttagtactttgggaggtcaaggcaggaggattgcttgaagctggagttcgagaccaacctgggcaaaaaaatgagaccctatatttatttgtattcagtttgccaaaattctgtttagaaaattttaaaagactatgtaaatgtagttttaggttcacagcaacattgaaagtatggtacagagattgtctgtgcttcctgtccacagacatgcatagcttcccccattatcagtatctctcactatagtggtacagttgatatgattgatgaaccaaaattgcatgtcataatcatccagatttcatagtttatattagtgtgcactcttggtgttgtacattctgtaggtttggaaaggactgatattcatcattatagtattgtacaaagtaattttactgctctaaaatttatttatgtttcacctatctgccctttcatgccctcctcaaccacaggtaaccactgatctttttactgtatccatagttttgccctttctacaatgtcatatagctgaaatcatacagtgcatagccttcagattggcatctttcacttagtaatatgcgtttatgtttccatcatgtcttctcatgacctgatagctcgtttctgtttagaactgaataatggttcattgtgtaactgtaccagaggttgttcactcacctattgcaaggtatcttggttgcttcagaaatttgtgaaatattttgtcaatgttcatgagggagttttcttttttgtaatatcattgtttggttcagggtaatgctagcattatagaatgagttgtgttgtatttctcctctttattatttgggagagaggttgtgtaaaattatattacatctgcctaaactgtttgatagaattcactagcatagctatctgggcctggagttttctcaactttattttctttcatagatatagggtgatttggattatctatttcttcttgattgagctttggtaatttttattttttaaggaacgtgcccacttaatctaagtggtaatggttagttacataaagcttgcactattatcttgctattcttttaatatctgtagaatgtataaaaatgttacattaattatctctgaagttagtaatttattctcttttttatgatcagcctggctaggtcaaggtttatcacttccactgatgacctcaaagtatttggttttattgattttccctattgttctcctgtttcatctttgatgtcatcatcggtttggcctgctctcacaaaataccatagacttggtagcttataaacaacagaaactgatttcatacattcctaaaggctgcaaagtccaagatcaaggtgccagaagattcagtgtctggtgagggacaaattcctgatttctatattcctttatttcccctgtgtgcttcatatggcagaaggggtgaatgagctttctggggtctcttatataagaagggcactaatcccattcattagggcttggattccatgagctatcacctccacaaagctgcagtatctaataacatcacctctgtgattaagtttcagcatatgagttttgggaggacaaaaatgttcacactatgttctgatgtttattattttctctgcttctgttgggtttaatttgctctctttttttgtagtttcttcttttttacttacttttcgtttgtttgcttgtttttgagacagagtctcattctgtcatctagcctggagtgcagtggtgtgatttcagctcactgcaacctctgcctctggattcaagcaattctcatgcctcagcctcctaagtagctaggactacaggtgtgcaccactgcacccagctaatttttgtatttttagtagagatggggtttcaccatattggccagggtggactcgaactcctgacttcatgacccatccacctaggccaccgaaagtgctgggattataggcatgagccactgtgtccagaccttttttactttcttaagatagaagtcaaggctattgatctgaatgtcttccagtatagacattccgtgctaacttttcatttaggaactgttgtagctatattccacaaagtctaacatgtagtattttcatttttattcagttcaaaatagtttccaatttctctttgtgtcaccactttgcctaggattatttagatatgtgttactttgtttccaaatttttgagtattttgatgagctattttgttactgatttctaattttattcttttgtggtcagggaccatactttgtatgacttaaatacttttgacttaatactttcatgaagatttattgtatggcctagaatgtggtctgttttgctaagtgttccaagggcacttgagaagcatagtgttcttcaagtctactcttgtcttgctgattttctgcctccttgttttatcatgtattcagtacgcaatattgaaatctcacactatacctgtgaatttgtcaatttcttctatcagtttttagctcatatttcgaagccgttatgttaccaggtacataaacatttaagattatgtgttcttgaataactaaatattttatcattctgaaatgatgttgtttataactagtaatattttttgttgtgaaatctactttagtattaatataatgattcctgattagatttcttttgtcatctgtttgcatgggatatatttttcttccttttaaccaatttgtgtctttatatttaaagtgtgtttcttataggtagcatggagtaggatcttgctttttatacagtttgacaatttgtcttttaatttaggttattagacccatttcatttataatgtgattattgatatattaatatttaagtttatctgtcatcgcgctgtttgattttcattagtcccagctattctttgttcccttctttttctaatttcctttcaattagttatgtaacttttatggtttagttttatctctcattttttggcttattggctctatttttttttttgctatcttaatggttgcattacaatttgtactgtatgattttaacttatcacagttcactttcagacaatattatatcatatcacatatggcataagaaaatcagaatagtatgctttcatttcctctctcccagccagattcttcctggatttgtggaattatggttttcattaagtttagaaagtttctgttcattttctctttatgttttgtcattgtctctccctccctctttggggacaggtatattattgcttaaagtttttgcataattctctgatgtcccaaatttatgaatcttctcttttgtggtatctagtctgtatttacttctaccagtgtcctttccgtcatgactttgtttttgtttgtttgtttgtttgttttttgaaacaaagtctgactccattgcccaggccggagagcaatggctcgatcacctctcactgcatcctctgcctcctgggttcaagccattctcctgcctcagcctcccgagtagctggggttacaggtgcctgccatgatgcccagctaatttctttgtacttttagtagagatgggatttcaccatgttggccaggctggtctcgaactcctgacctcaagtgatccacctgccttggcctcccaaaatgctgggattacaggcatgagccaccataactggcccagtcctgacattttaatttgaattcctactagtgtaattttctttcaagaaatatcttccatgtctctacttgagatttatttggggacacagttgacttataaacaacttgatctttctggtcttgttttttgatttggtctaattttccactcctgaatcaaggtgtttctgataactctattctttgccctgtgaagtcttgagttttttcagcatcattcagacgaatggacactcttcctggtacactgtgagcaacaggcactgtttcttacaattttttaaggattttttccccctggtctcaagtagtttcctaggacaaatatactgttcattattctgctaaataaatacccaatgagattctcagcttcattgttcgaactcagagaatctggggctctacctcagtttttggtagactctacctcagttttttttccttcaattgtcatggcctggaaactttgccaagtcagggggctggggtgtttgtaaggcttatttctcttgtttcctatcttacagggttcattgtcttcattacctgaaatccttgttcttgaaaatcgtggtattatgtattttgtcttttttggttttgttttaagtgagaaggtaaatcagtatctgctgctccatcgtggccagaagcagactgcagcagagcttcagtacatgacatagactagctagaatgcttttctaccccctttacttaacagcttccttctcacccttcatttctcagtgtagcccgctcttccccaggggaatcttcctgagcccagtatagatcaaatcctgtgtgatcatagaactgttttcttgcagcatctatctgaatttgtaatttcacttctttgtattttttcttcactacacctaaagctaaacaagagcagagttactgtttgttttatctgcagagctcagtagactgtgttcgccatggtaggaactcagtgcatatttgtttggtgtatggatgggtgaaggttaaaatgcacgggactttatatccaaaaactactcttatattttatttccaccttgtttccccccgatgcagattctgctagcctatcaaaaatccaggatgcagttatttcagaagaacacttactagaactcaaaaatagccactatgagcaacttacagtagaagttgaacaaatggaaaatatggttcatgtactacaaaaatagctatctgaggcaaaagaaacacaattacagttagctcctcagaaaggtgaatgtgagcaagaacgctacagttcgaggtatgacattctagttttagagaaatattttaactctttattctaaatatatatgtgagaattgtgattgctgactttctggggcttaatgggagaaaacgtcttggtcttatggagtctgaaaatcttggaaataatacaacaaattcttaactgtgcttcttttatttattgcatatgcttttaaattgtgattttaatggctatttagaagtttaccatatagaaatctcattatttaacaaacagaatttggggtttttgattcttttgtattagaattaatgctgcaagaaatactttttattattactattatcattattattatgattattattattagaattttgctctgtcactgaggctgcagtgcactggtgcaaacatagcttactacaactttgaacttttggggtcaagggatcctcttgcctcaaattcctaagcagctcagactgtaggcacatgctcccatgcctggctaacttttgaaatttttcattgagacaaggtctcactatcttgcccagtctgatctccaactcctgacctccaacagtcctcctgccttggcctcccaaagcattgggattacaggagtgagccatcacgcccagcccagaatatcttttatataaatcattttctgcatttctaattatttactttgtataaagtcttcaatatagaattttttggttaaaatatagaaactttttcaaaaaggccttggatcaatatttctaaattgtcctcaagaatatttgtattgaatgcatgctgagcttaatacctaggtgatgggttgataggtgcagcaaaccactgtggcacatgtttacctatgtaacaagcctgcacattctgcccatgtactctggaaattaaaattaaaattaaaaaaagaatatttgtattaatttacagttcaaccaacagagcatgaaatggccatttgtctcaaaccagaatactttttaaaaactttatacagttttattctttttttaactctctgtttaaattgatttatttttatttcaatagctttaggggtacaagtggtttttggttacatggatcaattttatagtggtgaagtctgggattttagtgtacccatcacccagtaggtagttttattgctcacttttcttctccccttccttcttctgagtctccaatgtcattataccactctacctgcctttacataacctagcatagctcccacttataaatgagaacatgtggtatttgtcgttccattcctgagttacttcacttagaataatggcctctagctccatccaatttgctggaaaaaacattatttcattcttctttatggctgagtagtattctgtggtgtgtgtgtgtgtgtgtgtgtatatatacgtatctatacatgtatgtatatgtagatgtatgtatataagtatatatatacacacatagatatatggactcacacacatatatgtgtatatatatcacattttctttatgccattcatcagtcaatggacactggttgattccatatattttcatgttgtaattgtgctgcagcaaacatatgtatgaaggtgtttttttgagagtacgatttcttttgtagatatccagaaatgagaatgctgggtacaatggtaggatctacttttagttctttgagagtctccacagattttgtactaacttgcattcccatcagcagtgtataactgttctcttttcaccacatccacaccaacgtctgttgtcttttgatttttaatagtggccattatggctgcagtgaggtgatatctcattgttgttttagtttacatttccctgatgattagtgatatttagtatgtttttatatgcttgttcagcatttgctcatcctcttttgagaaatgtctattcatgtcatgtgcacactttttaatggaatcatttgtatttttcctgctgatctgtttgagattcttgtaggttatggatattagtctttgacagattcataatttgcaaatatttttcccattctataggttgttggtttactcttatgattatcaatttgcggtgctgaagctgaagctttttagtttaattaggtcttatttatttattttcatttttgttgcatttgcttttagggtcttcatcataaattcttcacctaggtcaatgttttcaggtcttagttttaggcctttaatccatcttgaattaatttttgtatatgataagagatagagatccagtttcattcttctacatgtggctatctttttttcctagcgccatttattgaataatgtgtactttctccagtgtatgtttttgtatcctttctcagagatcatttggttgtaagtggctttatttctgaattgtctattctgtttcattgatctatgtatctacttttataccagtatggtgctgtttttgttactgtggctttagagcataatatgaagtcagataatgcgacgccaacatgtttgttccttttgcttggtacatctgttgttattcaggctcttttatggttctacataaatgtcaactttttttataattctgtgaagaatgacattggtactttcataggaattgtatcaaatctgtagactgctttgggtactatggtcatttttcacaatatcagttctttcagtccatgaacataggatgtattttcatttgtctgtgtcatctattattttcttcggtagtgttttccagttatccttatatagatcactcacctccttcattaagtatattcctaggtattttacacttttgcagccattgtaaaagagattgggttcttgatatgactctcagcttggttgtatttggtgtatagttgtgccactgattggtattcatttattttgtaacctctgagactttactgaatttatttatcaaatctaggagtgttttgtaagagtctttggggttttctaggtataagatcatatcattggtgaagagatagcttgacttcctcttttaaatttggatgccctttatttctcttgcccaattgctctgcctgggacttcccagttttattcttaatatgcatgaaataaaagtaaaatggaaaatgattcacgattagtttatttcacatctctgtctcataaacagataaaattaattcaccttgaattaattttgttatatgttaaatacatatattatatgtataataaaaacatgtaatatattatatgtataataaaaacatatatgttaaaaacaaaatattagaccctgtcttgttcaaaagaatgtctaagttgcttataaaatacataggaattaagaatataagttaaaaatgtttccaaaaaataaacatgaaaattatgggttaacacaggggttcccaatccccaggccaaggaccagtaccagtccctggtctgttagaaactgggccacacagcaggaggttagtggcaggtgagcaagtgaagcttcatctgtttgcagtccctctccatcactcacattaccgcctgagctcctcctcctgtcagatcagtggtggcactagattgtcataggagtgtgacctgaaccctgttgtaagttgctcatgcaggggatctaggttgttcactccttatgagaatctaatgccttatgatctgtcaccatctcctgtcacccccagatgagaccatacagtagcaggaaaacaagctcagggcccccagtgattcttctacattatggtgagttatagaattatttcattattaataatagtagaaataaagtgcagaataaatgtaatgtgcttgaataatcctggaagcatccccccacctcaggtctgtggaaaaattaccttccacaaaaccagtccctggtgccaacatggttggggacagctggcttaacagatgtgagacccctttgccttttcttggattaatctgcaagatatacattgtgtgaatgatatctgatgatgacaccttggcctgtaaatcattttagggataccttcagtatctcatgaaaattaaaatttcttctagtgaagaacaaaatgatacccggaagcaactttccaaggaacagaatgctagaatattacaagatgagattctgactactaaacagaagcagatagaagtggccgaaaaaaaaatgaattttgaggtattttctttagtcattttcaaatgcttttatataaaatgtatgtatttaaaaaaacaactatatatttcagaaagtataaaggatttttaaatcacatatatatgtatatatgtatatatcatttatcatgtgtctatatatgtacatataggataaagccatgttcttaattcaactccatttgcctgcaacagttgagtagtgacattcacaatggcctaaatccaaagaagcatttgatattttccataagaattgatgatctttccaatatcaaaaataagttttgctaacaacagattttccagtttttggacattagttcatcttttaaaaatattaatagagaagtcagtttattattttcactgctaagaaagtaggaaatgtatagttgggtcagaggccatattgtggatatcattatccttacttttgaggacagtaacagtttgctccaagtagtttctcatttcaatgcaaagagctttgaaaacaatgacatgcatgatatacattgagtgataatttattgataagtattttgttcccagagaaagagttcagtatattttcctctatttcacacttattactgtttcaaacattataaagaagaaataagttattgcaatggcaaataatctcatgatttctaagaaaagctctataagttgtatgctaccattcatattttgaaataaaaggcttcttttgtatttatatatttacaccacagaagtaactgtgattttgtggaggatcactagaagtagcatcagaagacctggagaaaatcctgcatcttgtgtatatacatatgtgtatatttgaatatatatgtatatattcaaaaatatgtatatatttttgagatggagtctcgcactgttgcctgggctggagtgcaatggcacgatcttgactcactgcaacctttgcctccctggttcactcgattctcctgcctcagactcccaagtagcttggattacaggtgcacaacaccatacctggctaattttttgtatttttagtagagacagggtttcactatgttggccaggctggtctcaaactcctgaccttgtgatctgcctgccttggcctcccaaagtgctggtattataggtgttagccactgcaatcagctgcatatatatttttttaacttcttttaagaattgtgatcttaaatgagttcagtgtcgtacatagaggtgcaatgtttagatgcagatgtgtacaatgtagaagggtacaatgtttagatttaacagttatgaataagtgtaattctcataactgactataacatattagaaaagtagaatattgataaaacattcttgagaaaaagtaacttaaagaattttgagaaattgcttctgccctaacatatgtatagctaaggctcctacaatgttatggtttataggtgagatatcagagtgtaaacccaatttaaaaaatatagtcaaatgtattaatcttatattttatgcctctgggttttttgtaattcagagaaatgcatttacaattctgagtttcttaaaaatcctccagtgatttaattttcataatctttaaataaatatttagatttgtggagtttacactctattaggtttgaagttttgtccaacttgtttttaggtaaatatccactatgggaattctttcattatacaaacatacaggttactttttaatttcagaagaaattatgatatgtccctctattgagtgctaactaaaatttccctttgtttactcagatttctcttagccataaggaagaaaaagaactcttgcatgaaaatagcatgatgcaggaagaaattgccatgctaagaatagaactagacacaataaaacatcagaaccagctaagggaaaagaaatatctggagtacattaaaagtgtgaaagaaaagaatgataatcttctaaaggctatacaattgaatgaggaagcactaacaaaagcagtagttcagtacagtggacagc

SEQ ID NO: 1538 - DNA, 70744 bp, Homo sapiens; identical to SEQ ID NO: 1537

SEQ ID NO: 1539 - DNA, 128829 bp, Homo sapiens
attttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggtaatgtgcattttctccttgtaactgaggagtgcagagttcaggtggggtccacacccttcccaacctgtgcccaccttgatcaagctgtttgctgatgccaaagcttcaagggtggctatgcacaaaaggagaagacacgagccttctcagaagtttccttccttccttccttccttccttccttccttccttccatccttccttccttctttccttccttccttccttccttccttccttccttccttccttccttccttccttccttccttccttccttccttccttccctcctttcaaaatcattccttgaggctgggcacagtggctcatgcctgtaatcccagcactttgggaggccaaggcaggcagatcacttgaggtcgggagtttaagactagcctggccaacatggtgaaactccgtttctactaaaaatacaaaaattcaccaggcatgcaggcgtgtgcctgtaatcccagctgcttggaaggctgaggcgggagaatctcttgaacccaggaagtggaggttgcagtgagctgagatcacgtcactgcactccagcctgggtgacagggcgagaccttgtctcaaaaaaggaaaaaaggaaagaaatcattccttgtgcatctactgcatgcacagggctcgatgccatgaaactgactttctagaagacctcagcctagttggggaagatgaccttgtgtttagttataatttaagctgaatgagccaaggctggcaagagccacaagtgatgatggtagtctagagggaggggcagttctctctgcctcctgaagagacattgattcattcattcttttttttttttttttttttttttgagacagggtcttactctgtcactctgttagctgagtgtactggtaggatcatagctcactacaacctcaaactcccgggctcaagcaatcctcccacctcagtgcactcctgggtagctgggactacaggtgtgcaccaccacacctagctaatttttaaattttttatagaaatgggaatctcaccatattgcccaggctggtctccaactcctggactcaagcgatcctcggtctcccaaagtgctgggattacaggcatgagccaccacacccagcccattcattcattcattcattcagcaggtaactgacaactgaaaaaccagccttcccccagtgatgcctgaaaagcagaaactcaaacactctaaaggtctccatcaatttgattgttggaaatgaatgcctgtaggttcataacaggtgggactatcccagcggctgcagtcagtggctttgttgttgatgttgttgttatccaccttctcctctgccatccccaaattacaaatggaatacagcacttccaggtagaaaatttgggaaatataggagaacagagagaagaaaagagccaccaaccaaaacttcaccagccagagggaaacctctgttctcattgttctacttcttccttctagtgtgtttttctcctctggagtgaagttttactggctattcttttaagcatctcctgtactctctcccaaattagaaaaatctagaggtggtcttccatacatgtccatgttagcagtgagcttggttttaaccctggtagctggaagtagaagacagagaaaaaggaggaggaaagtattccatatactgaaacttttcaggggaagagtgtttgagtttctagaagggttaagggaagagaaagtctcagaatctagtacaaagagcacagtctgtggagtcagctggagtggggttcagtctttggctctgccaccccctactgtgtgaccttgggcatgacccttcacctctccaggccccagtacctctgtaaaatgtggaagggattaaatgggataatgtaggcaggcatggtggctcacacctgtaattccagcactttgggaggatgaggcaggaggatcgcttgaggccaggagttcaagaccagcctgggcaatatagtgagacctcatctctaaaaaaaaaattaagaatttgccagacattgtggtgcatacctatagttctagctacttgagaggctgaagcaggagggtcacttgagcccagaagtttgtggttatagtgagctataattgtgccactgcactccagcctgggcaacagagcaagactctgtctcaaaataaaaaaacaaaaaagaatgtatcaaaccaacaaacttataacatgattattattattactatttcctgagtcttggatgccaaaatagtcgtgaagattaaatgaactaatatttctcaggtacttggcaagagaataaagcatccatatttggtagataataaatagaaaggggggcaagtctcccacctttccacccactgtcttcctgccaccattttgaggggtctttactggtttgagcttaaaccaaggtttttctgagctggtacatttataaaggcgaaaactatctctctctttctctttctttcttctttttttatttttttggacagagtctcactctgtcacccaggctggagtgcagtggcatgatcttggctcacagcaacctctgcctcccgggttcaagcaattctcctgcttcagcctcccaagtagctggaattatgggcgtgtgccaccacacctggctaatttttgtatttttagtagagacggggtttcaccatgttggccagtctggtcttgaactcctgacctcaagtgatccacccgccttggcctcccaaagtgctggaattacaggcatgagccatcacgtctagcctacttaactatctttcatagggaaaatgaaaccaaaatgttgagtgaatttcctgccctcgtgtcttcatggcatagaaacctaacattgtagatcaatcttttatccttactttgtcccagcaaacagctggcaggagggacagagggatcttggaaaggcagtgaatgtggagctgaatgacattgtaggattgtgggcgattcaaaggctatgatatggtgaacgaaggagtgatgtgctgcatgaacttgggtgagtcccttcccctctctgagtctccaatttatcatctttagaatgaggaggctgaggctgggcctgatggctcatacctgtaattccagcactttgggtggccgaggtgggtggattgcttgagctcaggagttcaagaccagcctgggcaacatggcaaaacctcatctctacaaaaaaatataaaaattagccagttgtggtggtatgcacctatagtcccagctactagggaggctgaggtgggagaatcacttaagcccaggaggcagaggttgcagtgagctgagattgccccactgcatcccagcctgggtgacacaggcagaccctgtctcaaaaaaaaaaaaaaaaaaaaaatgaatgaggaggctgcaccagactcctgagatgtgacctgtggccctaaagctcactgacatacagttagttattttgtccccggtatgtgtgcattttcagagttgagaatttagaattttagcacccaggggcaatgcgggtggttctgctggcacctcctgagacactggcacttcctcaaggaacattcccagccccagaatcaggggcttctgacagagaagactcatgtgtgcttgttgtttctaatgaactgtagtgagaatcccacatcaaagaatcttcagggagtcaagccttagacatgtgtgctggtgcctgctgcctctggtgtttgactggatgaaaaaattatgtccaaacctggtgttccagcctgttggaaacaacgcatatcaaaatgaggctgaggtccagcatggtgactcacgcgtttggggagactgaggtgggaggatcccttgagcccagaagtttgagagcagcctgggcaacataatgagaccctgtctctacaaaaaataaaaataaaaaataaaatgaggccaggtaaggtggctcacacctgtaatcctagtactttgggaggctgaggtgggtggattgcctgagctcaggagttcaagaccagcctgggcaacatggtgaaaccccatctctattaaactacaaaaaattagccaggcatggtggtgcacgcctgtagtcccagctactcaggaggctgaagtgggagaatcgcctgaactcaggaggtggaggttgcagtgagctgagatcacgccactacactccagcatgggcaacagagtgagactctgtctcaataaataaataaataaataaaatgaggctgagcattttattatcttgtagagcttttggctttggattttggcatctttgggatccgtggtagcctggtgtttgctggttacccattgactcttttgcacacatacaggcagggtagtaatacctcttccctggtgttcacaggtcaacacccaagcagttttgggtgtaggccatggaaggtggtgtcaaaagacaaaatcacagcaaatttgatttaaaactcgaattggcttttatttacaattctaggatcatgcagcacctcattctgtaaaatagaatgggtcttccgaagagctgagcagagaggagcttggctttataggcagaacagggctgaagaaagcagaaacaagggacaaaggggagcttcatagtttctttctttttctttttctttctttctttcttttttttttttttttttgagacagagtcttgctctgtcacccaggctggaggctggagtgcaatggcacaatctcggctcactgcaacctctgcctcccgggttcaagtgattcttctgcttcagcctcctgagtatctgggactacaggcacatgccaccatgcctggctaattttttatatttttagtagagatggggtttcaccatattagctaggctggtctccatctcctgacgtcgtgatccacctgtctaggcctcccaaagtgctgggattacaggcgtgagccactgcgcccggcccgcttcatagtttcaaaatgactttcccttcagggttaaaacaaatgcaactttcttatcatgttggctcaggtacactggaccccttctgattggttgctattgttttttggaaaactggtcagtttcaaagttcagactgattgcgaggcagttggccaggagtgatccgtcgttttggtttggtctgtaggggctaagcacaggagctcagctcaaaatcatggcctcccatatattaaaattttgttttaattttttagatttggggggtacaagttcagttttgtcacttggatataattcccagtggtgaagcctgggcttttacgagccattgcttgcatagtgtacattgtatctattaggtaatttgtcattccttaccccttcccaccatgccacctttccaaatctccagtatctattattctactctttaggtccatgtgtacactttatttagctccacttataagtgagaacaagcataaattatatttaagggtggtgcatgcaggccagccagccagttgcctgtaaccagctggagcactgaggaaaggaagcctgacccaaaaaggcaaatacagtgagcaagaatccctgttagctgaatccaggaactccttctgaaaaaaaatattatttttcttgaggccaggcacggcaggtcatgcctgtaatcccagcactttgggaggccgaggggggcggatcacaaggtcaggagtttgagaccagcctggccaacacggcaaaaccccatctctactaaaaaaaaaaaaaaatagaaaaattagctgggcgtggtggcaggtgcctgtaatcccagctcttcaggaggctgagttaggagaatcacttgaacctgggaggcagaggttgcagtgagccaagaccacgccactgcactccagcctgggcaacagagtgagactctgactcgaaaaaaaaattattattattttttcttgataagttgctaaataatctgtatcctctggcaaatcttctaaccgtttgaggtcctgtttctgcaaaatggaagcaggggctagaggtttaagctagtccttccagacaggatccaacccttgccccatttccaagacaaacaactaaggcctgggagaagaggccaggggtatttatttgagggttctgactcacgtggaagccacagtgaagaagtgacttgtatttgtggatctgcttctgctctctgcagtttccttgggcagtcacttcactgctgctctgccctggaaggccacttcctacattcacctcttcctgccaggccagtagctgggagactggcaaggcaaggatggaaaatgcttgtgttaagtctgtgatttgggaggaagctctttctgaagcagtcttcaaggggctgtctccttcctgcagtgcccagagcatcccagagttctcacaactgtgttcctgttttgggagttcgcactgggttccctctgaactgaaacactctctttctcccaacccctgaacccagacctcccaccagggccagcttcacaggcatgccctgtgcttcaagggaccccgtgcttgttttgacgctttgttgtcgccgtcttgagattcttttttattttgttttttgagacatgatcttgctctgatacccaggctggagtgcagtagcatggtcatggctcactgcagctttgacttcctgggctcaagtgatcctcccgtctcagcctcctgactagctgggactacaggcacgtgccaccacagctggctaatttttttatttttggtaaagatgaggttttgccattttgctcaggctggtcggaatctcatgagctcaagcaatctgcccacctcggcctcccaaagtactgggattacaggaataagccactgcacccagccccaaattcacaataatttttcaacaaggggctctgtgttttcattttgcactgggtcctgcaaattctgtagccggtcctgcctctactgctagctctttgcccatcagagtcacttcctcaaagggccttccctgtccctttctcacatttaaaaaatctaccccccaattaccttcagtatctttatcaatcactctgattagttgtctttgcaacatttaattatttcttgagattatgtctgtttttgtttgtttgtttgtttgtttgttttgacacagtttcactctgtcacccaggctggagtgctgtggtgtgatctcagctcactgcaaccccacaggctcaagaaatcctcccacatcagcctcctgagaagctgggactacaggcatgcatcaccatgtctggctacttttttttttttttttttttttttagtatttttagtagacactgggtttcaccatgttggctaggctggtcttgaactcctgagttcaagcaatccacccacctcggcctcccaaagtgctgggattacaggtgtgaacctccacaaccggctcctaaaagattacgtcttttatttttttatgatctacttggttattacctgtctccctacactggaagcaagttccgtgaagccagggccatagttatagtggtctctgtttttccccactgcctaggctggtgctggctcatggtaggctttgaatatctgctaaatacatgaatgaaatgagctgcaacaagcttgccaaagacagaattctgcattacgggggaatgtaaaacatgtgatgaatgagtgtgggaatggatgaacgaatggatgaatgaatggatgaatgaatgaatggattaattaattaattaacaggtgaataggcattttatagttgttgctctttagcagcagtaaatttttgttttcataaaattctttctccttgtatcttgtgactttggagactagttctggggtgaaactccaattttaaatttttcttctgtctttgataggatcatgcaaactcagcctttctctcctttctcccagctggcaagggctggctgagaatatgaatccaacaacctcgttaagctctctcctcccatctcctcccctttgggttgatctcagggcagggattagaacttggcctttccttggacttggaaacagtccctgaggtttggaaatcccatgcaacacttagaaacagagctaatgagaacattacatgatgtggcaaaatcactgcttacatgctctgaaatgagcacggttacaagaacctcctgttctgtgtgatcccattttgttggacaaacagcatgtggttagtagtgcatagtgggcctatgatgagacactcaggttcaaagctacctcttcctagcttgtaccccgacttagtatgaccctgtggggtgcgcatgtggactgaatggaatgggacaggttcaggattgctgagattgcagctggaatcctgaaacttaaagctatgaaattgaagttcataaattagtggtgaactcatttggcagcaaaacctgtcctgaattgatgtgaggttatgtatagtaattatttatcctattctgctgctgaaatattaatatgataatgtggaacagaaagttttaccttcctaaaaacaataatttccaagttccaaaacatatcaggccctgggaatttcagataagggattatggactatatataacatgcttagaatagttcctggcatatagtaagcacaaaaaatgcttctgcttagtaaatgtgcctaataaatgtgtgtgtgtgtatgcgtatgtgtttgtatgtgtgtgtcttagagggactgtaaagagtgtctccaaatagtaaataatcattttatgtggtatgattatgagtgatttaaattttcttctgcattttctaactttctgctctaaatgtcattttataatgcattttaacaatgtataataataaaacagtataaaaatattgggagaaagagtaaaccaatcatctcacttcctagataggaagctgaagcccagagacattccaggcctctcagcaaggtaatcagaggcccagagcaccatttgaacccagaccctcgttagatgtggatgtgaaatcagtcaacgaactgctagtattagtgtcactgcctaaccttcccccagcgggtaagaggcttggactccaggacgggcacctccgtcctcctcctaacttgttctttctattagtgggaagggttgggagattagggtagtttatggataacctttaagtcgtatgagcttgaggacatcatctaccttctcaggggccagactggacactctgaggttctttgtggctctaacagttggtggctttgttcctttatatgtggaggaatggacagcagggagggggctgggagatagagaaggagagtagctggaaaatggcagaaaagtttgttaatttacaggcaggctgaagcgggaggatcgtttgagcccaggagtttgaggctgcagtgagctatgattgtgccagtgtaccccagcctgagcaacagagcaagaccctatctctcttaaggaaattgttaatttagaaccattttctccctggtaaatgaccacagatagtctgggttctaggcaagagagaggacacactaagggatgaaatggtaggtggggaagtcaaggtttgtcccatccattcgttggcccaggagcagttattgcaacccctctgggtgccaggcagtcagttggcactacagatgcaaagatggtgagatacagcctctgtccttagggagaccagggcaaggggtctgagagcccacaggccagggcattccccatcatttttacagagagagctgtggaatagttaagagcacaacacgctggtggctgaggctgggggctggtgtgctggcttctccacctagccatcatgtgacttggggccaagttctgtgattttctgtgcctcagtttcctctgaaatgaagtcatcgtgttacctccctcacagggttgggatcaggcttcattgagttgctgtaagtacagcactcgaagcagcacccatggtgcgatcatggtcattagatccagtgcacggcataagagcccaggacccacaatcaggtctggattcagacctctcctgttacctgtctgagctgcaatttcctgctctgttgaggcaggataatactagtgcctactttaggagattgttgagatcgagtgggagcaagtgctgggggtggacggcccagaggtggttcagtagccattagttgggtgggcttcttccaaagttcttgcctgtgcgcatggttattcccaagccctggccgggcttacatcttaaaggtgtagcaacctgtgtccacggaggaggaagaggattgaaaaggcaggtgaagtgtcccgataaaaggataaagtccaaaacagcagatgggtgctgaagtgttccttcccgccaccatttacgaccatgttgggatcactgaggtaagaacagtttagcaaggcagaccttggatcccaggaaggcaaatgaggctctgtggggtctggacatacagagggggccctgcaggcaaaggtaggtgaaggaataccaggaaagggagctgacaccagggacctggcatcgcccccactttcccagatagcagactgggtgggcttgcagtgcagcctcccagctgcttgttcgtcatcccagcccacatctcttatcggctccaagcaaggaacaggtcaggaaactaaattgtctatgcatatttttatgcgcccctgagtgaaatgccaaggatcttcctgtaatgtttaatttattcatttattgacttaggaaggggctgggagaaactctcttttcaagtctctttagctcctaaaatgtttactttttctttttctttttctttttttcttttcttttcttttttctttcttttttttttttttgagacggagtctcgctctgtagctcaggctggagtgcagtggcacaatttcagctcactgcaacctctaccgcccgggtcccggttcaagcaattctcctgcctcagcctcccgagtagctgggattacaggcatgcaccaccatgcccagctaatttttgtatttttaatagagacagggtttcaccatgttgtccaggctggtcttgaactcctgacctcatgatctgccctccttggcctcccaaagtgctgggattacaggtgtgagccactgcgcccggcctcctaaaatgttttctaggagcttgggggaaagaggatccctgtctttgagttgttcttgtattaagttaatacaaggtacagagcaactaaccattcatacattcccctcccccttaagcatcattgccctattttagaaaaattattcacttctgctctatacttaatgtaacacagtcccccccaccccatatattgaaagagattatttcattttgcttttctgcaaaaatgaaggcaaattgtatgtggataattttatagttgaggaagtggagagacgggatttacttaaggtcatccgtgaggggaagggtaagttcaagcccatggatggcacagtctttctaccacgctgctggccacatgcatgcggattttcttgttgattttgtgtgtgtattgttcattgacctgggttttccctctgcaataccagtaagtaaaattgagcttctagtaagtctgagaggaagggcttaatgcatgagacagcaactaccaccatgcttgaactgtttcatcaaaaagcacaacaatggatgtttgtataaaggtggtgttgtgcttggaggtggatattaggttggtgcaaaagtaatcgtggtttttgcaatcccttttaatggcagaaactgcaattagttttgcaccgactgaatattattcatttctttccgtcttctattccctaataatgcaattagagaaaaatgcaaggtcatgatcactgtgatgaaatgatgagcccacccatctaaatgaaatcccttatttgagaccctgggtcatagtgagatgtgtgaggctgtctttcaggctgtattagcagagaagtgagaatatctatacagtgtttaagtagtgttggggtttttgcaatagagaataaaaatctagagcaatacaagtatgctggcaagcagttctcttctgcatgatcctaactgactttggtagggttggggtattttgaaatatcttcatttcttgattttcattgctttccctattttgaggtggttacatttacactggggatatttgggggatgaatacttgttggttttggtttgaatctctaaaaatcaggatacagtgggttacttttttggaggaggtgaagacaaggctgtgaacaccttcccagaaacttgaagaactgagaattttgtttatctgttttttttcttaaacctgttgttgaaatgttatttaatatatggtcagggcatagctatccactgctgtcaggcatggctgcttaaacaggggcccagggtgtttatgttgtggccaagtacttggcacccccgggaagtgtggccctgcctgtgccttttctttctttctttctttttttttttttttttttttttttgagaaagggtcttgctctattccccaggctggagtgtagcgagatcatggctcactgcagcctcagctacctgggctcaggtaatcttcccgcctcagcctcctgagtagctggaattacaggtatgcaccaccacgctggctaattttcatatttttagtagagatggggtttcactatgttggtcaggttggtcttgaactgctggcctcaagtgatctgcctgcctcggcctcccaaagtgctgggattacaggtgtgagccactgcacgtggccttcctgtgaagtgaatttttaattgtattttaaaatttgttttcatgtttttgtttgttttgagacagagtcttgcaatgttgcccaggctggaatgcagtggcctgatctcggctcacttaaacctctgcctcgtgggttcaagtgattctcctgcctcagcctctggagtagctgggacttcaggccaccccgccaccacacccagctaatttttgtagttttagtagagacgaaatttcaccatgttggccaggctggtcttgaactcctgacctcaagtgatctgcccacctcggccccccaaagtgctgggattacaggcatgagccaccatgcctggcctgttttcatgattctgatacattatatttttacacatttataggatacatgtaaaattttgttacatgcatagaatgcataatgattgtagggaccaagggaatatcttctgctttgccctctgaagtttcgctgaaaaattaacttgtaaaaaggcagattagttggagaaaagacacacaaatttaattaatgtgtacactgggagaaccgcagagtgattacccagaagggaatttactggccagcatttacattatttttggttggtttgttggctatgaaagtaggctacctttattattactgcgatgacttctaggtagtgttttggttctttgcatttattacattacttgaagaagcattcattcatttatttttgattttttgagatggagtctcactctgtcactcaggctggaatgcagtaccgccatctgggctcacttcaacctccgcctctcgggttttagtgattctctctcctcagtctctcgagtagctgggactacaggtgtgcaccaccatgcccggctaatttttgtattattagtagagacagggtgtcaccatgttggccaggccggcctcaaactcctgacctcaagcgcctgcctcagcctcccaaagtgctggtattacaggcatgagctaccaggcccggcctcattcgtttattctaactggaatcggtttgtctgagttcaagaccctgggctctggcacttcagataacatgcatctctgggccccagtttccttatctgtattatagggataaaaacaataagattgccacgaggattaagtgacacagaggaacaaaggagcacttagtaaatgttagtcttaccagaagtttatttcggatcaccgggctgctggggtcctccctgtcctggaggcactcgcttcagtagcggacccaggtggtgcaaagtgcgtgctagaagcacactgggtgattgcgcagccacctgtcccagggagtggaggtgaaaagatgagagaaaccaggactttgggaaataaaagtcgacttgacaacagggacttttaacgggcacagtggcgacctctgactcacattttaaatttcccatattttccaccgcttccctatcgtgtgtgtattcaagcatatcaattgctgccaatatgtaggggtgtcccatattggggagcaaagcagaagagaggctttaaaaatatatatctccgcagctcatttcggctgccgaagctcagcggcgggtcggaggtaggccggcccgggggcggggctccgtccggaaggcggggccctcctggggcggggtcggtgtgggggcggggcctgggtggggcctaggcgggcgcgatggcccgggactctggcgcgcagggtgcatttcgggatggagcaagcgcagcgcgaagttgggcgcccgccggctgcagcagaaccccgcccgcggcgctctaggactgcatctcggcctccgggtcgcgacctggctgtcctgctgggtcccgggcctcgggtcggcttcaggcggttaaggggtgcatgctctgcacccctgcgggagcccggtgggattggcctgcggggtggtcaacatgagtcctgccaagtgcaagatctgtttccctgatcgcgaagtaaagtaagtaagcctgcaattgtaatgaccatgatcttttacaaacttacgcagtcttccttccccttgaagtcaagctgtgtgtcctcttagcaccgccccctttacccccacccccatccaaagaaacacgggcttgagttggctgctggggagatgatgcccgccttggaaactctagctggccttggcgggaggggaggaaggaggctggacgttgggggtgacgttgcttggaggaggtcgcttcggagcacacaggtgcctaaagatcagcccttgcgcaggggcacgccttccccgctttctctccttcgcctccagaagctgatggttgtggaaggcaggtctcttttgaagctgaagcctgggcaaatcgacgtgaacttgagcaggctctcattgagggtcattttctgagcagatgagcgtaggcatctcagtgcctgagtgctttgtagctctacctacttggttttgtttctttccttttttgtcctcattttattgcacttaaaaagaattaccaaattgatggtgtgtctgttgttgacaattcagaaaattatagataagcaaaaaagaggaacaaaaatcacccataattccacccctgtgatgtttgttaacagttgtatattcttcagcttttttttttttccggtgcagatatgttttaatttataaacttgaatcatgcagaacgttctgtaactcactttttcattcaacattaagtatttttctaccactgggcttggcaaactatgacccactgcctgttttgggatggcctgcaagcagagaatggttttttcatgtttaagtgattgaaaaaaaaatcaaaagaagattgttttgtgacacgtgaaaattacatgaaattcaaatttcagtgtctacgaaaaaagttttattggactgcagcctgctcatcgatttatgatttatgcctagttcatggctgcttttgtgcctcactggaggatttgagtggtgggacagagactgaccagatctaaagtacttactgcctgacccttgacagacaatgtttgccaatccctgcctacaacatgcttttactggattcatagtgttcctttaaatgggtgcaccttaaaatgtatgaataatcctcgccaggcagggtggtgcaagcctgtagtcccaaatactcaggaggctgaggagggaggatgcttttgcccaggagttggaggctgcagtgtgctatgatcgttcctgtgaacagccactgcactctagcctgggcaacatagcaagaccccatctctgaaaaaaaatgtgcccaggtgtggtggctcatgcctgtaatcctagcgctttgggaggccaaggcaggagaactgcttgaactcgggagttcgagaccagcttgggcaacatagtgagacccccatctctacttaaaaaaaaattagctgaggatggtgatgcatgcctggagtttcagctactggaaagactaagggaagaggattgcttgagcctgggagatcgaggctgtagtgagcaatggttgtgctattgcactccagcctgggcaacagagcaagaccctgtctcttaaaaaaaaagtataagtaatcccctataagtagcggatattcaggctgtttctctctgtttttttttttttttttgggggggggctattatcaacagcacagtgaggaatacccctgtagctgaatctctgcctccatcctttattttcttaggatatgtttacctggtccataaacattcatgcacacctcccatgcataaggcctgcaactggtagcaggaagggtcgcaaaaatggttggaaaccgtgacctccgccctccaggaacttcggttccattgtggaaggcagatgtcttctcagtaactccaattcgaggctgatgggtgcaacagtaatagccactaccactcatggggtgctttcagtatgccaggccaagtgctttgtaggtgtggtctcatgccatcttcaaaataccactgtgggggcactaagtggagagtgttgtacccatttcacaaaccactttaatggaaaaaaagaaaaacctcacacaaatttggaattgtcccagcaagtccaggacgtggggtccccctatttataataatatggacatactttgttgggggactacattgttcctctcttagcttagagtggctaaaaagatggatttggacgatctaactttgccaccaagctgtgtgatcttctggagcaggtaccatcaagccttggaacctcagtttccacatctgtccaagggactagccctcataggcctttctagagttgttattattattattattattattattacagacagggtcttgctctgttgcccagacagtggcatgatcatggctcattacagcctcagcctccgggctcaagcagtcctctcacctcagccttccaagtagtgggaccacaggcatgcgccaccacacccagctaatttttgtattttttagagagacagggtttcaccatgtttcccaggctggtcttgaactcttgagctaagcaatcctcacaactcagcttcccaaagtgctgggattacaggcatgagccaccatgcccggctctttcttggtccgttgagactctgtgtggaagtcgctggtcttgagtactgccctgggtcagcacaaacattgatgaaaactaataagtaaagacagagttcggttatgaaagagccctctggagttgggaggcatttgggatcttgtgctgaaggctcgggccatctaagaagccagaactcctgagaaggtgaggtcgcaaatgatgactgatttttcatggcatgagaacggggtcacagttcagagagtagagaaatgattgtggatcagagtgcagaagggcttgaaataaagttggggatgaggaggcagaagttgttttttaatgagtcccatttcactgccatgcaattctgctctgaaaggccagctgcctgcatgcaaatattggctgtagacctatcaggggttttcactcttggctacacattagaatttcctggtggggagatttttgaaaaatctggatgccggggaccccacctctaccccctagacatgctgatgggaccccgacatcagaatcttataaagtttttcatgtcagggttgaaaactcgtgcctagcttggggtcagcagactgctattataaacggccagacagtaaatatttttggctttgtggccatgtggtctctgttgtaactactcaactctgctgtttcctgcaccagaagccatagttatgtaattgaacaggcctggctgtgtttcaatcagacattatttatagatggggaaattcaaagttcatataatttttatgtgtcacaaaacaggattcttttgatttttttttttttttcgatgacttaaaaatgttggctgggcatggtggcttatgtctatagtcccagcactttagaagaccaagacaggagggttgcttgaggagtttgagaccagtctgggcaacatgatgaaaccccgtctctacaaaaataaaccaattagttgggcatggtggtgcacacctgcagtcccagctactcaggaggctgaggtgggaggatcacttgagcccaggagtttgaggctgcagtgaactatttttgcaccactgcactgtagtcctggcaacagagggagaccctgtctctataaaaaacaaataaggctgggtgcggtggctcacacttgtggtcccagcactttgggaggccaaggtgggcagatcgccctgaggtcaggagttcaagaccagcctggccaacatggtaaaaccctgtctctaataaaaatacaaaaattagcagagcgtggtagcacacatctgtagtcccagctactcgggaggctgaggcaggagaatcacttgaacctgagaggtggaggtagcagtgagctgagatcacaccgctgcactccagcctgggcgacagagcaagactccctttcgaaacaaacgaaacaaaacaaaaaacaatctaaaaagttaaaaccgctcttagcctgtgggagatacaaaaacaggtggccgagtggatttgacccatgggtcctagtttgcccactcacccctggcctagccaaggtagtcatcccagggggtactgatggggcaggtggcttgagaaatttccaagggtccatttctggagagcgtggttttgtgctgtttgaacgatatcaacctttactgggctacacagtgttctttcttgctttcttgtttggaagtagttgtaattacagaattgcctggctcagaatcagctcttagcagtgcgggtagccgttaccatctctattttatagaagaaaagagagggaagaaattgaaggtctgattaatgccggggccctagcctaatggcccagcctgggctcctgtaatgctatcctgcagacgtacatggtagctaaagtgttgcaagctgtttactttggctaggtccagggataaactgttaattccatcatgtgaggaaactgaggcagggagtattgaagtaactttcccaggattacacaggttataagcggtagattctggcttcaaagcctaggaggatggccgcagtctaccagagtttctaaactgcggctctgttgacacttggggctgtccagttctttgtggggctgtcctgtgcattgcagggtgttgagcagcatccctggtctccacccactagatgccagtagcgcatcccccaagttgtgacaatcaaagatgtctccaggtattgctccccggggagcaaaatttcccccagttaagcactcagggctgggcgcggtggctcacccctgtaatcccagcactttgggaggccaaggtgggcagatcacctgaggtcaggagttcgagaccagcctggccaacatagtgaaaccccatttctactaaaaatacaaaaattagccaggcatggtggcaggcacctatagtcccagctactcgggaggctgagacaggagaatcgcttgaatctgggaggcagaggttgcagtgagccgagatggtgccacttcactccagcctgggtgacagagctagactctgtctcaaaaaaaaaaaaaaaaccaaccaaccaaacaaaaaacctcagcattatacatgtttgtctcttatttgagaggaatataagaggccatatgtgtaatgcatgttttaaaagtccagttaatagaggggcttccatttatctcagattgtctttctgcctagaagttagattctgaggtcagctagagttggatttgaaacggggctctgccacttgccagctgtgaaactggaggtaaatggtcctctctgaacctcggtttcctcatcgtgaacctggagatgacagactcctccatacagggctgtggagattcactgagaggccccctgtgcccagtccatagtgggcagccgagaatgtttatttcctccattcctgatactattctgcctggtcttgtgctccggcagctgactgcatttggtgtttggctgacacctctgctgttgattgtacctgaagtcatttccaaagtcaccttgaaacatttcagctctcacccttgccgtgctgtataaggacagggcttctcactggacaatggcacttaggatgatcctccttcagtggaagcaaatgctggccgaaggtcagctctctagagccaatgttggttggcttccagctttatcaaaaagaattaaaatagccacttgcctggagattgggcctgaaacaaggccagtccggcagctttgtgtgttcgcttgcctagcctgcggtaatgggcttgtggcctgcctgatggaggggctctgtcaccagtttcgaaatcaacatggtggccaagaatggtttttttgccccctaggccacaaatgaagtttttctttgttgtgctttaggtcaaattgctagagttttaatgtttgtgtgtgtagaaatgggatgtctcagactttctgaagctgaaccatcaagccagccagtcagggaaggtcgtggacagaatgaggggtgcggctgtgtgtgggaatgtcgattagtacaacctctgtggaaaacagtttggagagttctcaaggaactaaaatagatctgccagtctctccagcaatcccactactgggtatgtacacaaaggaaaagaaatcactcagtcagattcgcttttcattgggaggatcttaacatgattggttgaaaacaataaataaaattagcaaggagtccagttgtggggtctcacgcctgtaatcccagcactttgggaggctgaggcaggcagatcacttgaggtcaggagttcaagaccactctggccaacgtgtaaaaccccgtctctactaaaaatacaaaatttagccggacatggtggcgggcacctgtaaccctagttgctcgggaggctgagggaggaaaattgcttgaacctgggaggtggaggttgcagagagccgagattatgccactgctctccagcctgggcgacagagtgagacgcagtctcagaaaaataaaataaaataaaataaagaaataattatatcaaaagacacctgtacttgtatagttatcacagcactattcacagtagcaaagatatggaatcaacctaagtgtccaccaacagatgactagatacagaaaatttggtgtatatatatatataattttttatggctcagtagtattcttttgtgtgtatgtgtgtgtgtggtgtgtgtgtgtgtgtatacctacatgtatacatgggtgttcctcttacaaaattaatagcttttttcttattgaaaataacacatcattgcagaacattttttaaaatatagcaaagagataacggctcttaatactttagcatttttttcccccagatcaggggtctgtctacaaatgatgtcccttgggttgcatctacctttttttgtaaataaatgaagttctctttttttttttttttaggtagagtttcactctgttgcccaggctggagtgcagtggtgtgatctcagctcactgcaacctctgcctcccgggttcaagtgatttttgtgcctcagcctccccagtagctgagactacaggcgtgcgccaccatgcccagctactttttgtgtttttttagttgggatggggtttcatcatgttggccaggctggtctcaaactcttgccctcaagttatctgcccatcttcgcctcccaaagtgctgggattacaggcgtgagccaccgtgcccagcgtagcattaaccttttagaagctagaaagcagatgaatgagtggtcactggcttaaggctgagtcctaatggagcagtgaggaaagttggggacccctggccatctgtaccacagaacccccaaaaggcatagtgtctggcagcaagggatgcccctggagctgaggggtaaggagggtaccaaaatgagaaggacagggtggaagactcccaggtcccctcccctgtctcctgcggcaggggctgtccacttcgaccccaacagaaggcagcagttcaaaggtacatatagagggtcttgggagaggggatcgacaggcacagttgagggcatggggcctgtatcccaaataggaagataagggtctgaataggtgctgaattcttagaacttccccgttccccccggggctccaggctgacctttactgtccaggcagaagactggaaaacttctccctggggaatctggccagcgagagagaaagacacaaagatactgactcaggggatccccaacgcactcctacctcaccctacattgagctcagggtcaaccaggtccaccacagtctcagaaattctgttctcactcatagtcacaaggttggaaccaaggcttccctgacatttgggttcagtttctttttctttttcttttttgagatggagttttgctcttgttgcccaggctggagtgtaatggcacaatctcagctcactgcaacctccgcctctcaggttcaagcgattctcctgcctcagcctcccatgtaggggggattacaggtgcacgccaccaagcccggctaattttttgtatttttagtagagatggggtttcaccatgttgtccatgctgctctcaaactcctgaactcaggtgattcacctgcctcggcctcccatagtgctgggattacaggcgtgagccactgcacccggccctgaggtccagtttctcatatgtaagtcaaggtccaaaccagtagacacaggaagcttggaagaaacagaaaccacgctggagaagagaagtttaaaaagctctcattaatatcatcgttgaggtcagacaggatgttgcactcataggaagaggatgctataacaaagggaacatttgtaggccaaaaacaggctcgtagacatcaaaaacatgatagcagaaatgaagaactccactgaatgtttagaagatgaggctgagaaaaatcaaccagcaagtagaagaagagagagaataggagaggggaaaaatgcataaaccagtaggccagtgtaggaatttcaacatccagataataggacttcgggaaaaaatagagaaaaaaagaggcaaggacatcatcaaggaagtatttgtttcttgttgttgttgttgttgtttgagatggagtctcactctattgcccaggctggagcgcagtggcacaatcttggctcactacaacatccgcctcctgggttcaagtgattctcctgcttcagcctctcaagtagctgggattacagatgcacaccaccatgcccggctaatttttgtatttttagtagagacggggtttcaccatgttggccaagctggtctctaactcctgaccttaagtgatcttcccacttcagcttccaaaagtgctgggatcacaggcgtaagccaccatgttcagcccatcaaggaagtatttgaagacaaattcccaggatggaagtttccagattgagagggcctgagagatgtgcagcctcattggtggaagcagacacatacttgagctcatcactgtgaaatcatagagttctggggacagagggacgctcctataagcatctggatatgaaaaaacaggtcacctacaaaggatcaaggatcagaattactcttgttctagcagccttggaagccacaacacaatggcacaaggcttctaaaacttgaagaaggttttccttcctgaaatttctttttgtttgagatagagtctcactctgtcgcccaggctggagtccagtggcgcgatctcggcttactgcaacctccattctctgggttcaagcaattctcctgcctcagtctcccaagtagctgggattacaggtgcacaactctgtgtctggataacttctgtatttttagtagagatggggttcaccatattggccgggctggtctcaaactcctgacctcaagtgatctacccacctcagcctcccaaagtgctaggattacaggcatgagccaccatgcctggcccttcctagcatttcacacacagccaagtggtaaggttgaatgtgagggcaggagaaaggctgaagtgcaatggtgcaatcctagctcactgcagccttgacttcctgggctcaagtgatccttctaccttagcctcctgagtagctaggactacaggcaggtgccaccatgcctagctaatttaaattttttttttttttttttgagatggagtctgaccctgttgcccagtctggagtgcagtggtgcaatctcggctcactgcaacctccacctcctgggttcaagcaattctccctcctcggctttccaaggtgctgggattacaggtgtgagccaccacgcctggccctgaatagcctttcttagaaagctacttgaggatgtcttccactgaaaccagagggtaaaccaaggaagagcaacacacaggagacaggaaacaggagattcaacatagactgaaagggagtctccagggtgatggtgataaggaagcccagtcaggaatagggcagggaaattgagggcatcattgtcatgcgccttgccattctaccatcttcttaagtggatgaaactactggaggatatgccccagcaaaacaagggagtctaccaagaaagacgagccacccattcccccaaattaggaatccaaccccaaggaaaggcaaagggaattctagggatgtcagcaaagggaagccccaaaacaatggtgatgtaggggcctagaggacagccagtacctacggaaggagaacagaggccttcaggagagatgtcaccagtggaaaaaaacagaactgatcaattatttattattattatttttaatgagatggggtcttgctacattgcccaggctggtctcgaactcctggtctcaagcagtcctcctgccttggcctcccgaagtgctgggattacaggtatgagccactgcatgtggcctgatcaattatcttatgtgtactgggaatctattaggaggagtggggtgatttagcaacaggtacaaggaacactaagtaaaggaaaaaaatcattaactccaggaaaaggcaaaaagaaaggaactaaaatctggtacactgcagctctcatatgtgaataatgatcacaaacttcatatgtgaataatgatcacaaacaagtaaaacattgaatacccagtttgctaaattacagtagacttctatggtattgaccagctggtggaggggagccgatggggtggccttgtgagataactaaattcacatctctcaggatgggaaggccatagatgctgtctcacatggatgactcacaagattgcatacacttgttgtttaggactatggagatgtgtaattgctagaaaaaatcagcatcagtttcctctggtgtggagggacagagcaggaaacctgttttgttgttaaacatttaaaaaattgttttcagttttctaaagaaattttgtgggctgggcgtggtggctcatgcctgtattttggaaggccgaggtgggaggatcacttgaagccaggagttcaagaccagcctgggcaacaaagtgagacccctgtctctacaaaaaagaaaacttaaaaacttctgaaatacaaatgtagaaaagtacatgaaagatattaataccatgtaacaagtcggaacgattagaatgtgtggacttcttccctgatcataaaactctcacccttgttataagttttttagtattattcaggttcctaaacaatgggcatgtaaagtaaaaattaacttaggattaaaaatctaaacatccaccttgggacaggtagaagaaactgctccttctagttcatgtgctggtaccttagctggcctcttaaggtgctttcagttgggtacagtggttcacgcctgtaatcccaatgctttgaaaggctttgacgtcacttgacatcaagagtttggacgagcctgggcaacatagtgagaccccatctctacaaaaatgtttaaaagtcggctgggcttggtagtgccctctgtggtcccagctacccaaggaggtcgaggctgcagcgagccacgattgcaccactgcatactagcctaggtgacagaatgagatcccgtctcaaaaaaaaaaaaaaaaaaaaaaaaaaaaccgaaggtgcttcctgcccttgagcctccttgtaaattgcttcaggggctctggagagcaagtgcaaagcaggggggctctggtgcagtttggctcctctgctccactggctttacaggtgccgagctctgagtcccaggcttcttccctcatgcacgtctgtccctcattcttattctgcaggccgagcatgtcgggactccacctggtgaagaggggacgggaacacaagaagctggacctgcacagagactttaccgtggcttctcccgctgagtttgtcacacgctttgggggggatcgggtcatcgagaaggtacagatgggtctcggcactctgggtggggtccgattggggtgcaggggcccctcctctcagctggaggtgggagattcgggttcaggctcattctgcctgctgcagagagggggtgagggccacgctcctctgagttttaatagtttaaccctcaaatagaaataatagtgaagcctctttcaaagggctattgtgaggatgaaatgaaataagacaggtaaaacacattgtactgtaaaacactcaaaaagtgttaagggtgatcacaatgacaccaaaggaataaaaaaaaaatcattcactgggctcggcacagtggctcatgcctgtaatcccagcactttgggagggtgaggtgggcagatcatttgggcccagcctgggtttgtgttcaagttcaagaccagcatggacgacatgacaaaatcctgtctctgcaaaaaaattaaaaaattagcaggatgtggtggtgtacacctgtagtcccagctactcgggaggctgaggtgggaggatcacttgaagctggaaggtcgaagctgcagtgagctgtgattgcaccactgtactccagcctgggtgacagagcaagactctgtctcaaaaaaaaaaatatatgtatgtgtatatatatatatatatatatatatatatatatttcagacaaacagccatccatccatccatccatttgatgatccattcatgtggatggcagactttgagctcctgctctgtgctggggtgtgtgccatggaaatacatagaaataccaagaggaatgatgtgctgcgggggctgcaggaggctctgcagctgtgaggtggactcggggtagcacgtggcccccagcgcaggtagatgtgcatctacagctccttccttgtcttcccatgcaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcaggtacctgggccttgaccctctcctcccatcacgctccatccttgcctgccctcgcctccttcccctgtgcctaggcaagtccatcctggactcccgatggtcaggacctctcatgagtctgtatttatttgtccttccttctttatttaattaaaatgtctgctgacatcaagaacaactcatgtgccttacaaaaatgcagatggttaacatgcagagaggaaattcgatctttgagaaatgtctgtgttctagcagattgggggctgtttctcctgcaggtgtatgtaattgtatttcaatcatttgttcattcttccgttcatttgcctaagtttattataatgaatcattctataaacaactgttggatgatttacttttttcctgaacagtcttatccttttataggccctactccccacagcagccaaagtgaccttttaaaagcataacttcttctgctgtattttctgaaggttgttaaaaacaaaaacctcagccagagcgctggctcacccctgtaatcccagcactttgggaggctaaggtgggaggattgcttgagcccttgagtttgagagcagcctgggtaacataataagaccctgtctctacaaaaaataaaaataaaaaaattaactgggtatagtggcacgcacctgtagtctcagctactcaggaagctgaggtgggaggatcgcttcagcccagggggtctaggctgcagtgagctgtgattacaccgctgcattccagcctgggaaacagactgagactctgtctcaaataaaacaacataaacctaaaagcataactcaggtccgagcacagtggctcacgcctgtaatcccagcactttgggaggccaagatgggcgaatcacttgaggccaggagttttgagatcagcctgcccaatgtggtggaaccccatctctactaaaaatacctcccaaaaatttgccgggcatggtggcaggtgcctgtagtcccagctcttcaggaggctgaggcaggagaattgcttgaatccaggaggcggaggttgcagtaggctgagatcactccactgcactgcggcctgggcgacagagtgagactgtctcaaaaaaaaaaaaaaaaaagcaaaacaaaaaccaacataagtcaggtcttcaggtctttttgtgcttctccttaaaatgcatcagaggctgtgtgctgttcccaatattagcaacctcagcaccatcccctaagccttcctgccccaagctcttcacagacatggcctcatttgttacttacagctctgttttacagatggcacagtcgaggcacagggatgtgaatttatcacttgtccagggtcacacaaccatcatgtgatgcgggtgggatgggaaccctggtctgggttcagagcatcatccagtgggtcctcccatcttggttagtctaaaattcaaaattgtcacccaggcctattaagtcccctcctggctccatcttgaacctcttgccctccatcagccgggtaccagtcaccctgacctctggtagctcctgggcctgttgcagagtcttggcacctgctggaacctctattgaaggtgcttctcccagagccctttgtgcagtggactccctccccacccagcctgtaggtctcaacatgatcatcgcatctctctcagagaacctcatttattttcttcccagcactgaccggagtctgtagttattgtgtttattttcttgtttatcttctccaacataaaagaaaaactggacaaggaccaggaagcctgtctggccgctcacttcatcatctctggaatctccccgttggccgacacttctgtgtttgataaacataggaggcaggcaggccggaaggagcagctgctctgggatttctttctgtgtttgcatataaagtgccacattgttcaatttcaggatcttagcaattctatagtacagatgtcccaacccctgtgtttggattgagtctaacttttcctagtccaaaacactgctcagtggctgttctctgactttggcctcattgatgtgtgggtttttgtttgtttgtttgttgttgctttttttctgagatggagtcttgctctacctcccgggttcaagcaattcttgtgcctcagcctcccaagtagctgggacttcaggcatgtaccaccacgactggctaatttttgtatttttagtggagatggagtttcaccatgttggccaggctagtcttgaactcctgacttcaggtgatctgcccgcctcagcctcccaaagtgctgggattacaggtgtcagccaccgcgcccagccagcgtgtgtttttttaaggacatattcctagacatggaacttctggcttaaagagcatgagtattttaaaatcaaaacattgcgttatgttcagccttaaaaaggaaggaaatcccgtcatatgttacaacacagatgaaccttgaggacgttatgctggtcacaaaaagtgaaataagccagtcacaaaaagacaaatactgcatgattccatgtagaaggggtaactagagtagtgcaattcatagagagagagaagatcgttggttgccaaggacatgagggagggagagaaagggagttgttcatgagtatagagcttcagattcataaaatgaaaaagttgtggacatctgtttcacaatataaatatacttcactattgaactgtacactcaaaaatggttaagatggtaaattttgtgtgtgtttttttttttaccataatttaaaactctgtattgtatttttgtttgtttgtttgttttttgagacagggccttgctctgtcacccaggctggagcgcagtgacatgatcacgactcattgtagcctcgaccttctaggctcaagtgatcctcctgccttggcctcccaagtagctgggactataggcatgcaccaccattcctggctactttttttggatttttttttttttttttttttgtggagacaaagtctctgtgtgttgcccaaactggtcttgaattcttggcctcaagtgatcctcctgcctctgcctcccaaagtgctgggatgtcaggcgtgcaccaccgtgcccagccctattatattatttaatggtaaaacaatattaagataaactttaaataggactttttttaaaaacccacctctaatcccagtctgttgacagattacttccttcttccttcgttcctttccaggccttccaggccttgtccagaaacatatctgtatcacataattaaaatcatatttcattttctttacattttctttcttttttttttttattagacagagtctcgttctgtcacccaggctggagtgcagtggtgtgatctcagctcactgctacctccgcctcctgggttcaagcgattctcctacctcagcctcctgagtaccttggattacaggtgcccaccaccacgcctggctaatttttgtatttttagtagagacagaatttcaccatgttgcccaggccggtttcgaactcctggcctcaggccatctgcctgcctcggcctcccaaagtgctgggattacaggcgtgagccaccacgcctggccttctctttacattttcatacatgtttgtccattgttaccatagaaatctgcatggttctgctttccatggctgtacatagtcacatcttgtaatgttctgccattgatgtcagtctgtcagcagttccttccttctccctcccatttaatttcagagtacatcaagatggcggatcattacgtccccgtcccaggagggcccaataacaacaactatgccaacgtggagctgattgtggacattgccaagagaatccccgtgcaggtagatggactggggtgcccaagtgtggcccctgagtgtgggatgatgcccctaggttctagttcaattccacagttcacaaggggtggagggtccagatcccacaaggctccaaattcctgggctgatgtaacacagaaaagagtgttcaagtgaggcgaagcacattctgtttttaaaaaaaaattttatagacaggatctcgccatgttggccaggctggtctcgaactcctgggctcaagtgatcctcctgccttggcctcccaaactgctggggttataggcgtgagttactgcacctggctgggaggcatattcttgaaggaagattgttgctcacccctttctgtgtttgcaggcggtgtgggctggctggggccatgcttcagaaaaccctaaacttccggagctgctgtgcaagaatggagttgctttcttaggtagagtgtgtccccatcagatacatgggaattggggtattgctgggacactctgctgggtctgaccctctttctcctcctgtcctgtaaagcggaggtccgtttgatttcccacctcacacttctgtcgtgaggagtgagtgagtcccagggtggaagggcacatagctaatctgccaactcatggaattaggagctgcccgcttttcaaaggaagacacacaggcagccaacaagcatatgaaaaaaagctcaacatcactgatcattagagaaaggcaagtcaaaaccagagtgagataccatttcttgacagattctgagattgtggagaaaagggaacgcttatgcactgttggtgggagtgtaaactagttcacccattgtggaaaacagtgaggcaattcctcaaagagccaaaaatagaactaccgtttaacccagcaatcctgttactgggtatatacccagaggaatttaaaatcattcgaccataaagacgcatgaacacgaatgtttattgcagcactattcacagtagcaaaggcatggagtcaacctaaatgcccatcaataacagattggataaagaaaatgtggtacatatacaccatggaatactatgcagccatcaaaaatactgagattatgtcttttgtgggaacatggatggagctggaggccgttatccttagcaaactaacacaggaacagaaaaccaaatattaaatgttctcacttataagtgggagctaaatgatgagaacatatggacacaaagagggaacagcagacactacttgagggtgaaaggcgagaggagggagaaaagcagaaaaaataactattggatactaggcttggtacctgggtgatgaaataatctgtaccacaaacccctgtgacataagtttacctatataacaaatttgcacatgtaattatgtccatgtccttgtgtagtttaggggaatcatttactatcatgtaataaatccctgcttctccttaccggtgggtctgaaaacagtcttgcccaaatgtgaagcaactcagtgcggatcaatacatgatattcacctgaggtacagccgggagtcccatgcccattgacgttttctttgtctgtggactctgagtacatgtgggcatctgtcctgtctgacagttacccaggactctcattatcagtcttaattcctctggaggttgatgatccagcccactggacaaactacagctcataggccaaatccagcctatggcttgcctttgtaaataaagttttattaaaacatggtcgtgcttattcgtttatgtattgcctatggctgctttcacccaacactggcaaagttgagtcattgtgacagagacctgcaggctcgcacaactgaaagtatttcccatctggctctttatagaaagagtttgctaacctatggtccagctctttgagctcctagcttacctctttgatctagctttctgccttccctccaaagtgaattttgtatatgccactgtagcctaggttgtaactcacaacaggtttacaatccacatacgttgaaagttgactgatgcaatagcagactaacagattatttttcttccctgacatgaggttaagctccttgagagctgggaccagagaattttctctgtcatctgctccttacctggccccaccaccgtgcactcggtcggccttcagcctcgagggtcttgtgactgaccggattctgcttcccttcttgtccccgattcctcaggccctcccagtgaggccatgtgggccttaggagataagatcgcctccaccgttgtcgcccagacgctacaggtcccaaccctgccctggagtggaagcggtaagggaccccgagcttccctctgggggagcttctcagcccagtcttgataatgtgaacggtcagggtgacagaagtatgcttgtaacaattctttccattacaaatgttacttacttttattttttagtcattagcaaaatattttaaaattttaaattagtaaacaagtggtataatttattgtaggcaatttagaaaatacaagaagtacaaaaaagaaatggaaatcattcataatcctatgacccagtgttgaacatttattacattgtaggtatctacctttccaacctttttctggccatattctttgggaaaaaaaaaaaaaaaagacagatcttggccagtggctcatgtctgtaacccaaccccccaacccagtgctttcagaggctgagggaggaggatcacttgaagccaggagttcaagaccagcctgggcaacatagcaagaccccatctccagaaaaagtaaaaaaaaaaaaaattaactggttatggtggtgcatacctgtagtcccaactactgaggaggctgaggcaggagggtggcttgagcctaggaggtcgaggttacagtgaactatggtggcaccactgcactccagcctgggtgatgagaccctgtctttaaaaggaaacaacaacccatcttacatttcctagtttgtgactttttttttcctcactaatgaatatctttctatgtaaaaaatacactttacaccatttaagatgcctgcataggattatatcttatggatgtatcataatttacttaacagtcctcatggttaaacaatttaggttgtttccaatttattttttctaatttaaaaaatattcaaaggaatggagctttgataatcttacagctaaatttatgtgtgcattttaataattttcttaggataaattcctaacagtggagtttctaggacaaattaaaaaataaataggaccgtctcaaaagtttcctattaaatttgtttttttttccccccccaaaagttgaattttaaatttgggatggaaaatttgctttcatttgttaaatctttgcatggtgttgggaaataattattcacatataaatgactccataaggtagaattgggatttttttttggatttagattaatatggttgttgttggtcgactcagtctgagtttctttccttttttgttgttttgttttcgagacagggtctcactctgtcacccaggccaaactgtagtggcatgatcatagctcacagcagtcttgacctcctgagctcaagtgatcctcctgtatcagcctcccgagtagctgggactacaggcccatgccaccatgcctggctaattataaaattttttttgtaaagacaaggtctcactatgttgccagggttggtcttaaagtcctgggttcaagcgattccccccacctcagcctcccaaagtgctgggattataagcatgagccaccacgcctggcagttagtttcttaagcttgatttctcattcaaggttgggttagttcttgaggaaatgaaaagccattgtgagaagctgaagggagtgtctgtattccgctggtccagaagcccaggtctagcactatgtcagcagggagaggcgctgtggtttctgggttgtgtgtgtttctcctggatttgggaggaatcaggtttctttgtgactctccaggcctgacagtggagtggacagaagatgatctgcagcagggaaaaagaatcagtgtcccagaagatgtttatgacaagggttgcgtgaaagacgtagatgagggcttggaggtaaatgcagagcctgtgggggccaggggagccagaaccgaactgcctctgtcctggtagcagttggcaactggctaacctctaaagaggtctgtttgtcctttgcacccaggcagcagaaagaattggttttccattgatgatcaaagcttctgaaggtggcggagggaagggaatccggaaggctgagagtgcggaggacttcccgatccttttcagacaagtgagcagttcttgctgtgtcttttcgcatctgtctttgggaattgtttgtgggctgccagattatttctcttagcattattctgtgacagtcaagaagacatttgtaggagctggatgtatcgttgtatcgtattttgcaacaaacgcgtacatttttactcagaaaagcccatggttttgtgtcgatcttgacagaatcttttaggtagttcaagtctataaatcagtgtatctagaaatgatttcagagatacaggatcaaaatagctgtttgtgactatattggcctatagaggaatgggatattttataaatattagtactcttgttatttctaatgtttctagatggtctattttattttatttttgagacagagttcactctgtcacccaggctggagtgcagtggcacaatctcagctcactgcaacctctgccttccaggttcaaacaattctagtgcctcagcctcctgagtagctgggattacaggcgtgtgccaccacacgcagctcatttttgtctttttagtagagacagagtttcaccatgttggctgggctggtctcaaactcttggccttgagtgatccacccgccctggcctcccaaagtgctgggattacaggtgtgatccgctgcgccctgcctgatcaattttaactgtaggaacgaattgcacatttacttactggtagctagttttcctcttttaaaaccttatgtccgttatcagcaatgtttagaaaacatttatactgacaatcttcccattcttaaagctattttaatatttctagcttttcttctagaccttcttcatatgtatattttaaagagctgtattcagtctacacgaaattttgctctgcatttaacacattccaaattgtagatcatgaatattattatgttattcctgccttggcaattattttgatgattactcaatattttatgtgtggcaatagccttatttatgaaacctttccttttttgttaaatgtttagcttatttctactttgttattatgaataataataccacagtataatgtgatatttagtactataaataacacttagctcttttttcttcttaattattttcttggataaagacttggggagaaagacttagttaaatagcacacactttacatgcactttgaaacacatatcagtacattgctttctaggagttttactaattataccactcttggtataatatgtgaatgttgtataaagcagcagtttcactaccattgtatcgctgttggggtgtacaagtgttttggggatttgggtggggggaagaattgatattaaaagggaagttgcagcagcagtacagaaagttcacatctatccttcgcccggtttcactcgttaacatttttcatataactttgcaactaagagattaacatgggcacttttctgtttggtaaactccagactagattgaatttcatctgtttttgcaccaatgtccctttcctgttgcaggattcagtcctggattccatattgcattaggggtcatacagattttaaagcttttttgctttttaaaaaatagactttatttattagagcagttttagggtcacagcaaaatggagcggaaagaatagagagttcccacataccccaggccctcatgtgcacacagatgcccaagcttttttattttacttatatgagtgcactatgaatatgttcttaatgtagagagtcagtcaagtcagccatgtgttaagaataaaaaaggaaaaacccttttccccattaccttccaactctcctttctcagatgtaaccactattagcagctgccgatggtggggggctcttttcagcactgtcactgtatatacttttacatagacattcatacagttgtttcattattttttgcatgacttcatcctatacattattgcaaatttgttaaacttaatttgtcttagaaatcattgcacgtgaatacttttcacattgtctttaagaatctctagaagacatgcctataaaacaatgcctttcagctcttaacaggatgaagtaagtttgtccttagattccacccgggagagctagctgagaaagtgcagtaagtggaagaaaaagacaaccacagattagtgtgttttggtcccattttcattcaaagaaactttctctgtatgtgttgctatatgcatagaagaaagccagtttggacaccaaactctttaacagtgcaatatctttaggggatgtgactgtgggagattttaccatttcacagagtttgacttaaaaaagagaatatgttgcaggtagtgactattgggctggcggtgcagctggtaaaggaatttaccaagacagctgtaggtaaagaaaggcagatttattggaggaagtatgaaaatatgttgcaagattgcaacaggcagcacagcagagaaggatctgtctgcaaagaggcaagggctggtgggaggttttatagggtggtgctggaggaggggctgtgaggtcattacgtcctggggttgtttgtgattagccatctctcgagcagttgttcattgttcttccccacctggggccgtcccccacctggggcccctttctcctcgttactgtggagtcgggactccacagaatattatgtctgtgagacaacaaaagtaaaagatcagcagagtcctggatgagtaccctaaacacatcactgcgtttgttttatgttctctcctgagaacttccagaagcttccagagctggtttccccatgaagatcaggctgctctgcttcccccgacaggtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgccccgctggccatattcgagttcatggagcaggtacacttctcagagcccagggggcagcttcagagagagccgtctcagctcagagtcaggaagaactttctacggtcagtgtggctgaatggtggcatgggtgcctaacaagagggatgagggcccattccagaggtgatttcagcatcacacaggtttattggattagccggtctgtgaactccccaaatatttcttttcttttttgagacagagtctcactgtgttgcccacgctggagtgcagtggtgcgatgatagttcacagcagcctgtaactcctgggctcaagtgatcctcccacctcagcctcccaagtagctgggactacaggaacctgtcaccatgtctggctaattttaaaaaaaaatttttgtagagacagagtcttgctatgttgcccaggctggccttgaacttctggcctcaagtgatcctcccgccttggcctccttaagcgctagggtgataggcatgagccaccacacctggccagtcccaaaatatttcacatgtagcaggtgctcagtctgcatttggtgaaggaactgatagtcaccatttacagttccctgaaaagacctctggaacccccttggcctctttctgtttcttcacagtgtgccatccgcctggccaagaccgtgggctatgtgagtgcagggacagtggaatacctctatagtcaggatggcagcttccacttcttggagctgaatcctcgcttgcaggtggaacatccctgcacagaaatgattgctgatgttaatctgccggccgcccagctacaggtgagaaaatgggcttggggccctgggacttctctgccctgggtcaggggtccatgtgctgctcccattagtccatcccgcccatctcttggccgactgtcccaggggaatgactggccaaagagcactttgagaaatctgtaaaagctatagttctccctgggaaaatatcttttatacaatttcaggacattcatagacctagagaaatgtttcttaaccttgttatcattatcactccctgcaaggatcctttggacacattttatatcctaatccctgtcttgtgaaattttaatatcacaaatataccacatacctgtttggatattgtagatatatctgtgctttattcatgaaaagagtgagattttcttcactcccaagaacaaatatttgtctcttcagaggcaatatcatccctgttaagaatatgtgatccagagttgtaacctcttgggttaaagggaactctaaattttttttttatttttaattttgatgggtatatagtaagtctgtatatttatagggtgcaagagatttttgtttttgtttttgtttttttgagacggagtcttgctctgttgcccaggctggagtgcagtggcgcgatctcggctcactgcagcctccgcctcccaggcatacaatgtgtaataatcacatcagggtaaatgggtatccatccccctccagcgtttatcctttctttgtgttatggtgttatgaatattccaattatactcttttagttaattttaaaatgtacaataaattattgttgactgtagtcaccctgttgtactatatcaaatagcaggccgtattcattctcttaatcactacatttttgcgcccattaatcatcctcgctttccatgcccctacctcttcctttccagcctctggtaaccatcattctactctctgtgtctgtgagttccattgttttaatttttagctcccacaaatgagtgagaacatgcaaagtttgtttttctctgcctggtttatttcatttaacataatgttctccagttccatccacgttgttgcaaatcatggtctcattcttttttatgtctgaatagtactccattgtgtgtatgtaccacattttctttttcctttttcttttcttttttttttttttttgagatgcagtctcgctctgttgcccaggctggagtgtagtggtgcaatctcggctcactgcaacctccacctcttgggttcaagcaattatcctgcctcagcctccctagtagttgggattacaggtgcacactactatgcccagctaatttttgcatttttagtagagatggggtttcaccatattggccaggctggtctcaaactcctgacctcagatgatctgcccacctcaacttcccaaagtgctaggattacaggcatgagccactgcacctggcctgtaccacattttctttatccaatcatctgttgatggacatttaggttgattccaaatcttggctattgtgaatagtgctacaataaacatgggagtacagatactcttcgatatactgatttcctttcttttgagtatatatttagcagtaggattgctagattggtagttctacttttagttttttaaggaacctccatattgtcctccatagtggttgtactaattttcagtcctaccaacagtgtatgaggggtcccttttctccacgtccttgctagcacttctttttctgttttctttttcctttccttttttttttttttttttttttgagagtgagtcttgctctgttgcccaggctggagtacagtggtgcgatcttggctcacagcaacctctgcctcacggttcgaacaattctcctgcctcagcctcctgagtagctgggactacaggcgtgtgccacgacgcccagctaattttttgtgtatttagtagagatggggtttcaccgtgttagccaggatagtcttgatctcctgacctcgtgatctacccacctcagcctcccaaagtgctgggattacaagcttgagccaccgcgcccagctgctagtatttcttattgcctgtcttttggataaaagccattttaactggagtgagacaatgtctcattgtggttttgatttgcatttctctgatgatcagagatgttgggtgccttttcctatgcctgtttgccattcgtatgtcttcttttgggaaatgtctattcagatcttttgtctgtttttaattggattcatgagacttttttcctactcagttgttttagcttcttttttgtttttgagccagggccttgctctgttgcccaggcaggaatgcagtggcatgatcatggctcactgcagtcttgacctcctgggctcaagcgattctcccacatcaacctcctgagtagctgagactacaagtgtgcaacaccatgcccagctaactttttaaaattttttgtacagataaggtctcactatgttgtctaggctggtctcaaactcttgggttcaagcagccctcccacctcagcctcccaaagagctggtgttacaggcatgagtcaccatgctcatccttgagcttcttatgtattctggttattaatccctcgtcaggtggctagtttacaaatgttttctcccatgctgtggattgtctcttccctttgttgattgtttcctttgctgtgcagaagtttcttaacttgatgtgatcccatttgtcctttttttgctttagttgtctgtgcctttggggtattactcaataaatttttgcccagactgatgttcctgagagttcccccaatgttttcttctagtagtttcataatttcaggtcttagatttaagtctttagtctattttgatttgaagaatttgattcttcatttatgattctgcatatggatatccagttttcccagcaccatttatcgaagagactttttccccattgcatgttcttcgcaagtctgtcaaaaatcagttcactgtagatgtatggatttgtttctggattctctattctgtcccattgatctatgtgtttgtttttatgtcagtaccaccctgttttggttactgtagctctgtaatataactcatagtcaggtaattcaattcctccagtgtttgttcttttttttcaggatggtattggctattctgggtcttttgtgtttccatataaactttaggatttttttttctatttctgtgaagaatgtcattggtattttggtagggattgcactgaatctatagattgctttgggtaatatagccattttaacaatactgattcttccaaaccatgaacatggaatatctttccatttttgtgtgtcctcttcaatttctcacatcagtgttttatgctttttattatagagacctttcacttctttggttaagtttattccagggattttattttgtttgtagctatcataaatggaattactttcttgatttttttttccagaccattcgctcttggcatatagaaatgctactgatttttatatgttgattttgtatcctgtagatttactgaatttgtcaattcgaattgtttttttggtggattctttaggtttatccaattttaagattatatcatctgtaaacaaggataattggacttcttcctttccaatttggatgtcctttatttcttctctaaattgttttcattgttttcttccttccttccttctttcttcccataatggggtctcattacgttgcccaggctggtctccctcccttcctctttttcttccttcagcagaattttttaaaaagttttctttatttttttttcagtttgaaagatttcaaaaaagttgcaagaatgatacaattaatacccatacgccctgcatatagatccatcagttgccacatttgctttgtctctcttctgtctgtttgtataattttagggggctcaatcttttttttttttctttgagatggagtctcgccctttcacccaggctggagtgcagtggtgcgatcttggctcactgcaacctccacctcccaggttcaagcgattctcctgcctcagcctcccgagtagctgggattataggtgcctgccaccacacccagctaatttttatatttttagtagagacggggcttcaccatgttggccaggctggtctcgaactcctgacctcaactgatcagcccacctcggcctcccaaaatgctgggattacaggtatgcaccactgtgcccggccgtgggctcaatcttttgagcaatggtttgagtgaaccttcgtaacatatggcctctgaatacttcattctaaaggcctcctacaacaagagcattccggtccaatgccctagtgcaattatgacacttgagaaatagagcattgataccacatctatatctaatatataccattcacattaaatattttccctgttgttccaataatgtctttttgtagctgttttttgtctcttaaatccaggatccaacccaacccagggtgacacattccattttattttcatgtgtctttaatctctttaatctgaaagcatttcgtagtcttttttcatccttgacattggcattaaaatttttttttttttttttggtgatggagtctcgctctgtcactcaggctggaatgcagtggtgcaatcacgactcactacagattcaacctcccaggctcaagtgatcctcccacctcagcctcctgagtagctgggaccacaggtgcaagtcaccatgcctggctaatgtttttttaattttttctgtagagatcgggtctcattatgttgcccaggctggtctccaactcctaggctcaagcgatctgcctgcttcagcctcccaaagttctgggattacaggcatggacactggcatttttgaggagctcaggcagaatgtccctcattggatttctctgattgtttcttcctggttcgattcctgctacacattttggcagaatactacacaggtgttgtgtccttaatacatctcatcatgaagcctgttaaatctgatcatttggttaagctggttccataattgtctactttttacccattcttcatgtccagtttccccttcgggtgccctttacaaaaacttcctttaactctgcagccaacatggttgcttctcaccttccctagctctaaaagtctagtgcttttacttgatgcatgtattttcttgttgtgtgatgttgtttcataaatatttttccttttcccaactgtactatttgctccactgtgaaaagttcatgtcttatggctttttctttctttggctctctggccacagtagagcaccatgttgtctatagagtagtgtctgtatatcctaaatcattgactgaacctccgttgcatctaccactgtgcctggtgttttggggccgtgttctggtaggactgacagtctgtgggttggatctcttgattttagatcgccatgggcgtgccactgcaccggctgaaggatatccggcttctgtatggagagtcaccatggggagtgactcccatttcttttgaaaccccctcaaaccctcccctcgcccgaggccacgtcattgccgccagaatcaccagcgaaaacccagacgaggcaagttatgggggcccctgtgtttccaccatctcagatctcccagcatgtgggggaccctggatgttagcctgggaagagacacccacaagctatccaggcatctcagtttacaaatggggaaactgaggcatgggaagggacatcccatggtttatttgattattggatttattggatttttatttttatttatttttatttttttgagatggagtctcaccctgtcacccaggctggagtgtagtggcgcaatcttggctcactacaacctctgcctcccaggttcaagcgattctcctgcctcagtctcccaagtagttgggattacaggcgcccgccaccacgcctggctaatttttgtatttttagtagagacggggtttcaccatattggccaggctggtctggaactcctgaccttgagtgatccacccgcctcggcctcccaaagtgttgggattacaggcatgagccaccacacctggctggatttactggatttttggattattgccaggctctgggccgagccttcccatgtctcactgctcacttataggacactactgctgctggacatcgtcaccccacattacaggcaaagagcctggggtaacttgcttcctgtctcccacctgggacctgctgagacccatcagtggactccaaaagccatgcctatctttgggacaagcagccaggtttagaaccctagtccttggatttctggccccgtgtgctttttgctacagtatgaagtctggctcattgtagagagtccctttgtgacttggccttacttgggtcttaaaaaacaaaccaactggcatcccttacagtttacatgcataccgaccgttgattgtcacaggactcatcaatctactacaacttaattgcttaattattaccctcaggaaactgggggtaagagagggtacacctccaccccttttaattaaataattttaagctagggtagctgtattcatttagggttcttggctgtgaaccaaacaccaactctggtggacaagcaaaaggggaattttttggagggatgatggctcgttcccaggttcctaggaggatggaggaccaggtatggtaacagcccaggcacttgggtcgctccatctctcacttctacatacctctccccaaatccttcatcccttagttcaggagccctaatcccagtgagaggtgccatgtccacccactcttaccaaaattgtacttagagggagacgggccgttctcccagagggaatcaggtgtgtgttggcagcagcctggccgatggggtgaggaaaagggggatggagggagggagggaggaaggggtaggaaaggaaggagggaagaggggagtgaggaaggacgaagggagagagggaaggagggagggaaggaggaaggaaggagagaagaaaggaaggaaataccaacgaaatggcctcttccctagcagcaagggccctgcccaggatgccctggatttcttcacctgcagaggttttcattatccagaattggaaatctaacctgtcttcacttctatttaaactttttattttcgaaatgtcaagcatataaagtcagaatgtcccttcactcagctccatcaatcatcaatgttcgcccatttaacacctgcactaccatctctgtcccaactcgcttattttatttatttatttatttatttatttatttatttatttatttatttgagacaggttcttgctctgtcacccaggcgggagtgcagtggcgtagtcatgcctcactgcagcctaatctcctgggctcaagagatccttctgcctcagccccacaagtagctgggactacaggtgtgtgccaccacacctggctaatattttaattttttgtagagatggggtctcctgatgttactctggctggttttgaactcctgggctcaagtgatcctcctacctctgcctcccaaagtgctgggattacagacatgagccactgcgactgaaccaacttcgttatttttttacagttaaaaaaaataagaattataggcattgaggagctcatatgggtacacccatgaatagatacatccatacctgtaacaagcgatatcagtgttctattgactaccctaagcttttggtcagcgtaggggttcttgggttttcccaggactgaattctgatgaaaatatatctggagtaatgatttcttccattttgcattttctgtccggactccagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgtcagtatctccttccttccttccttccttccttccttccttccttccttccttccttccttccttccttccctctctcccttcttcccctcttccttccctctttctcctcccttcctttcttcttccctccctctcagcctttctccttttttccttccttcccttccattgccttcctgccttcctttcttccttccttcctcccctcttctgccctcccctccccttccatcccttcccctcccttccttcctcccgtccttcctcctccccttcccttctttcctcccttcctccctccttccttcttttcctgacttctctgctttcctccccctccctttcttcctccttctttccttccttccttctttccctcccttcccacttcctccttttcccaattccttcctttaagaaatgaaacggtcccctggggcttcagatacagtagcatttcaggagaccaagaaaagtaaatcacagggtaggccccatttaaaataccctgtgcttgaagttcaagatcaaagcctgccctttttttcctttattgaagatccacaaagtaaaataagtgcaccaaggtcatttggtcttgagcttataagagttctagcttgaaggagatctaaagattgttctaggagatacccaaagtgtaaaaggtgctaagtaccatagctgaagaaagggggagggaaactcctttacatttaaaccttatcagtagttccctaatgggttgtatttcacaccgaagactaaattttaaggagtgtgtcctgctgtgaaccacccaccactctgaggcctgtgacagcagccccatgtccccagctcagccaagtcctcccatacttgtgatagtttctgcagagctgagaagcccacattgacagagggacccccaaattctgacacaccatctccgacacttctcctggcttgacatgggtgtggaaaggtataaaactagtttactttgtaattaaatgtttttgtgtgggtaactgcccttcggagtgaaaaaatcccaaaggccttagcattaaaatctgacgtggggcacttagccacgaattaaattgagttgggcagttttgatgatcaggttttctttgccagcttagaataattaattttaatcatgcttagtgaaaaatcaagatccttgaagtttatggaagattgcagcaaaaagggcttacttaataggagtaggcggaagacaggtcagccagcccagacccctccgagtgaagtgacctgtggcttgtcacatgctacgagtggaccaaccgcaacttcaacagaactcacaggcagaaattccagcttttcttattgctgttagtgagagtccagtagggggatcaactgtcctcgttttcctggcaccggtttctcaggttgaaggacttctcagtgctaaaatggggaccaccccaaggaaactgggacaagtcactcacccgtgagaccagcgggttaactctcatacccagcttccagacccacagctgacttttcatggcctatggatacccttgtatgaccttactgggtcttcattttctcacccccaaaatggggtcatcagtgtccttccccgttacctgctgacagcacacaggatgctgcaagacatgaaagcttactcggccaggcacagtggctcatgcctgtaatcccagcactttgggaggccaaggcgggcagatcacttgaagccaggagttcaagaccagcctggccaacatgacgaaaccccgtgtctactaaaaatactgaaattagccgggcatcctggtggccatctgtaatcccagctactcgggaggctgaggcaggagaattgcttgaacctgggagatggaggttgcagtgagctgagatcgtgccatttcactccagcctgggcaacaagagtgaagctccgtctcaaaaaaacaaaaaaaagaaaaaaagaaagctttctctcccagaagaagaggtgttcagatacctgcccacactcaccatgaattcatagggctcagcttcccgagtagctgggactataggcgcgtcccaccacgcccggctagttttgtatttttagtagagacgggatttctccatgttggtcaggctggtctcgaactcctgacctcaagtgatccacccgccttggcctcacaaagtgttgggattacaggcgtgagccactgcacctggcctgaggtttagctatttgaactggtgctcttggagatttggagtctgtgtgttggggagaggcagccatggggcccaccaggcccctgagccgggtgacagtgccgtccatctgcaggtgcaccccacacacaccaggcagagcagctgtgtggaaggtgagagggtggcaccagctctggggacaggagatttgaataggtcaagggagagacagaggcggtgaccgattttccctttgtttttttttcttcttttaagagatagcgtctcactgtgttgcccaggctggagtgcaatggtgtgatcatagctcactgcagcctcaaactcctgggctcaagcgatcctccccctttagcctcctgagtagctgggactacagtcacataccatcacgcttggctgattttaaaatttttgtagagatggcgtctcattatgttgcccaggctggtcttgaactcatgcctcaagcaatcctcccgcctcagactcccaaagcagtgggattacaggcatgaaccaccatgcctggctggttctttctctactaatcattaactattatagtcaataattataacaataataactaatcacgttcattgtagttaacatttattgatcagtgaccatgtgcattacatggattgtctcatttcaattctcgaacaccctcatgaagtcagggctatttccccattttccatatgaggaaactgaggcccagagttctcaagtcacttggccaagattagccaggcagtaaaccctggcgctgattcaatgcactggctgtgtcagtcagagccctctcttaactcttctttttttttttttttggagacagagtcttgctctgtcgcccagcctggagtgcagtggtgtgatctcagctccctgcaacctctgcctcccagattcaagtgattctcctgcctcagcctcctgagtagctgagattacaggcgtcctccaccatgctgagctaagttttgtatttttggtagagatggggtttcgccatgttggccaggctggtcttgaactcctgacctcaagtaatacacctacctcagcctcccaaagtgctgggattacaggcgtgagccaccacacccggccactcctgtgcttttccagttctctgaatcacatcattgcagcaactctgttgatgtatgcatgaatttggaaaatgatccatgtgcctttcccttcaaggaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaggtagggagtgagctgcctgtgtctcccctctggatggccgagacctcggcttcctgaggatactgaagtgcattttctcctaggcggagaaaccggatatcatgcttggggtggtatgcggggccttgaacgtggccgatgcgatgttcagaacgtgcatgacagatttcttacactccctggaaaggtaggggctgtggcagttcccttctgcttttgtgatatgtgttagcggcttaggaggctgaatctgtctcctttatttgtgtggccagttagtcaccaggcaattggtgagtctctcctccggtcttgcctctgggaaattcctctacagatcaacctaggctacccttgaagaggctgtgggttagggaatgggattctcgaggccagggtggcagtcagtgaacaggctgttgtgtacggatccatgctgacttgtgtaaggtacatcataatagtcaggagttctgagttcaaggaggtggatttgggaagcaaagcggcttaaaggtcatctctacaagcgggtgcattcccagaccctcaccagaatcagagggtcatcatgaaatggaccagaatggaaagcaaccaggcgatctctgttaggataggccggggtttctcagcctcagcaccattaacattttgtgctggatgctttttttttgtttgggaacctgtcccgtgcatcataggatgttagcagcattcctggcctctacccactaaatgccaggagcagcccttccctctgagtcatgacaatcaaatatatctccagacattgcccaatgtcccagggttaggagtagaataatcacccccagttgagaactgctgcaagaggcaaaggaactatcaaaaagaaaataaaaggataaacttttttttttttgagacagagtcttgctctgtcatccaggctatcacccaggctagagtgcagtggtatgatcacagctcactgcagcctggacttcctgggctccagtgatctgcccacctcagcctcccaagtagttgggaccaccggtgcatgccatcatgcctggccaatttttttaactttttgcatagatggggtctcactatgttgccccccaggctggtctcaaactcatggcctcaagcaatcctcctgcctcaactctgaaagtgctgagattataggcgtgagccactgtgcctggtaagaaatgtttttagtgtttggttatgcttttgaacggtagtagaatcacagtccctgctctggtttctttcataagccgaaggcaggatcccatatgtgaaatttttccaagagaccgttatggattttgctcctgaaaagcctttgtaagatttcaaatccctcagcaagtgctgattccttaagttctaagcaatatcaggctgctcagggtgattcaggttctgtgcgtgacttttaatcagatttagccttttttttttttttttttgagacatagtctcgctctgtcacacaggctggagtgcaatggtgtgatctcagctcactgcaacctccgcctcctgcattcaagcaattcttgtgcctcagcctcccgagtagctgggatgacagctgcatgccaccacgcccggctaatttttgtatttttagtagagatggggttttgccatgttggccaggctggtctcgaactcttggcctcaagtgatgtgcctgcctcagcctcccaaggtgcagggattacaggcgtgagccattgcgcccagcccaggcttagcatttttagtgcagtcaggtttgctgatgcagagagttgcgtaatttttttaaatgcaagggatggctgtggagttctcagtccctcccaaggctgaccacaaccctgtcttttctttcaggggccaggtcctcccagcggattcactactgaacctcgtagatgtggaattaatttacggaggtgttaagtacattctcaaggtaaatgcccccgtgcctctccgatgtctccaacactctgcaagcttcagggagtttctttcttccatgaaccatccctggagtggatttgctcatgcttgggtttgagctcttgtgttcctcgggaatccccatgtagtccgtgaccttgacacctaaacactttggcttttagaacatgtagggctgtgcattctgcagagggcacaatggagcgtggataagtttcctgtagctgcggtaacaaggtaccacaaactggtttaaaccaacaaaaatttattgtgtcccagttctggaagccaagtctaaaatcgaggtgttggcgggccgtggtctctctgaaggcgctggggcaggatctgttccgagcctccccagcttctggtgctgctggcagtccctggtgatttttggcttgtggatgccttgccccagtctctgtctctgttttttttttttgttgttgttgttgttgttttttcaaacggagcctcactctgtcacccaggctggagtgcagtggctcaaccttggctcactgcaacctccatctcccaggttcaagcaattcttctgtctcagcctcctgagtagccgagattataggcatatgccaccatgcctggctaatttttgtatttttagtagaaatgggatttcaccatgttgcctaggctggtcttgaactcctgagctcaagtgatctgccctgccttggcctcccaaagtgctgggattacaggcatgagccaccccccaacctctgcctctgtgtgtgcatgtgtgtgtgtgtgtgtgtgtgtgtgtgtgtgtgtgtttacattggcctcccaaagtgctgggattacagtcatgagccaccccctggcctctgcctctgtgtgtgtgtgtgtgtgtgtgtgtgtgtgtgtgtgtgttcacattatcttccatgactgtgtctttgtgtctcttctcttgtaagaacaccagtcacattggatttagcgtccaccctaatccagtatgatttcatcttaattacatctgcagagacctcattccaaataaggtcacattccaaggttccaggaaggccatgaattttggaggatattattcaacccctatagaatgtgagctgggcctttgctgagacagaatagtgggcccgggtctgtttccaggggctctgaggctggttttgttctctgtctctgcaccacgtgtagattactggcatcttccctggtttactactggagtccctggggcttattccggttgctctcctctgtcagaagtgcctagttgccctttgtgggccatccaaggtcaattcaacagtgtcagaaatgtctctgagatgcacaggtagggggtgaggcttggtgtcctagccatggtgttctgggcccagggtccttgttggggtgagccggctgtggcatcagtgccccgggttccaatgcaatggcaggaggctgtgtcccctgtaagcccaggcctgcccagtacttcccagcctcacattgtcaggagggaaaagaggacagagtttgagtctgcttatgagacagaatttttgttttctttaattagtactttctatttaatattgatgagcatgagtagaactcacaactttggagatttgggggctttagttcaactaaacctgtgtgtcattgatcagggtatgctttcacaatcatcctcctttgcccctaatgcctcttggctacctttggggacctagctgcccccaacttgattttaaatgtcacatatgcacaatgtagaaaatttcaaaatttcaagcgagcataaaaaatcaggaaaacaaatccatcatgtgctaatgcctagaggtaatcctggtaaacattttagcaaatctttgttatatatttttttccttttgcattaattttacaaagttgagatcatggtgcaaatgcagttttacagctttgatatgatcatggcataaagttttccatgttattaacaagttttttttttaacacgagtctaaactcatgtctgtggcactgtctccctgaacttttaatagtgatgggaacattccctatcttctgtgtccaagatgctgcccttatgtggtgactgagagcttgaaagtggccagtgtgactgaggaactgaattttacattttatttcattttgatcagtttaaatagctgtgtgtggttaggggtcaccgtatcagacagggcagatctaaagtgttccattgcaaggttgttggcttgctaattttgttctaatttttgttgttattacaaataatgctgcaatacacattcctctatttcttgctgccttgtgtcataaactgtgaattttataggttgaaggccctttagggtgtgtgttttctgagagaaaactgaactgaagtaccagatggggcaggcgctcttcctggagggagatgtagtgctggggccagggcttggctgtgtctctctcacgtgtcccaaagctcttgtgtgctcctgggcagagctgggtctgggaagcagagccctagtccatgtccaggtgtcttagtccatttgggctactgtcgtaaaataccaaagactgagtggcttctaaaccacacactgaatttctcacaattctctaggctgggaaggtcaatatcaagatactggcagatttggtatctactgaggacccacctttcgtttcatagatgctgtcctttcgctatgtccttagatgtcagaaatgggccacagagctctacaggggatcttttataagggcactaatctcttttacaagggccccaccttcatgatctcatcacctcccaaaggctccacctcctaaagccatcacattaggggttgggatttcaacttatgaattttgcggggacacaaacgtttagtccattgcacctggctgctggtggagtctccagggctgcctcacacagagtgagagctggagacaggaatcagaagggagtctctagccccagaggacatgcagttgccaacacggcttgacagggactatataagcggccattagcctacccacagggcaggtgtggctcgctactccaggcctcccccagccccatcagcagctgctcccttggcaggaattgtgagggctgggtccgagagacgggggtgttcatcttggccctctgtggtggacaaccagctcttgtttgttgttagcggggcccagcagtgctctgggagcacatcctgaacccaggcggtgacaaggggcttgtccccacaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacaggtgcgtgggggtgcgagtcccactgtgggctgggcatgcacagctctctgtcctaggcatggaaaacacagcactggcctgtgtgcaggtccaagggtcttagagaaggtgcctttctggtaaattctgggggtgtgcagagaagttaatctcttggttggaattctgtgcaactggcagatatttaggggaggatcctaggaggcccttttctagtaacctggttggtggggattcagagctgaacgggacatgactcccagctctgtggcctgcgaggtgtgtgaccaggtgcctgctgcctgtgcatctgggctctggcatccacccagttagtgcggcagtgacctactaagctcctccgtaccaggcgctgtgctgggtgttgggatagcattctgggtgtgactcgtggagcttccagcccattcgggaagatgacacactgaacaaacagatagtggcaggaaagggtgtcgtgtacctgacgggtaacacacaagatgccctggaagctcttagcacaggggcttgtgagatagtgagataggccccaaagatgccccgcctccagtgtgtctgatcaccccgagatcacgcaatgaaacagaccccagccaaggtgatgaaaggggaggggatgtctgaaaagctccagttagagagtggagactctcttctcaatcctcaatgttttggaagaaggaagactaggtttatgccagagtaatattttgttatctccttttttttctttttgagagagggtctcgctctgtcacccaggcaggagtgcagtggcaccatcatgactcactgcagcctcaacttccctgggctccgagatgatccccccacctcagtcccccaagttgctgggactacgggcatgtgccaccacgcctggctaatttttgtattttttgtagagacggggttttgccatgttgctcaggctggtcttgaacttctggactcaagcagttggccagccttggcctcccaaagtgctgggattgcagtcatgagccactgcaccctgcctgttatctcttttttaacccacgttctatctgccaagaatgttcaggattactataggttctactctccccagttcaaaggttaagactttgaatcagtaaatatttgttgaatcatatccactgattgatttttctgtgtcaggccctgttggaagtatgtcagtaaaaggaaccagctttcagccaaaaaagggtcacatcctttttattattttattttattttaaagactggttcttactctgttgcccagcctgggcaagagtgagaccctgatcgcttgagtccagaagtttgagaccagtctgggcaacatggcaaaaccccatctctataaaatacaatgattagccaagtgtggtggcgtgtgcctgtagtcccagcaatttagggggttgtgatgggaggatcacctgaccccagggaggtcaaggcttcagtgaaccatgattgtgccactgcactccagcctgggtgacagagtaattatagctcacaatagcctcaaactcctgggctcaaaggattctcctgcctcagcctcctgagtagctgggactactggcatatgctaccacgcccagctatttttttttttttattttttgtagaggcagggtctcactgtgttgcccaagcttgtcttgaactcctggcctcaagccatcctcccacctcggcctcccaaagaaagcatcacagccttggccaggcacagtggctcacgtctgtaatcccagcactttgggaggctgaggcgggcggatcatgaggtcaggagatcgagaccatcctggctaacatggtgaaaccccatctttactaaaaatacaaaaaaaaattagctggatgtggtggtgggcgcctgtagtcccagctatgcgggaggctgaggcaggagaatggcgtgaacccgggaggcggagcttgcagtgagccgagatcgcgccactgcactccagcctgggcaacagagcgagactccgtctcaaaaaaaaaaataaaataagaaagcatcacagcctttttgttcacccacctcactctcagtgtctctgagataactatcaactgccaccctttgggaatgtagagggtacactccccctttaggaaggggaaatggtattgaaagccggactagggcttgctgagttggtagtcctcatcagtctccctacccgactcctcctctctcccagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgactgcagagccggccgtggggaatcctgaaccctcaaactcccactcttctggctttgtcccatgtctgaacaaacaggcctacctctccccttgaccactgtctgcaaatttctaagggaatcagtctgtggatttcagccaaatcccctgaagtattcaaagaaaaaaacttcaggctgggcgtggtggttcacgcctgtaatcccagcactttgggaggctgaggcgggcggatcacgaggtcaggagatcaagaccatcctggctaacatggtgaaaccccgtctctactaaaaatacaaaaaattagccgggcatggtggcaggcgcctgtagtcccagctatgcaggaggctgaggcaggaggatggcgtgaaggcaggaggatggcgtgaacccaggaggcggagcttgcagtgagctgagatggcgccactgcactccagcctgagcgacagagaaagactccgtctcaaaaaaaaaaaaaaaaaacttcaaaaaatgcacatctccccaggaatgagtaagaaggttaatgacagagaaactgggtacagagaatatggaaactctctgtactatttacataactgttctataaactgttgtgtaaatcagtttccttgatttctttattttttttttgagacaagtctcagtctgtcacccgggctggagtgtagtggcgtgatcttgtctcactgcaaactccgcctcccaggctcaagtgatcctcccacctcagccttccaagtagttgggattacaggcacgcaccaacatgcctggcttaattttttgtatttttggtagtgacagggtttcgtcatgctgctcaagctggtcaaatacctgagctcaggtgatccacctgctttggcctctgaaagtgctgggattgcaggcatgagccactgcacacagccaagaattgattgataataacaattattgtcaatcaatgattaaatattaaatattgaccccagcaataattgaaaggtgttaagccaacacttgcaaagccataaccatgtggcaggtgctgttctaagcattttactgatctttattttttaaccttcccagcaaatatatgagatgggcacaaatgtgatccccattttataaaaaagctgggcccaggcaggctaagaaactcactggaggtcacacaaagccaggattcaaacccggaaaataacaacaataatagcaatgaaaatacatcaataatagtagctactgcatattgacctgctgcatggcaggatctgcatctcattcaatcctcgtaagagccctaagaggtgaaactgtcattattcctcattttacacttggggaaactgaggctcaaggaggggagccacttctgaagatcacagaggtattggtgggggcagttcctgggattctagtccaggcctggctgacttgggtgcccaagctgtgaactgccaagcaagagagatagcacagtcctggctctgcggccgccaccatggtgacaaagctcatgccacgcacgtatccagacattcgggaaaattaaaagggctgatgagcagattcttcatttcacagagtgttccctgagggttttctaagtgcctttaataaaacaaactgttcacaaaatgtttgatttatgcagtacgttttaggaacgtgtatatgaaccactctatgtaatatgatttaacagtatttctaagagaagactccccctttggaaataaacatcagtttccatatctgtaaaatgggcatcataaacacctccttggctggctttgcagattgaatggcacttgcctggcacttagcaggcttccagtaaaggtcacttttccttgtaccttctgcctgaacactacccagggagtcattctggcgcgtccctgggtagtgtcccggcgcgtccctgctccggcatcactagttctgggtggctctgggtgtcaatcccggtgggctctgtactatttcttctttttacgaaataggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggtatgtggctccacggcccaagtgctctggctggtgcaggtgcactcgtgacctccactggttcagtgagacaggtggactcaaggctggtagcgcttctcctgcctccacctgcagacagagctcgtcgcagcagccaccgtgatggtgcagaaacacaaggaagccgcgccctgctttactcagatccctctctgtggctctccatcctgcttagagcaaaacccaatttctgccagtgacctgcaagaccccaaatgagctagctgttccctgctttcttctctgcctttctcctctgtccctctccccatcacttacttgaatacactggacccctccctcctggcggctgtcctctctgctgtgaaggacctaccccagactttgcagggatcactctcaactcctgggagctttgattccaatgtcttcccctcaatgagggcattcttgaccattgaccaccttttctttttaatagacttaatttttagtatagttttagatgtacagaacagttatgtaagtagtgcagagttcccatattctctgtggccagtttccctgtcattcatttaattatcattcaattaattgttagtattattattattattcatttttttttgagacagactctcgctctgtcgcccaggctggagtgcagtggcgtgatctcgactcactgcaacctctgcctccctggttcaagtgattcttctgcctcagcctcctgagtagctggggattataggtgtgtaccaccataccagctaatttttgtatttttagtagagacagggtttcaccatgttggccatgctggtcttgaactcctgacctcaggtgatccaccctcctcagcctcccaaagtgatgggattacaggtgtgagccactgcacctggcctcaattaattactattgttatcaatttactgttattaatttaactattattgcacgagcatggtccatttgtcatatttaatgaaccaatatcgatatattaggtattattgtttaagaataataattaactttaaaatttaactattattgcaataatatggtccatttgtcacatttaatgaaccaatattggtacattattgttcactcagatttctttagttcattttttaaaaattgtggttaaatacacataacaaaatttaccatcttagccatttttaaatgttctcttgagcagtattaaatccattcacattgttgcacagccatcaccatcatccatctccagcacttgcaaaactgaaacttgacactcgttaaatggtaactcctgagtccctcctccctccagcccctggcaaccattgttctgctttctgtctatcaattcaactcctctaggtgcctcatataggtggaatctatatagtatctggccttttgtgactagcttatttcatttagcgtaacgtctccaagtttcatccatctgatagcatgtggcagaatttccctgttttttaaggctgcataatattcccttgtaggggtgaatcacattttgtttatccacccatccactgatggacacttggattgtttctacctgttggctactgtgaataaggcagctatgaacatgagtgtacgattttcttagtttttacctattgtccaggatcccatccaggttagcacattgcatatagttgtcaggtctctttcaaccgccctttaaaaaattgtgctcacctccacccacgtgcaaacacacaccgtacctcacaaagatgatctcactgattgtcttgttgctttattatttggcctccaggagactggaaacaccgtgagaacagggccttttggctttcttgctcgctgctggggccccagtgccaaaaacagggcctagtacatcagaggtgctctgtaaatattggttgttggatgaacgtgtagcaggcaggtgccgggggcgtccccctgtcctcaggaccaccagggggtgcaccagagtgtctgtcatgtgaccctgagctcaggctcttgggggcacctccaatttagattcctcttaatttgtcaagctgtgtcattaccgatgagtccctgaggtcaaggactactttcgatgtccactgttgtgatcctggggcttagcacagtgctcggagcatagtgggtgctcagaaataacaagtcttgatgaatgaatgaatgtttacaccctcctaagcaagactctaaaataattagtacatctgtccagtaaaaaaaaaatttaaaaatatcacatggtctcttttctccagagtattctattaattgtatttgttttcttttttaaaaaaattataattattatgggtacataataggtgtacatgtttatgggggtacatgtgatcttttggtataggcataccgtctaataatcaaatcagggtgattggggtatctattacctcaagcatttttcatttctttgcgctaggaacattccagttctactcttttggttagtttaaaatgtacagtcgattttaattgactgtagagtcaccctgttgtgctatcaatactatatcttttttttttttttttttttgagatggagttttgctcttgtcgcccaggctggagtgcagtggcgtgatctcagctcactgcaacctctacctccagggttcaagcaattctcgtgcctcagcctcctgagtagctgggacttaaggcacctgccactatgcccagctaatttttgtatttttagtagagatggggtttcaccatgttggccaggctgatctcgaactcctgacctcaggtgatccgcccacctcagcctcccaaagtgctgggattacaggtgtgagccaccatgtccagcctcaatactagatcttattcattctatctaactggatttttgtacccgttaaccatccccactcccaccagccccactacccttcccagaccctggcagccatcactctacattctatttccatgagtttatttgttttaattttcagctcccacatatgagtgagaacatgctaaatttgtctttctgcccagcttatttcacttaatgtaatatcctccagttccatccatgttgctgcacatgactgttgttacaattcttttcattagtctctttctctctttttttgagacagagtctcactctgtcacccaggctggtgtgcagtggcacaatctcagctcactgcaacctccacttcctgggttcaagcaattctcctgcctcagactcccgggtagcaagtacctgggaccacaggtttgtgcgaccatgcctgactaatttttgtatttttagtagtgatggggtttcactaggttggccaggctgatcttgacctcctggcctcaagcgatccgtccaccttggcctcccaaaatgctgggattacaagggtgagccactgtgcctggcatcactagtctctttagggagttcccaaagctaggaatagactgggcctttttggatcagtgggcaggtctgggtacctgcactgtgattcctttcagcacacatttcctgtgctgggttaatgaggcagggcctgcccacccattccctgcagcctcacataaatgcttgtgagacagactgggagatcgagtaacttcacttggtgagtgtagttagaagaccgcccttggccctgggctgtggggacccacatggagaagctatgatcagattgtgtaggggaaaaccctcaagtcagctttttttttttttgagacagaatttcactccattacccaggctggagtgcaatggcacaatcttggctcactgcaacctctgcctcccaggttcaactgattctcctgcctcagcctctggagtagctcggattacaggcacgcgccaccatgactggctaatttttgtgtgtatttttagtagagatggggtttcaccatgttggccaggctggtctcgaactcttgacctcagttcatcctcccacctcggactcccaaagtgctgggattatggtcatgagccaccgtgcccggccaagtcatctcttaaaaggggagaaaagcctgcagggctaggggtggggatgggtgtgggtggaggggtagagggtgggcaggaaacggagtgttctctgctgggagaacagcaccccagcactgtgcgtcatgcacagtaggtatttgtagaatgaatgagtagacgaatgagcacatttagtctgtgttgccctctagggagctttttatttttccatgtgtttacctaagactgaatttttatgatttacaaaaatcagatgcatttgtatgagatgttcataaattttcatcctactgtgaggtgtttaactttgggattcaatagagaatgaaaataaatacagaacatgagatttgttgattataaagcaaaacaacaacaacaacaaacagatcggccgggcgcagtggctcacccctgtaatcccagcactttgggaggccaaggcgggcagatcatgaggtcaagagatcaagaccatcctggccaacatggtgaaaacctgtctatactaaaaatacaaaaattagctgggcgtggtggcctgcgcctgtagtcccagctactcgggagactgaggcaggagaattgcttgaacccgggaggcagaggttgcagtgagccgaggtcatgccactgcagtccagcctggggacaatgcgagtgtctcaaaaaaaaaaaaaaaacagatctcaccgccaccccacaaaactgtctggggtgtgaaactgtgtactgggccatttgcaaaaggaatggtttggaaaacccacattggggtgtgagtttggccgttttaactttccagttcattgtctttgattttttcctcagacctcatcctcacttgattacggaagccggcagatctgtcctgcctcccgttctgcccggtcccatttggaattcccagagttttcctgacctgtcgttcttgtggtgtctcatcaggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaaggtaaagtcacctatgagcgcaggcgtgtagaccagtgcggagggtcagaagatctaccccgtgacagcagaggtcattattgagtaagaaatgagaaaatggtcggtcctctgttgtttttattttatttattttattttttcagacaaggtctcactctgtcacccagactcactgcagcctcgacctcctgggctcaagagatcctaccacctcagcctcccacgtagctgggactataggtgcaccccaccacgcccggctaattttttgtatttttgtagagatggcattttgccatgttccccacgctggtcttgaactcttgggctcaagtgatccatccgcctgggcctcccaaagtgctgggattacaggcctgagccaccgcacccagcccctcggttgtgtttatgaaggacctgtcctcagggaattcctcaattcaattgtaaacattggcctgactttttctccttgatcgtaaactgggcttgtagcagttcagctcaagactgagaatactccagtaggacattaaggaaggagtcagtgggggtcaccctgcttaaggagatgacagacaaggcactttgtttgaaacacacctctgttcgtcattcacccttgctgggtctcatctgctcactcagtagagaaacaagaagttctctgatttgcagacctccttgaaagacccatgatgctcatagcagtgactaagcatcacactgtgtgctgtaccgggtccgtctcaggagagcaaatcatgatggtgatgacgataataaccgccaacccttagcaagtatgtaccatgtgtcacccccctttgtttttgagagggagccttgctctgtcacccacaccaaagtgtggtggcacgatcttgtctcactgtaacctctgcctcccaggttcaagcgattctcctgcctcagcctcccgagtagctgggattacaggcgtgtgccaccatacccagctaatttttgtattttttagtagagacggggttctaccgtgttggccaggctggtcttgaactcctgacctcaggtgatccacccaccttggcctcccaaagtactgggattacaggcgtgagccaccgtgcccgctgtgtcaccttctaactacttaaaagttcaatcatttcatcctcccagcaaccgataaggtaggaactcttatttccacttacagttgaggcaactgagggacacagagactaagagacttgctgtgcttcatacatgaggaggcaaagatgagatctgaaccatggccatcaggattctgactctgtgctcttcgcccccacgttatgctgcctgatgattattaccaccattgcaacattttttttttttttttggagacagggtcttgctctgtctcccaggctggagtacagtgggggaaacactgctcactacaacctcgacctctgggttcaagcaatcatcccacttcagccttccaagtagctggggttacaggtgcctgccaccacacccagctaattttttgtagagacggggtctcgccatgttgcccaggctggtctcgaacttctgggctcaagtgatcctcccgccttggcctcccaaagtgttcagattacaggcatcagccaccgcaccccacaataattgcaacttttattagttggggcacttcgcagtttatgcatcagttcactttgaaacctcacaaccacactaggatgttggccccactatcatcgtcatccaaagaccatcagcattggctactgagacaccccggaaacagcatagggcagcagttcagagtctcaggagctgaatagcctgggtttgcttcttactagctgagtgactttggttaacttaactaacctctctgtgtttcagttgcctcaattgcaaaatggacaaaatcattagacttcctttatatggttgcttttagggatcaaatgataacatgaaaagaaagttcctagaacactgtctggcactaagcaagtatcctataaacatcagctcatcatgtgaccttatgtttgatcccccacaccatgctggctttctgatgcacagagagggggagtcagggtcttcctatgtagggaaactgagtattcccctgtggtcagggggccattccactctggactgccccagaggctgctgggtctggatcttcagccacttgagtgcatggggtcaggatgggttgagctgtgttgggtgccctgtttggggcggtggtgcccatgcccatgcagggctgggggctgatgctgtggtccccgcttcagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcaggtgcgtgctcccctgcccagccccaccccaccaggatggtcacactgggccggctcccggtctggctcgatatctggcctctgatcaagttgaactccttgagacccacttatagcctaacatatcaggggccgagggtttccttttgagccttgtctgcagaatcctatcatttactcaaagcaacagttgtttgaatgaacatcagtattccttaggcctcattgcctaaaacccaagattctgaataggagtgagcagttgttgcagatggagtgagcatttcccaaaaaataaactggctgacatcattagaggaaactgcaagtttttttatttttgttttttcactggtttgcagctttgattttctgcccctggattttgtaggtgatcatctgggagctccatgtatgtgtgtgtgtgtgtgtatctgtgtgtatatatatatacacacacatatatatgcatatatatacacatacacacacgtgtgtatatatgtatatacacacatacacacacgtgtgtatatatgtatatacacacatacacacacgtgtgtatatatgtgtatacacacatacacacacgtgtgtgtatatatgtgtatacacacatacacacacgtgtgtgtatatatgtgtatatgtgtatatatacacacgtgtgtatatatgtgtatatgtgtatatatacacacacgtgtgtatatatgtgtatatatgtatatatacacacatgtgtgtgtatatgtatatatacacgtacatgtatgtgtgtatatatgtatatatacacacgtgtgtatatgtatatatgtatatatacacacgtgtgtatatgtatatatgtatatatacacacatgtgtgtatatgtatatatgtatatatacacacatgtgtgtatatgtacatatacacacacatatctgtgtgtatatgtatatatacacacacatatctgtgtatatatgtatatacacgcacacacatatctgtgtatatatgtatatacacgcacacacatgtgtatatatgtatatacacgcacacacatgtgtatatatgtatatacacgcacatacatgtgtatatatgtatatatacgcacatacatgtgtatatgtgtatatatacatgtatgtgtatatacgcacatacatgtgtatatgtgtatatatacgtgcatgtatatatacatatatacatgtatgtgtgtatatacatataaacatatatatgtatatatataatattttttaagaattatactgaggtcgggtgcattggctcacgcctgtaatcccagcacgttgggaggccagggcaggtggatcacttgaggtcaggagttcgagaccagcctggtcaacatggtgaaaccccatctatactaaaaaaaaaaaattagctgggcgtggtgttgcacacctgcaatcccaactactcaggaggctgaggcaggagaattgcttgaacccaggaggtggaggttgcagtgagccgagatcgcaccactgtgctccagaaaaaaaaaaaagaatgtactgagatgtcttatcataatcatagttgcatttgtgaacatgttaaaaaaaaaaaaagaatggaagccattccagggaagtaagaaatatctctgttatttacacatcggcctcgcgttgttcattttgttgtggttgttggttttgtggggcatttgaaaggcatttgcactgggaagagcccctctgcctgtttgccttcctgccctctggtgggagggttccccaccatcatcatccacccacccacaaattggtgatttgggaaaccagaggacagtgtagttcaggccattctcggaggttaggagttctatgggttggaatgttgttcagccaaagaaagaaagaatactgattcatgctcccacgtggatgaacctattgtgctaagggaaataagccaggcacaaaagaccacatattatgtgattcctcttttttttttttttttttttttgagacctcccgaatagttgggattacaggtgtacaccaccattcccagctatttttttgtatttttttagtgaagatgggttttcaccatgttggccaggctggtcttgaactcctgacctcaggtgatctgcctgcctcggcctcccagagtgctgggattacaggcatgagccatggtgcccagccctgtgtgattccaattttatgaaatgtccagaataggcacgttcatgaagaaggaagtagattagtggccgccaggggctgcagtgcagggaaaatggagagtgagcgctaatgactacaaggtttctttttagagtgacgaaaatgctttaaaattagatggtggtgatagttgcacaactttatgaatacactaccaaccactgaatgtacactttaaagggagatggtggaatatgatggtgtgtaagttatatctgaactaaaaaataacaaaagccaaactctagaggatcctaactgaaaaagtacacacttggaactttcaggaatttgtcattgatccaggtttttttttctttaaaaatatttttgatgccaaaggcaatacaccgataacattatgtgtaatgataaagacaggacccttccccatgagcaccctggtttttgctagagtgggacattcccatctccttgttccccatcccattgatatgtgcggaatggtataaggcgaatgtgtgcactcctccatgtgatcgctggcattttgagcgcttgaattcctcaccgttgaggggatgaacaggggtgtttcagggtagctggaaggctttgggcctggaattttcaatcttcaaatgagtctcggatgggacctccctgggaggctgtggtgggtcctttaggtcagcagttcccaacctttttagcaccagggaccggttttgtggaagatagtttttccacggaccggggagggggatggtttcgggatgattcaagcacgttacatttatggtgcactttatttctattatgattacattgtaatatataatgaaataattatacaactcaccataatgtagaatctgtgagagccccaggcttgttttcctgcacctagaaggtcccatctgggggtgatgggagacagcgacagatcatcaggccttagattatcgtaacgagcatgcaacctaggtccctcgcatgcacggttcacagcagggtttgcgctcctgtgagaatctaatgctcccgctgatctgacaggaggtggagctcagatggtaatgtgagcaatggggaggggctgtaaatacagatgaagcttcgctccctcacccactgcttacctcccactgttcagccagttcctaacaggccacggaccagtgctcgtttgggtactggtttggggaccctttctttaggggactgctgtgtgtcatctgaatcatcagcagtcagacctgtcttgttttcccatccagatagccaccatcctggactgccatgcagccaccctgcagcggaaggctgatcgagaggtcttcttcatcaacacccagagcatcgtgcagttggtccagaggtgaatcctgggtctccccgtaggatgtggttgtcacctgaatcgtcgcatgcattgcaccagggtggtgctctggggctgtcttcagggcaggcttgaactgagagaaagtgtgttatagtcctgcagtgccattactaacagcagaaccctgggtgaggtactttacttctgtaaatctctgtttgtaaatctcagctcactgcaacctccgcctcccaggttcaagcaattctcctgcctcagcctcccgaatagctgggattacgggcatgtgccaccatgcctggctaattcttgtacttttagtagagacggtgtttcaccatgttggccaggctggtctcgaactcctgacctcaagtgatccattctcctcgacctcccaaagtgctgggattacaggcctgagccaccatgtctggcctataaatgtattaagttttgtgaagtgctgacaaatagtaaatacttgatagatacattagattgagacaatgggatgaaatagctttatgtatgataaaacactgcaaaaattgttattgtggcttttgggacaattgcaaaggaaagtggatgaataattgtatttcatctcaagtagttatttattgtacaggggtttcccgctgcaggactattctgatgacaaaaggattttctttgtttttttgagatggagtttcgctctgtcggccaggctggagtgtaatggttcgatcttggctcactgcaagctccgcctcccgggttcacgccattcttctgctgcctcagcctcccgagtagctggaactacgggcgcccaacaccacgcccggctaatttttttgtgtgtttttagcagagatggagtttcatcatgttagccaggatggtctcaatctcctgacctcgtgatccccctgcctcggcctcccaaagtgctgggattacaggtgtgagccactgcacccggctgacaaaaggattttctgccacttttcatgaaaaatccacctagcaagaaggctttccttatgaagacaatcagggccaggcgctgtggcttatgcctgtaatcccagaattttgggaggccaaggcaagaggatcacttgaggccaggagttggagaccagcctgggtgatgtagcgagaccctgtctctacaaaaaaaaaagaaaaaaaaaatgagtcggggatggtggtgtgtacctataggcccagctactcaggaggctgaggtgagaggactgcttgagcccaggagttcgaggttatagtgagctgtgatcgcgccattgcactccagcctggggacagagcaagaccttgtcttttatgaaaaagaaaaaaggaatcaaagcattcttggatttgaaccagtaaattccaggcatgtttcccatgtgccagaaactcacaggtacaaagaatgtgagattgtagaaaactggcctccttttcaaggagctcctcagctgttagggagagagattttagtgtggattccccacaaactgcaagtttcacagccaagggctaggaagggagtcctcctaaaacacatagactgctaaccttaagcccatcctttaagcttcagagaaacatctaggaaaaatgaaccattaataaattaactgaattttctagcaagttttctgtgctgaccataaatattaaagccctgtcctgtattgtgtaagtatgttttaaaatcacatttgtatcagagtcttttagcatcttggtctgttttgttgtgatttggtgatgctgccatgaagcgtctacttccccacaactcagtggcgcatctcctgagaaacttgactcctgtgttcagatttttggaagaacatccaggttaaaactttgttttaaaagaagcggctaggtgcgatggctcacacctataatcccagcactttgggaggccaaggcggatggattgcttgagctcagaggttcgagaccagcctgggcaatatggtgaaaccctgtctacaaaatatacaaaaattagccaggcttggtggtggccacctgtggtcccagctactccagaggctgaggtgagaggattgcttgagcccgggaggcagagattacagtgagctgtgattgcaccactgcactccagcctgggtggcagaacaaaacctcgtctcaaaaaaaagaaaaaaaaaaagggagaagcaaaatttacatggggatcttttggtaaatgtttttccagtttgtctttttaaaatggtctctataccttgggtaagtaattgaaaaattttgtttttaacagttaaagcttgctaaaattggctacccctgttcagtatccgaaatctatgaagttttttttttttcttaactctgtggccagaaaggcgccctcccaagtataaggcttgggatctacctactccagttttgcctccagtttgatgtgggactttgggcagggcagtgttctttttggcctgcagatgaatcaactccatatcctttgaaggcctcaggattagagggtgcctctagatactttaaaaaaatttttggctgggcgcggtggctcatgcctgtaatcccagcactttgggaggccaagacagccggatcatgaggtcaggagatcgagaccatcctggctaacacggtgaaaccccgtctctactaaaaatacaaaaaaattagccgagcgtgggtggcaggcgcctgtagtcccagctactcgggaggctgaggcaggagaatggcgtgaacccgggaggtggagcttgcagtgagccgagaatcgtgccaccgcactccagcctggccgactgagcgagactctgtttcaaaaaaaaaaatgtatttttaaattaactaattaattaatttttatttatttattttgagacaagctgtcacccaggctggagtgcagcagtgcaatcatagctcacaacagccttgacctcctgggctcaagcgatcctatcacctcagcctcctatgtagctaggaccacagtcatgcgctaccactcccggctaatttttttgatttttttgtaaagacaaggtctcaccttgttgcccaggctgctcttgaacttctgagctcaaatgatactcacgcctcagcctcccaaagtgctgggattattggtgtgagccaccatgcctggccttaatttttttgttttgttttgtagatatggggtcttggctatattgcccaggcttgaactcctgggctccagtgatcctcccacctcagtgtcctttctaaaatcctttctctctctctcttttttttttttttttttttgagacggagtcttgctctgtcgcccaggctggagtgcagtggtgcgatctcggctcactgcaacctcctcttcccggattcaagctattctcatgcctcagcctcctgagtagctgggactaccggcgcgtgccaccatgcccagctagtttttgtatttttagtagagacagggtttcaccattttggccaggctggtctcgatctcttgacctcgtgatctgcctgcctcggcctcccaaagtgctgggattacaggcatgagccaccatgcccagccaatcctttctctttttaaaaatcataaaaaaaaatactaaatattcaggtactcaaggaagggtgtgagcattaagagcagccttcccttctccccagataccgcagcgggatccgcggctatatgaaaacagtggtgttggatctcctgagaagatacttgcgtgttgagcaccattttcagcaaggcaagagatgctgatgccaacaccagtgggatggtggggggcgtgaggagcctgagctttacctctgtgtggtgttttgtctcccccagcccactacgacaagtgtgtgataaacctcagggagcagttcaagccagacatgtcccaggtgctggactgcatcttctcccacgcacaggtggccaagaagaaccagctggtgatcatgttgatcgtaagcaggaagagggcctgttactagactgggggtgggtcaggagtccacaaacgttttcttaaaagggccagaaagtggctgggtgcggtggctcatgcctgtaatcccatcactttgggaggctgaggcgggcagatcacttgaggttaggagtttgagaccagcctggctaacatagtgaaacctcgtctccactaaaaatacaaaaattagctggccatggtggtgcatacctgtaatcccagctacttgggaggctgaagcagaaggatcgcttgaaccctgaaggcagaggttgcagtgagccgagattgtgccattgcactccagcctgggcaacagggtgagattctgtctcaaaaaataaataaaagaaaaagtaagccagcaagtaaattttttagactttgcaggttggtgtggtctctgtcgtgaccactcaacactgcctttgtacaatgtaagggaatgggcatggctgtgttcccataaaactttgttgggagcccgaggtgggaggatcacttgagcctaggagttcaagtccagcctaggcaacattgcaagactccatttcttagaaaaaaaattaaaactgggcactgtggctcacatctgtaatcccagcactttgggtggctgaggcaggagaatcactcgaggccaggagtttgagacgagcctgggcaacatagggagacccccatctctacaaaaagtacaaaaattagccaggtgtggtggtgtgcacctgtagtcccagctactcagggggctgaggcaggaggattgcttgagcctgggatgttgaggctgcagtaagctgtgatcacaccactacactccagcctgggtgacagaatgagatcctgtctcaaaaaacaacaaaaaaaatcccaactttgtatacaaaaacaggcaatgagtcgggtttgttggcactgggaagatcatgactaatgcaaagcacctagtttgtgccaggtactcctgaagtgctttccaaataaatagttgctcatttaattcacgcagcagtcctagaaagtgggtactgctgtcacagctctttggcagagcacagagaggttaagccacttgcccaagggcacccagctcctaaatgtagagccaggatttgaaccaatagtctgactccagactcatgaactattagccgcaggatattggattttgagtcctgtgtgtggagaagaagaaatatggagtctctgttcttgtttctctttccactcgatgatagcagtcttttgttttttgtctgttttttcttttgagacagggtctcgctctgttgcccaggctggagtgcagtggtgccatcatggctcactgtagcctctatcccctgggcttaagccatcctcccacctcagcctcccaagtagctgggattacagactcacaccaccacgcccagctagtttgtttgtttgtttgtttgtttgtttgtttgttttgtagagatgaggtctcactatgtttcccagtcttgtctcgaactcccgcgctcaagcaatcctcctgccttggcctcccaaagtgctgggattacaggcataagccactgcgcctggccgataatagcagtcttttataactaaaaatatttttctttgatatgtcccttgcaactgacttggaaaatgtaggatcagcagagtaagagcaacttggacttggcttatagtagaaaggggtttggcaatttttttttttttttttttgagatggagtcttgctctgtcgcccaggctggggtgcaatggcataatcttggctcactgcaacctccgcctcccgggttctatctatcttctatctatctttttttttttttttgaggcagagtctcactctatcccccaggctggagtgcagtggcacgatctctgttcactgcaacctccacctccagggttcaagcaattctcctgtctcagcctcgtttagctgggattacaggcatgcgccaccacgcccggctaatttttgtgtttttagtagagacgtggtttcaccatgttagccaggctggtcttgaattcctgacctcaggtgatccaccagcctcggcctcccaaagtgctgggattatagacatgagccaccacgcccggcctggcaacttttttttgtaaagggctccagatagtaaagattttaggcttgaggacgtccaccccctattgccactactcagctctgtgagctctgccactgtagcctgaaaactagacaataggtacatgaatgagggtggctatgttccaataaaactttatttacaaaaacagtcagtaggcagagtttggccacgatctcagagaatagttaataccctgtcccctgtccaagttgcattaataaatattgggatttttggtaaagaatcatttaaaaatctcacgcagcagcttttaatcctggctgtacattagaatcacctagggggtggggagacttaaaaaatacaattgcccatgccccacccttggtcaatttaatcagagtttctaggggtagggcccaggcattagtgctttttgaaagtttccctgtgggaaacctaaatgtgcactgtatattagataatattattggtttaatgttcagtttctttggtgttttaatggttctgtagtaggtggaagggagatatgtgcgaaaatagtgtaaaggattgtggtgtctgcaactgactttcagaaaaagagagagtgtgtatgtgtatgcgcacgtacgttcttattagagaaaaatcaaatatgataatgtggcaaaagttttaacaattagtgaatctaggtgattactatgggtttttaacatactgatcttcaattcttctgtagttttgaagtttgtaaaaattaattgggagagaggactctccaagtgattgcaacacgcagccaggactgggaatttatgcccaaggagatatccactctttggggggagttctattactaaaataatataatgtttttcaaaatacattctttggatggagtttcctggagtttgagtgtttgtcaagcaaaatatgcctgtaatctattacagtcagcttgccattcaaaggcagtgggtctgtgggttattttgctgttcgttcttctgtgcacatattgactctcttctgggcatgaagtcatgaaatatcatgtacaccagaggacagccaagggaagatgggtggagcagcccccagttcttgggaattgggacattttcctggacctccttggtgatagaggctaaaaatgttgaaccaattacagtctcgggataaatgtgagattcattattcttctgactttcttggtcccatttgttagaaaatagtgagttctctgcacctgatggtatttggtacctgagaggttttgaacaaagacttgtgaattgaatgattatttcgaaatgaatttttttgaggcttttaaagggacctagtttctgacaccagttcactggtcatgggacttcgttagtgacaaaacgaagcaaacaaaacatgattctgagaactaaaatatacaagatgagactgcttcacaaagttaacaagaaagaaaaatggtgttgttgttgttgttgttgttgtttgtttgttttcgagacagagtcttgctctgtcacccaggttggagtgcagtggcgcaatctcggctcactacaacctctgcctcctgggttcaagtgattctcctgcctcagcctcccgagtagctgggactacaggcacgtaccaccacacctgactaatttttttgtagttttagtaggaaacagggttttgccatgttggccaggctggtcttgaactcttggcctcagatgatttgtccgccttggcctcccaaagtgcagggattacaggcctgagccaccatgccctgcctagaaaaatgtttttgttattattattattatcttttgtatgtagaaggcaatggttagattttttaacattcacacttagatgtgtggggggaaatttaaaaaatgttcacacaaactcttgagtttttcacctcttagaaaagcaccagtctagctgctggccagcacctgtgctgtctggcctgggagccacatgcctaggggattggtggggagttatgccaccaccgtttaataatagaaagcaaatcagagaagggagaggagatttagaacactttcctaccacatttcttcagcattgatgttcctgtgtctttgtgtatgaaatatcaatatgttgaagttttttctgatgataaaatcagtctcggttcattataataggaaaatgcagaaacacatgtagaaaaaaatgccccacagctctaccatctggtgacctcttgaagaccagtcttagtggatgcccggggtggggaatgggggcatattgctcaggagctctgatatttagcattcattgctccatcttcagtgggtggttagggagcacctgcgctgagctgttcccaagccccatatgcacttagggcataagaggagatgcgaacaccggctgcacccaggcctggtctccagcagaaaggcccttctttcagaagcagagaggagggatgcaacacagacacattgtccctccctctcctgcaagattcaaccccacgtccctctcctctgaaaccgtgagcgccttaagtcaggcagcaatgtgtaggggaaggagcgggaggctttgggggcagaatagtgctgtgttcgaatctggctctgtcttgcacatgtttgctggctttggggtgaggcatattgcctctttgagcctcagtgttcctatctgtaaaatgggaatcaaaataagtaactcttcgtgggggtgggagaatttggggagttgtatataaagggtctagctgtttactagccacctggcacatagtatgtgcctgataatcactgacctttttttttttttttgggggggagacagagtctggctctgttgcccaggctggagtacagtggtgcgatctcagctcactgcaacctccacctcccaagggatgatcaaatcatcctcccacctcagccttctgagtagctgggactacaggcatgtgccaccatgcccggctaatttttctatttttttttttgtagagacaaggttttgcgctgttgcccaggctggtctcaaactcctgagctcaagcgatcctcctgcctcagccacccaaagtgctgggattataggtgtgagccaccatgcctggcctaatcactggctattaatagtaacgtaggcagggacttagttgtatttgtttgttcttaccaggcatttagggcatgttgtggggtggatgaatgggtggccgagtgagtgagtgagtgagtgaatgaatgactgactggggtgggtgcacagtagaaagtggtgagggtttgcataacaggctgtgctgggcctgtttggagagtggagcagccgcctggcttttgcggcaggtgctccccaagtcgagatgagtgctgcatgtttccctgggctggagaaaagccatttggcttctttttctgtcccctaaggatgagctgtgtggcccagacccttccctgtcggacgagctgatctccatcctcaacgagctcactcagctgagcaaaagcgagcactgcaaagtggccctcagagcccggcaggtagggtctcagggtgcggtccccacgatgtgcgtttccccccaccctcctatgtgtcccctaccgtgctcagccctcaccatgcacagtcccaccgtgctgccggcccgtgcccgagcctctgccttctgccctgggaggttggctcacgccagcgcccccatccctccccctgcagatcctgattgcctcccacctcccctcctacgagctgcggcataaccaggtggagtccattttcctgtctgccattgacatgtacggccaccagttctgccccgagaacctcaaggtgagcccgtctccttcctttcaccatctgcagagcacacactgtggcccaggtgggggcctctggggaaacggctcctcctgccctccaggtgctcagtggggtgcagggcacagccacagatgcagacagttcagcccaatgtggccagggctgcccgaggggtcacctggggagactctaggagaggtgggcatggagcccagtcctccaggaaggacagtgtgacagcagtgggggctcacctggtgcagtttacaaacctcagccatatggagcatatctggaagctgtgagccctcctgtggctgagtcgcggcctcatcttccctattcctggactctggctcatttacatgttctcaggtaccccctcagtgcctgatgggagacctgtcccaggtgccgtcatcccggagttcttcaccagctctcctatgattaaataggggaggagcccagcgcgctgcagggcactgatcgcttttagtggtcaaagcatgacttctgcctgctcccaccgcccccactcatcagactggtgattaaaaaacttactcactggctgggcacggtggctcatgcctgtaatcccagcactcgggaggccaagactggaggatcacttaagcccaggaatttgaggccagcctgggcaacatgtgagaccctgtctctacaaaaaatagacacacaaaaaaaagagccacgatgttggcgcacgctgtagtcccagctgctcaagaggttgaggtggggagatcgcttcagcctgggagtttgaggctgcggtgagctatgatcacaccactgcactccagtttatctcaaataaaaacaaagaaaaacctgaaacttgttcacatttacttttccttgtttccccttttcatttcccttagaaattaatactttcggaaacaaccatcttcgacgtcctgcctactttcttctatcacgcaaacaaagtcgtgtgcatggcgtccttggaggtaagcaggagaggcccagagaacagcactgaccatgccagttctagtgttcactgccgctaccatgcacctgaccctaggccacatgccttggtgaatgtgatcctatccttttctcttcaaggtagctatgttaatagtcccatcttacagaggaaggaactgaggctcagagaggtcaagtgacttatgcaacgtcacacagctagaaagtggcagaaccaggttttgcattattgggtctgcctcattccagattccatgctagttaccactgctgtctcatgtcattccagcctcttccaggcagggcacattaaatactaatccctgagagccaagtctgaggcacctcatctaaactttctgactcacgtgcattaaatacctttgaaagacttttctgcttggaactgccagagctagaggagcccaggtgacaacttaaggtgaccccctgccccccgagtgatgaggtagaagggcgtggccagtagcaaaacccagattagagccaggtgatcccaggtggtcttgctcccgggagcaagaattcaggtcttcttgaattcaggaaccaagaagtgttgtgttggttccaggaaatcagagttttaaatctgctcttttattattattattattattattttgagactcgcttgtgcctagggtggagtgcagtggcactatctcggctcactgcagcctctgcctcctgggttcaaatgattctccttcctcagcctccccagtagctgggcctacaggcgcccaccaccacacctggctaatttttgtattgttagtagagacagggtttcaccatgttggccaggctggtctggaactcctgacctcaagtgatctgcctgcctcagcctcccaataaatctgctgcccttttagaatctttttaagaaaatatgtttttaacacggccctcttacccgggtctgctttgctggcagtagtttttccaatattctttatcttctgagctcagagtctcagtcccctgttgcccccactttctcttctgcatccttgggagcctgtgagtcacacagtgagaaggtttactgggtcttctggagaccatcttgggcttgttagcatattacagccacagggtctcctgggcctgcaacttttattcctctatgggtttcacctctggaagaatctttctcaggcctcactctttgtttctaacagggagacctaatacacctcttctgtagttactttaaacacaatttttgttttgttagagacaggtcttgccgtgttgaccaggctggacttgaactgctacgctcaagcgatcctcctgcctcaccctccccagtagcttggactacaggtgcatgccaccatgcttgacttacagttactttttaaagtgctaaatgctgtttgtgtcaattagagatttttctaggatgcttttgggtttttttatttgttttgtttttccaccacgcccagctaatttttgtatatttagtagagatggggttttgccatgtcatccaggctggcctggaattcctgggctcacgcgatccacctgccttggctccccagagtgctgggattacaggcgtgtgccaccatgcctgaccccattcttgacagggaatggtgggaaccttccccaaattcaagttccccagtgctggccaagggcaagtcttttaatggaaagcaattatgtctgctaattgctgtattagctcctgctgcccagttcccgcatttcctgttcagttgaaaagcttccagtgtttaaactccagaactgcattgtccactatggcagccaccagccacgtgtggttagtgagcacttgaactgcatccagtctaaatcgagctgtgctctaagtggaaaatacacactccattccaaagatgtagtactgtatggagaaaagaatgtaaaccatctcaataatttcttatattgattacatgttgaaatgataatatttgcatatgtggggtgaaataaaatatattattaaaattattttttatcttttttctaagtggttactagaaaatttaaaattataggccaggtgaggtggctcatgcctgtaatcccagctctttaggaggctgaggtgggagaatcactgaactcaggagttgcagaccagcctgggcaacataggaagatcctttctttactaaatataaaaaacaaaaaaaattagccaggtgtggtggtgcctgtagtcccagctacttgggaggctgaagtgggaggatcctttgagctcaggagttcaaggctgcagtgggttatgatctcaccactgtactccagcctgggtgatggagtgagaccctgtctcaaaagtaaataaataaaataaagttacatacacagcttgtgttatatttctgttggacagcactgctctaaagcagggtttgataaactatagaccatggaccatatttggcccaccacctgtttctgtaaagttttatcagaacgcggccaggtacggtggctcatgcctgtaatcccagcactttgggaggccaaggcgggcggatcacctgaggtcgggagtttgagaccagactgaccaacatggagaaaccccgtctctactaaaaatacaaaattagccaggcatggtggtgcatgcctgtaatcccagctactcaggaggctgaggcaggagaatcgcttgaacctgggaggaggaggttgtggtgagctgagatcatgccattgcactccagcctgggcaacaagaacaaaactccatctcaaaaaaaaaaaaaaaaaaaagaagaatgcagccacacccattcatttacatgttgtccacagctacgtccgtgctaacagcagaattgagtagttgcagccaagatgatatgtcccacaaagcctaaaatatttactacctatctcttacagaagtttatcaacccctgctctagagtttagagtggattttgtgtaactagtaacactctgaaatatgagcaaatttgctcttaactgctgcttagaaatctttttttttttttaattgaggaaggatttttctctgttgcccaggctgaagtgcagtggtgctatcatagctcattgcagcctcaacatcctgtgctcaagcaatcctcccacctcagcctcccgagtagctgggactacaggcgcctgccaccatgcctggctagtttttgtatttttagtagacatggggatttgccatgttgcccagactggtctcgaactcctgggttcgagtgacctacctgccctggccttccaaaatgctggattgcaggcctgagccactgcacccggcctgcttacagatagatattttagaggtcatttctggtacctgttccccgtgagtgccctcagcttttgagcacactctgcagtggcccctgagagaatgtccgtgtgtttctgccttgtcaggtttacgtgcggaggggctacatcgcctatgagttaaacagcctgcagcaccggcagctcccggacggcacctgcgtggtagaattccagttcatgctgccgtcctcccacccaaaccggtatggagtgggacacacccagggacggcctgtgtttctgttcttcctgacctctgtcgtcctgtctctggaaggacctggcaagtgtgtttgggcacgctgctggggagacatcagcgataagcacttcccctgtgggagctccctgcagcgccattttctcccctctaacatggtgataatgcagagcccacctcctacacctgcactgttcagtacagtagccatgtgtgcctatttacattaaaatgaatgcacatgggccaggcgcggtggctcatgcctgtaatcccagcactttggggggccgaggcgggcagatcacttgaggtcaggagttccagaccagcctggccaacatggtgaaaccccatctctactaaaaatacaaaaattagccgggcgtggtggcacatgcctgtaatcccagctactggggaggctgaggcaggaggatcacttgaacccgggaggcagagtgagtcagtgagctgagattgccccactgcactccagcctgggcgaagaagcgagactccgtctcaaaaaaaaaaaaaaaaagaggccaaacacagtagtggctcacacctgtaatctcagcactttgggaggctgaggtgggtggatcacaaggtcaggggttcgagaccagcctggccaacatggtgaaaccctatctctactaaaaaaaatacaaaaattagcctggcatggtggtgtgcactggtaatcccaggtacccgggaggctgagggagaactgctcgaacccgggaggcagaggttgcagtgagctgagattgcaccactacacgccagcctgggtgacagagcaagagtccatctcaaaaaaaaaaaagagaaaaaacaaagaatgcaaatgagccagccatggtggcccacacctgtaatcctagcacttcggagggctgaagggggcagatcaggaacttgaggcctggagtttgacaccagcccggccaacttggtgaaaccccatctctactaaaaatataaaaatttgccaggcgtggtggcacacccctgtaatcccaggttactcgggaggctgagggatgagaatctcttaaacctgggaggcagaggttgcagtgagccaagattgtgccactgcactccagcctgggtgacagagcgaaactctgtctcaaaaaaaaaaaaaaaaaaaattcagcttctcagtcatactgggtggctcatggctgccatattatttgacagtggagttctagaacattctgtcatggtagaaagttctagtagacaatgccacccaagccattgggaagagtcatgagataaggcacatgtagcattttagacagtgcctggcacaaaggaagttgttgactgtaagtgatcccggagatgatcatgactaacgctgttattaccatctagtggcatgccattggcctgggcactctgctcagtgctcccacactcttttatttatttattttttttgagatggagtctcgctctgttgcccaggctggagtgccagtggcacaatctcagctcccagattcaagcgattctcctgcctcagcctcccgagtagctgggactacaggcgcacaccaccatgctcggctaatttttatatttttagtagagatggggtttcatcatgtcagccaggctgatcttgaatgcctgacctcagatgatccacccgccttggcctcccaaagtgctgggattacaggcgtgagccaccgtgcccagcccacactcttattttattcagctcttatcctctatcggccaaaaatgtgttctcatcctcgttttacagatgggagccctgggccctcacctgacctaggctgagctgcttgtgcacgtggagtgggaatttgagcccaggccacactctcacctccaagtcctttccacagcattcaggggccctctgagccaggtgtgagggcacctgtcctgtctgtgtccactgtagtctgctgtccaagagctgtagttcagtagataccctcagtgttctcacctgagaatatctttttttgatttttttgagatggagtctcactctgtcacccaggctggagtgcaacggcgcgatctcagctcactgcagcctccgcctcctgggttcaagcgattctcctgcctcagcctcctgagtagctgggaccacagtcatgcaccaccaagccccactacttttttttgtaattttagtagagatggggtttcactgcattgaccaggttggtctggaactcctaacctcaaatgatctgtccacctcagcctcccaaagtgatgggatgacaggcgccaccatgcctggctcacctaaaaatatctgatgtgtctgagttcctcactcacagtctttttttcagtccatcttgtttcaggacccaaagtattaataccatttaggtcaggtagagtgggataccttctcttaaagtaattatgtctccttgggattcgaagtgttctctctcacgctccctcacccctctggttttagttcttatgggggtgcccaaggccttacctacggcggcattgatgtcattgtgatttgggagttcggttgatcagatctgtacaggcaatagggttcatgctttggtgaagcggggatttttctggcctcttaggatttttaaaataactttcttttcctgttggttttaagaagaaagatgctgctatgttttggatgaagaaaagggggcttccccacgaggcactgcctttcctagttatttgtttttacccttcttatttccaaaaataggattgtgacattttaccccattgagagaaaggggactgactgcttgcagcctggggtcattctggggatttggagagcagtggtggtgtaagatattttgtagctgtctactcctgagaaggactcttttgatttttttgtttggttgtttagagacagagtctagttctgtcacccaggctagagtgcagtggtgtgatcatagctcactacagccttgaactcctgggctcatgtgatcctcccacctcagctccctgtgtagctgggaccacaggcttgcgccaccacacctggctaattctttaaaaatatttttttgcagagatgggggtctcactatgtggcccaggttggtcttgaactcctgggttcaagtgatcctcctgcctcggcctcccaaagtgctgatattataggcgcgagcccctgtgcctggccttctcttttgatcttattgtcccagcaagtcagccctgttaggaagggaagggcggctctcctgagggctgtgggtcatgccttgtgagctacacgtatatccaggttattggttgtgattttcagtatgggcacagggtccttttttgacccagagagacattgaggaccctgggggattcctggccatctaagattctcatgattgctctcagtgccagaaatgtactctgggcctgtgaagagaccttgcctgcggctgcccccaccaaccagccctttaatgcctctgtaaagggccatgaggaataaagtctatccccaagatggcctggcttggccctcaacacttgtgtgtgtagagccaggcacatggtgctttaggtcaccgagacccaagggaaggtcagatgagaagttggcagggctttgtgccagctgcagcctggacctggacctctgtgctgggtgggaactggctacatccccctgcgatggggctgctgtcctagctctgcccactgttgccctgcaggaaactgaccatcacaaccagacttctccatgattttttccagcagaagcaggaaatctatttttttttaacctgaagtccttccatttttcaatggggacaggtaattcatgttaaatgaatacatgaacacatgttaattcatgtatgttattaaaatgctgcatggaccaaagtcattctgtgagtggcattcagccacactgccactgcaagtttgtgacccctggattgagctgtcggggagcagaggggccatgatcgtgatttcagagcacccaacaggaatgcacacacctgtgtcagggtccccaaaagcacccccaggttcgatcatcgcctaggagaactcacaggtctcgggacatagtcatgcttatagctctgacttattagggggcaaggatacaaagcagttagccaaggcagaaggcatcagggtgaagtccagaggaaagcaggtgtgctgccagggtcctctcccagtggattcacgcagggtgcacttcattcccccagcaaggagttgtgacaacacaagtgaagggttgtcttccagccccgcaccagggattggtggctggtcacatcaccctctgctctgcatcgaaatctcaggcttgcagaagaaagcaggtgttcagcataaaccacactgtttgtgcaaacagttgaggcacagtgagccccccttgtcaccttcagggaacgataggaaccttccccaagtccaagttcccagaggccagccaagggctgtccttgcaagcaagcaggtctcctttctcagaagagcagtgtggggcctgctgtgctgacttcctgcacaccatttcattacccctcccgtatctgattccaaggcccaattctaacaacctcaggtggcccattgagatttgctgctggtgagcagccagttctgggagcatcgttgtctaaactccagaaggctgctgactttgtcccaagggcaagtttgatggagggattacagggagcagaggactggagtgtccgtcaggaccaagcctgactgcctcaccagctgcctggggctggtggatttctccaggagaaattgatgctgggagtgtttcttctctgtggtcaagttcagcacttggggctcccctcgggactgtgttgagactggactctcatgcatgaatcattgattcctacacttgttgagctcttactcttcaccaggtcctgagggatcagatgagaccctcctcaggccccggccccagccattgtctcatcccctgcccattttaagcccccatttggaagagctctaaatctggtccagctcactgaagcttcaggagtaggagcagctcgtagagttgggtctgcaagcagctgcctcatccccgacttgccatcaccttacaggatgaccgtgcccatcagcatcaccaaccctgacctgctgaggcacagcacagagctcttcatggacagcggcttctccccactgtgccagcgcatgggagccatggtagccttcaggagattcgaggacttcaccaggtacccagcatggcccggtctccaacaccctgagcatgggggctgggcagacttcccttgaatccccccccaattcactggacagatggggtgggagagacccagacacgtggcacagcatgtcaataacaacagaataataatagcattgtagccaagagtatgagcctacatgtcagcttgcctggcacagcacatcaataacaacagaataataagagcatcgtagccaagagtgtgagcctgcgtgtcagcttgcctggtttgaattctggctatgtgctttctaactaagagactgagcaaaatatttttacctctccataccttcgttttcttatctgtaaaatgggaataataaaggactcacttcataggtgcgccatgagaattaaatgagataacatatgtgaaataacatatttaaagtataattagtatgcagataatatagtgactaaatgttagctctcaatagttactgttatagtcttttttcagcctttcactgtgtgttctgctttgtgcttggagtatcttgtggaattttcacaacagcctcatgaggcatagggattactcttattacctttctttgactcggggtgaggtgaggtttctaggatctcccagccagtaaaaatgggagccaagagttgatctcaagcccagctgatgcctgaaagcgctggaatccttccctgtattcctgatcacagatcacttaggttcattcttcccttttgggaaggaccccatcacgggtgctctggacaaagtagacagggaacctcctgagctctgtagagttggataagatcaaagggtgttggctgggaaattgggagggtctggcgttccctgctgcctggcttggaagcttgacctcatccccatgggtcagcagcccctcagccctccctctctacccgcacccccagaaattttgatgaagtcatctcttgcttcgccaacgtgcccaaagacacccccctcttcagcgaggcccgcacctccctatactccgaggatgactgcaaggtaagcgtctaagcccagggagcaacctggggagcaggtgggccgtggcccccaggctttccagccctaccccttgcttctccctctcagagcctcagagaagagcccatccacattctgaatgtgtccatccagtgtgcagaccacctggaggatgaggcactggtgccgattttacggacattcgtacagtccaaggtactctgggcgtgcctctggttttggtgggggttcttggagaaggaggaggggctgggctcgtcgaggcggcccttggggaggcaggcgtgctgagtacttcagagccacagacctggcttcccactctagctctgctcgcctcatagctggcgaccttgggcagatgtggctgaacgtggggtcagcatttctctcgctcacggtgttgcaatgattcaatgacaaagtatatacacggcttagccagtcccaggtacggagggcacacccaataaatagtttggagattttctgggagtgtttttgttggaataatccagaaactggcagttttaaaatggctacttacattgatgaccaagtgtgccaataacagcaggttgctctgtaagcctgtgatgccattgtatttcagcctgggggacagagcgagaccctgtctcaaaaaaaattatatatatttacagtatacaatgtgatattttttaattatctttttaataacagctttattgagacatcattgacatactacacaattcacccatttaaagtgtgcagttttgcagccataaaaaagaatgagatcatgtcctttgcggggacatggatgaagctggaagccatcatcctcagcaaactaacacaagaacagaaaaccaaacaccgcatgtgctcactcataagtgggagctgaacattgagaacacatgggcagagggagggtaacaacgcacaccggggcctgtcggggggtgggggccgaggggagggaacttagaggacaggtcggtaggtgcagcaaaccaccatggcacatatatacctgtgtaacaagcctgcacgttctgcacatgtatcctgtttttttttttagaagaaataagaaaaaaagtgtacaatttaatatatttttagtatattcaccaggttgtacaaccatcaccagaatcaattttaggacattctcatcactccatagaaaaaccctgtacctgttagcagtcactcccctctgtccccaacccaaaaaccctctccccaccacagccctaggcaaccactaatctactttctctctatatagatttgcctattctggacgtttcatataaatggaatcagatcacaggaggtctcttatgattgacatcttccacttagcataatgtttacaggttcatccgtgtggtaacatgcagcaatacttcagttccttttacggccaaataatattccattgtgtctttggtttttaatgcagaaaaatatccttgtggattatggactccgacgaatcacattcttgattgcccaagaggttagttcacagttcatctctatgagtctttcccattctccaagccttggtgtgtgccatttatttgatatttattttgtagatttgggtgaaagagatcattagaaaggagaaggatttccaaatgattcattctagaagtgaatgtaatcgtttacaatcactaaataaggatgtacatatttcagtgcgtcttgcttgatttaattgtcttgtgtgtggatttctttttgcagaaagaatttcccaagtttttcacattcagagcaagagatgaggtatggccaaaagtaatgatgttttctcttctctagcatcttgttttattttttaagagatgggatggggccgggtgtggtggctcaagcccgtaatcctagcactttgggaggctgaggcaggaggtttgcttgagctcaggagttctagaccagcctgggttatatagtgagaccctgtctctacaaaaaaattaaaaaatcagcctggcattgtgatgcaagcctgtggtcccagctacttgggaggctgaggtgggaggattgcttgaacctgggaaatagaggtttcagtgagccaaggtgattccactgcactctagcctgggtgacagagtgagactctgtctcaaaaaaaaggaaaaaaaagagatggggtctcactatgttgcccaggctggactcgaacttatggctcaagcgattctcttgcttcagcctcccgaatagctgggactataggcacatgccaccgtgcctcccagctccctggcatctttgatattcatgaagaatatagtctgcagtccttaaggcatccccatattcaagaatgtagcaacttttgtgtagactgcagtcttcctctgggattgtatttccattgagagccctctgttccctgcatggcactcagacctgagaatcttgccctttcagcctcactacaggtttctgtcttgcttgaataattttcagtacttgctgatgtactcagtaagacattttttccaaactgtttttcttatgctcgtctagaacagtggttggcaaactcacttgcagaccagctgcctgtttttacgaataaagttttattggaacacagccacacccgttggattccacattgtctactctggctttcactctaacagtagcagaattgagtagttgtgacagagcccgtatgatccatcagcctaaaacatttactctctggccatttaagaaaacgtttaccgatccctgttgtagaacaggtaggtttattcccagcactgattcaagaccccaccaaattcagcattttgcattttaatttatccaaagctttatttttctagctaagacacatccttttcttaatgtcttcattttttttttcagtttagtttccagtactgtcagttgctttcttttcggggaccaatttccaccaagaaaccaggggttagtggcttcatgagaattgccacaggctgtgacagatggagaacagcctggtcacgctggcaggtgatagggactagctaggttcccccaggagccagcgctgcacccagcacaacaggcttgcaatgcccatagctctcctcagatcttagcaaaaccccaaatatctggagccctgggggtagcttacaattagggaacatcatgaatgctgcattcctgagtgccaaacccatggacaccaggggtctgcagagtagggtgtggaccaagcagggacgcagctccaacgtcacgctgtgtgtgtatgtgtctgtcttctctctctggtccgcctacagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggtaagatgtcgcagagcatttcttcctctctcagaacctggccctcccttccttacattcctgctctgtgctgggtcctgggctgcatgctggggatggagagtacaccaacacccagggtcctgcccttgctatgctccagtccagggcaggaggcggacagcaaagtggcctgtgatcacgtccaggctggtggcacttggatctgtttcttgtattatgtgggtctctgcgcatgagaagaaaatttccaggatagaaaaatactggtttgttcagggaatttcttaatatttgctgactgagtgatcgttttccattgtttcttgcatttagaaaagtaatccatggccgggtgcagtgacccatgcctgtaatcccagtactttgggaggctgaggtgggcggatcacttgaggtcaggggttcaaaaccagcctggccaacatggtgaaaccctgtgtctactaaaaatacaaaaattacctgggcgtggtggcgtacacctgtaattccagctactcaggaggccgaggcatgagaatcgcttgaacctgagaggcggaggttgcagtgagctgagatggagcccttgtacttcagcctgggggatagagtgagaccctatcacaaaaaaaaaaaaaaaagaaaaaaagaaacagaagtaatccatgattatattgtgaaaattttaaataagactgaaaacgatttttaagaacctagcgcaaggaccgagaatcctgtcactgaggggccagcttagttgttgactgtttctagacacaattccgtccctgaaacctagagttgtaggcataagttgcagataagagctgagagtggacagatcatttgaatatattattctttaattggtcagtcacttgtggacctctttcattgttaataaagagtggtccaccacatattatttccttgcatggatgtaccgtgtataattttttttttttttttactaatcccctattgatggaaacatatatatattattatatatataattatatataataatatatataatatattatataatataacatataatatacataatataatatataatatgttatataacattatatatacataatataatacatattatatgtatttatataaatatatatttatataaatgtatatataattattatatatatatatttttttggagatggagttttgctcttgttgcccaggctggagtgcaatggcacaatctcagttcactgcaacctccgcacccccgggttcaaacaattctcctgcctcagccttctgagtagctaggactacaggcacaccccaccatgcccagctaattttgtatttttagtagagatggggtttctccatgttggtcaggctggtctgaaactgccgacctcaggtgatctgcccacttcggcctcccaaagtgctgggattacaggcgtgagccaccacgcctggccctattgatggatattaagctaactgcagtttttttgctacctgtcagctagatgttttatttttattttgatacagagatttgctcttgtcacccaggctggagtgcagtggcgtgatcttggctcactaccacctctgcctcccgggttcaagcgattctcctgcgtcagcttcctaagtagctgggattataggcgcccaccaccatgcccagctaatttttgtatttttagtagagacggagtttcaccatgttggccaggctggtctcgaactcctgacaactgatccacccatctcggcctcccaaagtgctgggattataggcgtgagccactgtgcctggccaagccgttttaataggttttattattgttgaggtatggtgaggccaacagataaggagacaactgccatcaaaaagacagtttattactcatagttcccaagaagaaggggttttccctgccatggggccacatggggaggctctggggttggtcaggcagcagagggacagaggggaagacatggaagacgtggacgagagccttgattgtggtttcctggagaagaaaaaagtgaggctgagtaaacaggtttaggattggctgtgaatcatctcagcagaccctggcatatagaagctgtctctggttctcaggaatctggccctgggtgattagagcaggtggtttgtgtccccaggtatgatccagggtcagcaaggccccaggtgtcaaagtgtcagaatgcagaaaataggacacatgtcaatacactcaacagctttgcagtcccttcgcctctgagaggcagggctctgctgttcttgcctggcacactttttggaggaggggaatgttttcctcctgtctctgcctctttggggctgagtttccagccagctgggagtaggcctgcacccctggcctgagcagctgcccctcccactctttggcaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaaggtctcgcctttgcaggggggctctcaccgggctctgggttcaccctctgagccatgctgctttggggtattgtctcttgccactcaagacctgggttccaggatgaaaccatgcgtatctgagcctcagttgctgcgggaggagagcaaaccttctgccattcaattctagagctatgttttagccatgccctgcacgggaatgctttactttaaggatgacaagcatgctcaaaatgtctttcaaaacaaaattttgtcctttccctggttccaggctgcgctggggactgcatgtgggtggggagagacgtgagaccgtgaggtctgtggctgaatgttccctgtcaggtggctcttcacgagcagacagacttttatggtggtgattctggaatgaaagaagccccacttgtaatcccagtactttgggaggctgaggtgggtagattgcttgagcccaggaatttgagacaagcctgggcaacatggagagaccctatctctactaaaaattttaaaaattaaaaaataaaatattaagattattaatcaaattaatattaatatcgatatattaatattattaaaatatataaatgtattttattttattatttaataatatatattattaaaaataattaatacaatagtattattaaaaagagaagtcctgatacatccgtttggtatctgggggattcaggggacccatgtggaggctctggcctcactagttcaggtagttccagaaggaagcagtgcaatggcttgagtcaaaggcatgtaaagatagtataacatagcagtactagttcagtcacttatcagcctcagtttccttatctgtcagtgagggattagaaaagctcgcctctcttgagtacttacgaaggcaaaatgaggtagagttttaaatgcttagcaagagccgttgcttgttattagttaatactttttgttggatacacactatgtcccaggcgtttttgcagtcagtatatctcatcctcttattagtatcagtgctattgcaaatgtccttgggatgtcttggccctgaaactggaattgctgtgttttggggcagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatgtaaggctggcccgcgccgtgggggtctaagtcaaagcagaagcaggctgcttgggccatcaatttgtagattaagatggcatttggaggcggtcttgccttgctctcccatgtcattctgggttggggtagccccctctgagtgttatgttaaatgtgttagcctttgaatcttggtttttcactcacctaaaaaggagagtgaatctccaagtttaatccattctgtggccatgttggatttttgatagagacaaggtgtcaccatattggccaggctggtctcgaattcctgacttcaagtgatctgcccgcctcgacctccaaagtgctgggattataggcgtgagccaccacgcctggccatatggccatatttgggataagttgtgcactactgtggttgactgtaatgcagtcctcagattggttcacttagggaaatactttcccaaccatgttctaggacagacttttgtaaagtgaattaaatgttcttttgactgccatttaaattcctatgtgtgtacataaaaatatacatatatatacacgccattttttaaagagatattgcctagactgggcctgaactcctgggttcaagcaatcttctggcctcagcctcccaagtagctgggactacaggcacatgccattgtgcctggtctatgcactttttattttggagtaattgaagactgaagactctcaagcagttgcaaaattagtacagaagaaaaaaaatagtgcagaggattttcacccagtttcccccaatggtaatgttgattgaacttcaccattgcacatcattaaaacaggaaattgacattggcacaggactgttcgcaccaacactgaccacgttcggatttcaccagcgtttccatgcatgcctgttgttgggagtgtgtgatgccttgatcactgtatttttggaactgcattccacagcccctgttgtcccttcttgttctggccctccacagtggtgaagaagggagttttacgtagcccaggcactcactttgtcatgccatgtgacatgctttgcttcccccacctgcattttcattgaggactgggcagaaataaattgggggagatgtgtgattctctctcactctctgttttccctcctttctggtccagatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggcaagtccggcggctcagacgcggtaccccctgggtcctcccagcagactccaccagaaccaaagcccatccttaattctccttctaaagacctagtctaaaggacaaggtcttgccaggtgcggtggctcacgcctataatcccagcacttcgggaggccgaggagggaggattgcttgagcccaggagttgaagaaccccatctctacaaaatatacaaaaattaaccgggcgtggtggcgcatgcctgtagtcccagctacttgaaggctgaggcaggaaggatcacctgagcctgggaggtcgaggctgcagtgagccatgatgtcaccactgcactccaggctgggtgaccgagtgagaccccgtcttcaaaaaaaaagaacaaggtctgcattgaagaaaaagaaatgaatgtgttgagaacgacttcatagtatttttctccaaataagactaatttatcccaatgataaaagtcataggatatagaaacttcagaaaataaaggaggttggaacaaagaaaaaataattcctagtcccacactctgatgacaaattgcttaacattttgatgtgtttccttctggtctttttaatggtcatttattaagtacctgctacttaccaggcaccattcgaagtctagacagctgtgggaaagaggagggggtcactgccttgagtaatttttagtctactcttaaaaaataatgttttgggttgggcacagtggctcacgcctgtaatcccagcactttgggaggctgaggcaggtggatcatttgaggtcaggagtttaagaccagcctggccaacatggtgaaaccccatctctactaaaaatacgaaaattaaccaggcgtagtggcaggcacctgtagtcccagctactcgggaggctgaggcaggagaattgcttgaacccgggaggtggaggctgcagtgagctgagatggccccactgcactctagccctggtgacagagcgagactctgtctcaaaaacaaaaacaaaaacaaaaaaataatgttttattatgtttttctgatgattaaagtatacataggaaactatggaaaggtaagaataaggaagtaaaattctattcatatgtaattttcccaccatcaatgcctgaaagaacatttgggtgcattttcttcaagtattttttatgcctttatatgtttatgccctaggggctttaaaggagcctgaaccactgacattggtgatgtgaatgtctcttcattttccaggattgctttggaatgacattatatatatatatatatatttatttatttatttattatactttaagttctagggtacatgtgcacaatgtgcaggtttgttacatatgtatacatgtgccatgttggtatgggatctaattaaactaaagagcttctgcacagcaaaagaaactaccattagagtgaacaggcagcctacagaatgggagaaaatttttgcaatctactcatctgacaaagggctaatatccagaatctacaaagaacgcaaacaaatttacaagaaaaacaacaaccccatcaacaagtgaatgacgttcatgaaaccaaggtcaaggaccttccagtgtaggcaggaagcatctgttcctacctctgcctatgcctcatgcatagaggatatgaaagagtaggaaaagctgctctttagagtaactcgggcctcagctcgaatgctggatctgtccccttgcttcctgctgtccctagccaagttccttcacctctctgggcctcagtttcctcttctgtaaaataagaataataacagtacctaccaaaagttgttggaaaagtgtatgtattcagtgggcgcttaataagtggaaacttatgattaagaatgtcattgtctgtatccttttgcctttgacctcaagagctataagggaagaaacatgactgaaccagaagcaaatccatcgtctcttttttagataaatccattgtctcttttttacaggcatgagccaccatgcctggctaatttttttatttatagtggagacagggtttcactatgttggccaggctggtctcaaactcccggcctcaggtgatctgcctgcctcagcctcccgaagtgtttggattacaggcatgagccaccacacccagctgtctgtctgtctgtctgcctctatatctatatctatgtctatatctatctatttatctatctatctatcgagagaatggaaaactgaacagcagaccagagctaaatttatcaatatggataaatctctcaaacaaagaggagtagaaaaagtaatttgctgccgggcgtggtggctcacgcctgtaatcccagcactttgggaggctatggtgggtggatcacctgaggtcaggaatttgagactagcctgaccaacatggagaaaccctgtctctactaaaaatacaaaattagccaggtgtggtggtgcctcaacccgggaggttgaggcaggagaatcactgaatccgggaggcagaggttgcggtgagctgagattgcgccattgcactccagcctgggcaacaagagaaaaaaaaaatagaaaaagtaatttgcggaaggatgtgtacagtgtggtactctttatttaaagtttgcagtgcaaaacgatattgtatgtttccaatgtatgcatacaggataaaggaaaatgaaaaaaaaagcatgcataggactgggtaggcactgaattcaagggaatggtcacctgtgggttggagttgggaggaagaatgagctggggcttcaatcgcatctttcttctttctttcaaaaactttaaacaactatggaaaaatcaagatttgacagagccactggatgggtgctcatatttaaatatgctttaaatatttcatgattcaaaaagagagagtgaactacagaattcaccctggaatcatgacagatcatctctgtctgggaaagatagttcttccctactgatgacttcaagttttttctctttcctcttctctccccaggctctctttaaactgtggggctccccagacaagtatcccaaagacatcctgacatacactgaattagtgttggactctcagggccagctggtggagatgaaccgacttcctggtggaaatgaggtaatagctcagcggagcctaacccctggctggagtcacccccttaaaaatatttttgggccaggtgcagtagctcacacctgtaatcccagtgctttgggaggccaaggtgggtggatcacttgaggtcagaagttcaagaccagcctgggctacatggtgagaacctgtctctacataaaattttaaaattagctgtgtgtggtggtgtgctcctatagtcccagctactcgagagactgaggcaggagtgattgcttaagcccagaaagttgaggctgcaatgagctgtgattgcaccactgcactctggcctgcgcaacagagcaagaccctgtatctaaaaaaaataataataactaaaataaaataaaaagttttcccccaaagaaacaaactcattttccttgtgcattcatccccttgccaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaagtacgtcgtgaaactggcggggcagggtgattctgctcagctactactgtattttcagtgggagtgctagcacctgcaagaggtgaaaaaaatctcacttatgtataaagcacagatgtacatgtagtgtataaacaggcatacagtgtatcagtgatactaacatttcactgtggcgggggggatggtgatgagaaaaaaaagatctaaaaaggctccttaacggggataatgaaaaaagtctataaaccctgagctgatatacactgagcgctcctgaatgcagtgtgcactgagaatgcagaggtgattgtgtcaactccctggcctcatagcgttcttagaattatggctcacacctgtcatcccagcaactcaggaggcttgggtgggaggatagcttgaagccaggaattcatgaccaagctaggtaacctaggcagcatagccagacttcgtctctactaatgaaaaaactaggtgagcatgatggtgcctgcctgtagtcagcctcagctacttgggaagttgaagtgggaggatcacttggagcccaggagttcaaggctgcagtgagccatgatcatcataccactgcactccagactgggcaactgagtgagaccccccatctcaaaaaaaaagaaaaatctttggggagttgtatagataccagcttgccataaaaggcaagatgaatgagggaagcgcacgcattctgtgatgtgaaatgacaggggacagtcatcctttccattcagagcatgcattctcgggggcgatattgcccactacccccaagaagacagaaaaataatttttggggtggcaataaaatagtttttaacatatatacatatacagagtatgtaaatagtggttaaacagtgtatcttgaaaattaaaatttcatgttggggtgctggcaataagaaataaaaatgagatagtccttagaggagagcttagctcaaagcagaacttcagtttatggctgttattaatacggtatttacatgagatgtgttaatgtgtcattgacatgttactaacatgttattaacatccatccctacgatgttcacattaagaaaaaaaaaacagtggctttcagtgcagggaactggattcgtagcctcactaaagtattttttaagggatttaaatacctgtacctgactccccaagactacaccagaatcagctccctgaactccgtccactgtaaacacatcgaggaaggaggagagtccaggtaaataacttatcaggtagctccttaattttgctcatggttaatttcagctgtcttctttcctcggggcttgtggcgatattttccagtggggtggtggtgtttgtatgatgggaaccaatgcctgttgggggcactgatgccttaaacatttgttaaactctccaaggtgagtccatccttgtcattctaaaatgagtgactcctttcacaaaaaatagcacgtcatgtagggagaatgagattggattctcgtgaatctcctaggagccgcaggctcacattttgtgaccaaactgatgcagcggtgacttggcaaactgggaaggtatgggtggggcagagagaggtctgttcttcgagagcattcaaaggctactatcttttccaggacaagttatgtttttctcagtgggattaactgactcaggatttcctagactgggttttttgcaatgttagtgacaagctggggggaaattccatagtcagatgagtttgggaaacactgggttaaatgagatctcataaacatctttattgcagaccttcttagtacctgtagcatgctgtattagtcagcgttctccagagggacaggactagtaggatatatgtatatatgaaagggactttattaaggagaattgactcacatgatcataaggtgaagtcccatgataggctgtctgcaagctgaggagcaaggaagccagtagtggctcggtctgagtctaaaagcctcaaaagtagggaagccaatagtgcagccttcagtggccaaaggcctgagggcccctggcaaaccactggcgtgagtccaagagtccaaaggccgaagaacctggagtctgatgtttgagggcaggaagcttccagcatgtgagaaagatgaaagccagaagactcagcaaggcagcttactccaccttctttcacctgctttttctagccgcgctggcagctggatgactggatggtgcgcacccacattgaggatgggtcttcctctcccagtccactgactcaaatgttaatctcctctagcaacaccctcaaagacacacccagaaacagtactttgcatcctaaagttgacacttaatattaaccatcacacatgctaaagtgcattgtgaatctctaacagaggctggcgggacagtgtttctcattatgtggccctggaatttttgattgattgattgtgaatgggtttcctctgtgtacccccatctctctgtagaccgttggaggaatatgggccgagggtgatatttcactgagacagcccctgaacaggcagatatctttggttgtataaaccaaaaagtatctgagacaggtctcaatcaattgagaagtttattttgccaaggttagggacacatccagaagcaaagaacacggaatcatagaaaccgtctgtggcgtgtacctttcttcaaagatgatttggagggcttcagtatttaaaggagaaaagcaggctggaggggaaagagggaagttctggtaatcacatgttgcaggagaaaaggcgcaggcaggggaagtcagttatgtattcttcctgcgctcagtaagtcagcactttctataagataaggtggacatagaggaactacctgtggagatatttcagcttttatctgtatctatctgcttactaaagaaacaaaaggaaaggcagcttgcacaactcagcttcagcttaaattgttccttttggcattgtgaatcgtggtcctagtttttattttcctttcacagatgggagcagtgtgatgatttatttatttatttgagacagaatcccgctctgtcacccaggctggagtgcagtggtgtaatcttggctcactgcaacctccacttcccaggttcaagcgattcttctgcctcagcttcccaagtagctgggattacaggcgtgcaccaccacgcccagctaacttttgtatttttagtagagatggggtttcgccatattggccaggctggtctcaaactcctgacctcaagtaatctgcccgcctcgtcctcccaaactgctgggattacagagcagggtgatgattgttgatgctgcacttgcccttttagaaatcttagcactcattttgagggttctagatgccaatttcattttgcctctggatgctttgtctgcttccaatctctcaccttgctgcccagtcagtcccttcttgggaaatgcatccaccttggattttttggggctagagcccagcctttaacctgtgcttgcttttgaagatacatgatcacggatatcatcgggaaggatgatggcttgggcgtggagaatctgaggggctcaggcatgattgctggggagtcctctctggcttacgaagagatcgtcaccattagcttggtgagtcttcttctattttctcttacttttcaactttccattatagaaactttaaaattgtcacaaaattagagagaatcaataataagccccatgtgcccgtcacatacctcctacagttaccacatgccagcccactgatatttcctcaatctcacccccatcccctgcacctgttttagagtattttaaagccagcccccatcatgtcttttcatccataaatacgtaagggtagatctttaacagataatgactctcaccctcttcccccggtttttaaaaacataactgaaatactaatattacacccaacagaatcagcaatatcattgaaacccagtgtggtttaacagttatctcaaaatacccttttctagtggtttgtttgaatcagggtccaatctcatcttattttcaaggtactgaatgtttagaagaacttttctctgactttaactggcatataaggagtagtccccatcccatccccatggcctttccaaaaatgttttctgtttctagtagtagtactactgtagtagtagtagtagtactagtagtaattctagtactagcagtggtggtagtagtggtggtggtagtagtagtagtggtagtagtgtttgtggtggtgaatctgtatgggtctaaggcagagtgagagaccgaggcaagtctctcagcaggagtgaaagtttattaaaaagttttaaagcaagaatgaaatgaagtacacttggaagagggccaaacaaggcaacctgagagatccaagtgcctcatccaacccttttgaggttttatgcattggcatgattccagggtttgtgtttcttctcccctgattcttcccttggggtgggctgtctgcatgcacgtggtctgccagcacttaggaggggccgcatgaacagtgtgtttactgaagttgtgtgcatgctcacttgaggctttcctcctttaccagtcgagtgttcctagaagaagggcacggtaccagataaactctgccatcttacctcttagcatgcatgcttgagcccacccacccagctcctgagatcttatggggaagctgcttatcactagcttcaggtgttttctatctatcaggagattgcctttccctggagccagctgtgaccaatattaattttagagagacactttagcaactgcctaactatcacctgatggttgccttcctctcctgccctgctcatgtctgcttaactacctactctaacagcagcagcagcaggaataatagtactctttaatgataaactgccttggaaggccttatttgtacatgcaatgttgaatcttcagtttccaagtggaaaatgttggtcataagcatcttccttgggcttgttttctagattatatgtatagtctttttattttgaagtcatctaggacccaccgtaagttataagatactacagagaatttccaagtacccttcacccagcttcccctatggtacttacataaccgtagtacattatcgaaaccaggaaactgacattggcacaatattgttaactcagtacagaccttattttgaatttcaccagtttttacatgcactcctaggtgtccttttggttgttaagaggctgcaatggcccatgaatgcccaggctcagaagagctgcacacaagcctcttaaaatctgaaacattcactgtctgctgcttgtctttacagcaatctttgttaaccatgttatttccagataggaatccaagctcaataaagtggcctgaagaataggcttttgcctctactgtggtttggctccaaatcgggttgccattggtcaaaacataacttccatttggtcccagcaggttcctggactcttccctgctgtggggggtgggtccctcgccactctccagaattcagagggggtcctctctccacaggtgacctgccgagccattgggattggggcctacttggtgaggctgggccagcgagtgatccaggtggagaattcccacatcatcctcacaggagcaagtgctctcaacaaggtgaccaaaaaggggcctgtgcagagtggatccttgggggccaggagtcattttaacattcccattggtctctggtgggggatttttctcaatatgaagccagtttcattcctactgatacaagagctctttttttccaatttgcagctatctgggtccttatgagaaaaaaaaaattagttttaggcaattctggtcgatctaactccctgtattactgacattttaaaacaaattattgaagtgccattacacattgcagaaaattagaaaaggaaccccccaaaaaagtaattttgcagcttctatcattctggtatagttccctctcatcttctgtctttatgtggttaatttatagtgaatatgcagttttgtattctacttttttcactgtattaaaacattttccttgttgaaaagtctctatacttaatgtctgctcaaatctcagccaaagtctcaaagcctggttcttgaaccaacagcatcagcatcagatgggaacttgtcagaaatgcacatcctcaagccctgctgcagacctgctgaatcagaaacactagctagggttttgcttttgagatggtcaaggtagaagtcagctgcatcaccagttctcaaattggcctgcatattggaattatctagaaactaaaaaacaaacaaaacacaaaaactaattcctcgaagattctgatataattggtctggatgtagcctgagcatcaggatttgtgaaatctcctgggtgattctaatgtgtagccaggattgagaagcactgagatgatttccaaacaggtggtagagccctgcaccgtgcaggacattgctaaccatgttgtgtcaaagcaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggtgcagtactccccctgcagcttagaacctggaagactcttattaagctcattggctaattctgtccctgtcacctcctgggtggtgtgggaggctgaggagcaggaagcactgcacatgtggctggggttgatttttcttactccttcttccttctctgatgcccagccctgtactaggtgtcctttgctcttttggtggcactaatgccattgtaaggatgctatctgttaatcctttagaaagaggtagtattgcctcttgacaagaggcagcattggacaatactgagtctttaagctttacagtcaggctggatttgattcctgccttcctcctcggtagctgtaagacactgggagagtccctaagtttttctgagcctgtttcctcatctgtgaaatgagaataataatagcacctaactcatggtgttatcatgatgattaagtgaagtgatatttaaagcacaacgtttggtaggtcctcaccaaagtaagaaggggacaatcgtgggcacagttcttggttaactgtaacattccttacaaatgagtgaggttgtcattcttcattataaccatttctgagaggttgggtttacagagttcaggtcattccagatcttctgccaagaaccccaagtcacaaatgtcagtttgtattcccaagtgccccttttccccatctgcatgccatctgttaccattctctgcaaccaatctctttttctttcttttaagatgtttttcctcctatctgaccatatatagcagtagcaaccctttcctgcgtttctgtaacttcccagcatcagtgacaccatctgaaccgggaagcacactcaggagttcataaactagatttcagaagaatccatgggatggccagtccttatctggcattttccaatcagagcagtggcttcaggagccctagggaggggatattgctgcataaccaggcataatcatagtcagaggagcaaagtgctgatcagaggtattattgacaagcaccacagactaagtcagagacttggctttcttttttaggataatcacagccctgtccctatcatcacacccactgaccccattgacagagaaattgaattcctcccatccagagctccctacgacccccggtggatgcttgcaggaaggcctcacccaagtaagttctaaagtattttgcctaggacctggtctcgggtttctttctagggcttgagacaaaggagcactttgtctcaagcgcttgagacaaaggcttgatattcgttctcatatcccagagaggtatacctgaaatcaaatgcagggaaagtagagaaatggagattttactctaggcttttcctgagccattgaccaagaaggggtggaaacagcctccagtttctggagctaatagatggaggtggggtgcaatggtggtcctggtctccctcccctgatgctccatgctccgtggtctctaactgccccactgtctcatcagtagaaaattcagtgctgaaacatcagagtttcaaagagaagactgcatctttctctttctttctctcttacaaaggaactctgtgagtttacacaggataggcaatctggtctcctcttctttttttttttttgagacagtgttgctctgtcgcccaggctggagtgcagtggcgcgatcttggcttactgcaatctctacctcctgggttcaagtgattctcctgactcagtctaccgagtagctgggattacaggtgcctgccaccacacccagctaatttttgtatttttagtagaggcggagtttcaccatgttggccaggctggtcttgaacacatgacctcaagtgatctgcctgcctcagcctcccaaagtgctggaattacagacatgagccaccatgcctggccaattttacctcttctatacctacacacacacacacacacacacgcacgtggacacgtgaacacacatgcacatgcacacacatttttgcacacacacattctctctctgaaagggatgagtttctctcttggaggtatattatttcagtctgagcaaccagaacacaacaggaaagttgagctgctcccgtcactatatcccaaatctagaatttcacatgctgctacctttagacttggctgctccttggctgtgcaatgcaggagaggtgaccctcgggagtgtgctagactccagccagtgcaaggagtcctgtggcttccttctcttgcttttcatttctcttgggctttctggcctgtaaacactgagggggctgcttatctcaattaaaaaatgttcggcttctcactgtcaggccagtcctcggcagatgctgaagctgtgctgttgcatgcctgggtgccgggcctcccatgcctgagatgcctcttactctggctgccccctcctggtcagagccacagccatttacgctgttgcatggatttaagtcatcatttcttccccaccaatggctgtcattgacatcatcatattctctctctgtctctctgggaaattgaaacttttttcccaattaagtggttatgaagctgcagccagcagctagcaggtgagggatgagtttttcgggaaaggtggtcccttcctaaaatcccaccttctggaggtgtctgtccactctctgcatcttaggaagagaaggcagagaccatgattagaatctatgtgtttggagttggctggctgttgatggtagtcacatattccatacagactgaattcttgacttggtatatttattgcagccctgtttgtcttttgaggcattttgggaaggagggaaggggttgggctgtgtggttttaggtagaaaggggtatctgggctatgaggttaaagccaggctgtccttagggagcttttgcacagccaggagtgtcctgggggcccccagccacctggccctccagcctgggcttctgcccttctgtccacagctctgaagggaacgtggcagagcggattctttgaccacggcagtttcaaggaaatcatggcaccctgggcgcagaccgtggtgacaggacgagcaaggtaatcatgaagacgggagcaggctgcccatgtctgactcaccaggcattggggccccgaggtgtgaggccagggacctccaggggcaattttcttcttggcctcaggattttctaaaagaaaaaaccaatttggggaatgatttctgcagtgtctgtgtgtgcccttagaaggtatctcagccagcctcctcctgaggcctgggaccctgtagtcagtccccaggccacaagggctaacaacccctttgggcatcagaaggtggccttgggtgctctccccagaaaacttcacagacactggcactctgaattccatcttaggagagccatggacaggagccctgttgtatgccactgttggtgggaggctgcaatgcttgcatgctttccaagctgggcagctcacccttcagccttgtagctttcatctctttggacagctccacctgcctgaaagttcctccttataatgagccccgagctccctcctcatcatttaccactcattcctggtacgatgtcgcagctataagtccaggctctgcattagacctgaggccaagccccatctccatcactcaccctctctggtccttcacatctgtaaaatagggataataattctaccccaaaggattattgtgatgattagatgcaataacatgtgtgaaatatttaaaatcgacatactccataagtgggaatggctgctatcatttacatcttcggcaataaatactaaagtgcagccagggccgggcgtggcagctcacacctgtaatcccagcacgttgggaggccaaggcgggtggatcacctgcagtcaggagttcgagaccagcctggccaacatggcgaaaccccgtctctactgaaaatacaaaaattagctgggcgtggtggcaggcacctgtaatcccagctactcggggggctgaagcagcagaattgcttgaacccagaaggtggatgttgcagtgagccgagattgcgccattgcactccagcctgggtgacagagcgagactccatcttcaaaataaataaaataaaataaattatatttttaaaagcaaaaaataaaaaaaaaaaaatccactccttcttccatgtgaaaacactttgatttgaagactgctctcccccacccctgcatcatagggtaaacgagaaccatgtagtgatgcacagttcagtagcaagtaactgatgtcatggcatcccctgagctgagtctctgtccagttcaatatccctcagccctttccaagtgcaacttgatgtctagaccagtgtagtagctgctggctacatgtgatgctttagtttcattattattattattattttgagacaaggtcttgctctgtcacccaggctggagtgcagaggcatgatcgctgttcactgcagccttgacctcctgggctcaagcaatcctcccacctcagcctcccaagtagctgggactagaggtgtgcgccaccacacctagccagtttttttattttttgcagatacagggtctcactatgctgtccaggctggtctcaaactcctggactcaagcaatcctcctgcttcagactctcaaagtgctgggattacaggcataagccaccatgcccggctccttcagtttaaattgaactaagtcaaagtgacagaggatgacctgttccattcctcacacttgccacgttccacgtgcagcccacagctcctgtattggacagtgcagatggagaacgtggccctcgtcacagaaagttctagtggttcatgctgctccaggccctataccatcccagccctcctctgatggttcttgcctcaaaaagggcaccaataggtctgctacctttcgaggctcttaccatttgggggctttttctttgccttccaataaaataatccgccagattaaaaagagcattctcctccacgtgccctcacccccacacccagaggtccccaaatgcacctggggtgctgcccagggcctggctcactggtgctcattttccaggcttggggggattcccgtgggagtgattgctgtggagacacggactgtggaggtggcagtccctgcagaccctgccaacctggattctgaggccaaggtgagggggccgggagctgtggctgctggtttagccagcggtactgtcgagagtgggtcctgggcgtgggggtcccatccctgccctgccaacttaggtggagaagcaggggacccagtgcagtccctggccctggggggctcagtgcctgtttctctgacactttctctatgggttgcataaatggctgcaccatcttgcttcttcctcagcagatgataaaggtccctagaaacccctcccacctcctgccctgcctctgttgctgtttctgcgctaggccagggcacagactgagaagagctcaggagtcaagagggctgggttccagggccggctttaccccaactcagtgtgaccttgacgagcttggcacccctcggagcctgtaaaggagggcaacgggaaccttgctgggctgcaatgggagggtcagcctggtcctgagcggaggagatggggcttccatccttctgagccctggctctggtgctggggccagcacagatcagatcgcctgccatccagagcgaggttctggcagccgtccctctgtcctgggttgtggttgtgcagagacatctgatccccgcagctctgtgttccagataattcagcaggcaggacaggtgtggttcccagactcagcctacaaaaccgcccaggccgtcaaggacttcaaccgggagaagttgcccctgatgatctttgccaactggagggggttctccggtggcatgaaaggtaagcccctccctgcctatgttaccccaaagccttggggtcagcacccaggacagcaccctctgggtggtgatgctaatgtcctagtctgtgcccatcatcatcttagctgtgtctcccaacaaccctgaggagaaaatattgttcaggtgccccactaccccgttttaaagatgaggaactgctgggcacagtggcagacacctgtaatcccggtgctttgggaggccaaggcagaaagatcatttgaggccaggagtttgagaccagcctggggcagtatagcaagaccctgtctctacaaaaaaacaaaataaatgtttaaaaaattagctgggcatggtggcacatgcctattgtcccagctatttgggaggctgaggtgggaggattgcttgagcccaggaggttgaggctgtactccagcctgggcaacggagtgagacccccatctcaaaaaaaaaaacaaaaaaacaaaaaaaaaacaatgaggaactgagggttggaggcaaagtgtcactttctagaggtcacaccatgaggtgcaggtcagggaggggcagccccaggagctgccgggtgacctgggcaggcacctccccatttggcaaggtgaggaggatgtttgtccacccttccctctgcagaaagctgctctgagcctcatgtgaccttacaattgtgtgagggctttttaagccaccaagcatgttttgggagagagtggctgttggatcactggggtgttgaggacagagctggatgggaggcagacagacctgctgtgagtccttgttaactgggtgacatcactgagcctcagtttccctcctttgtaaaagggggttaagaacaggaccaacctcagagggccgaggtaagagtctgatgagctaattgctgacatgcagtgtgattgtcagtgctgttattattgcattcttgttttcatgtagggtgcctggggacctggagagatgtgtcttggtggaagataagggccatgttgcccatgcacattggggaaggatcagtgtgactgttagtgagggttttctttgctggaaatggtggggcagggcagggacagtcatgggtgagggcatttcaattccagttggaaagaatcctagagattggtttttccctgtgccttcacagatgaggccactgaggcccacactgggtgaatgacctgttcgaggtcacacagccacttagagagtgatcagtactctcaaatcccagcccagtgctctccaagcctctcagctgggctcactctcccaggacccccaggacaactagggcagtgggtttcatgtgtggatgagtgagggccctgaactgggaggctgctttgcttttcagacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggtgggtgtgttgcccttagcctggcttagccttttcttgttctcccagccttgagagcccatgaccttgggagatcatggagggatgcagtggctggaacctgtaagtggtggagaaatgttgtctcttctttcatggtttccacttccccttcccaaggaagtttgcaatcaaaaaataaaaaggaaagaccaaaagcacttgaacttcctggcagccaggatgaaaagggaaatatgatgagccatttatctctcattagactctgagctatgagttcctataggaaatgttttattcagttttatatcccagggtctagcacagtgccttactctcctggtaggtggtcagaaaatactggctaaacaaatgactgaatgaatacttgcatgagaggataccggttcttcgcgggagaggtaacctccttggcactttccttaggaggaatttattccagagattcttacagaaaggatgatgacaataatgttcacagcacagtgactgatgactttgaagtgaaaactacatgctacacaggatgtcaaggcctcaagagtcattctactccaaatataggcacggcattcctgtgttcactccctcattcatttgctaattcaatgaatatccattgattacctcactgtatgccagccattctggtagacattatgatatggtggcaaatgggccaagcttgtcctgcattcagggcacttagacccttgttagggactgctgaggtcagtcctccaggaagactcaggatactgagcagcacttgaatggagtcattgctaacttttcatgctggccaccaggaagctcagagctactgatagcattcttcagggcttctaagctgtcaaaagcaaaagggggcagggggagaataaggggtaaataaaaatgttggaaatgaggccaggcgtggtggctcacgcctgtaatcccagcattttgggaggctaaggggggcagatcacttgaggccaggagttcaagaccagcctggccaacacagtgaaaccccgtctctactaaaaatacaaaaattagctgggcatggtggtacacgcctgtaatccaagctgctcggggggctgaggcaggagaatcacttgaacccgggaggcagagattgtagtgaaccgagatagtgccactgcactccagcctgggtgacagagtgagaccctgtctaaaaaaaaaacaaaaaaaaaaaaaaagaaagaaaagaaaatgtatgttggaaatgggaggacagctcacacaagactacactgggctctcaaggtgcttttgtgagatttaaagcgatcagaaacagtgcccctcctctaggagggcagaaattagcaaagttagagaggactgtggctggagagcaggagggttatgctgccatggaaaaagtcgtacactcttagacctgaaaggggccctccagagttcagaaagcattattttaaacagttggctcagtctttccatctgtgggtaaagatacagaggcccagagagggaaagtgacttgtctaagggcacacagcatgtgtgggggtaaaagagctgaggactgacacccagatcttctggctctcttccctccagctccccccacatccattagcccttgcttgctgggcaatgcctcatatacccccatccctgcctcttctcttttaaggggtggtgttctggaaccagaggggacagtggagattaagttccgaaagaaagatctgataaagtccatgagaaggatcgatccagcttacaagaagctcatggaacagctaggtaagggggtcccaaaggcttcacctctcagaggtcaagagaggcccagctggcccactgctgggggtttctaggatgttaaaaataaaatgaaaaaataccaaaatacagctataataactgtgagatttttaaagatattcacatttgtctgtttgttttgttttgtttttttgaggtctggctctattgcctaggctggagtgcagggtgcaatctcagctcactgcaacctctgcctcccaggcataagccatcctcccatctcagcctgagtagctgggactacaagtacgcaacaccatgcctagctaatttttgtatttttgtagatgtggggtttcgccatgttgcccaggctgttctcaaactcctgggctcaagcaatccacctacctcagcctcccaaaatgctggggttacaggcatgagctaccatgattggaggacattcacatttctaaatcaacctttttaacattatatatatatatatatatatatatatatatattgccatcgtgaatttatttctcagcatacacaaaagatagcaattgaagtatttggggctgatggggattatcagaattttggtggcaaaatgttcctttagaattcccaatcagagataagatattttactaattttgtttgaatgacagctttgttttacttgtcatctttagatgtaattatctttatttatttatttgtttatttttgagacagagtcttgctctgttgcccaggctggggtgcagtggcgcaatctcagctcactgcaacctctgcctcccaggttcaagcgattctcatgcctcagcctctcaagtagcaggaattacaggtgtgtgccaccacacctggctaatttttgtgtttttagtagagacagggtttcaccatgttggccaggctggtcttgaactcctggcctcaagtgatttgcctgcgtcagcctcccaaagtgctgggattacaggcgtgagccactaagtctggccacaagatgatatttaaatatccattttaagtgtcagtgtctttataactgtgctattcacaagattttttacagtgtgtgcgtgtaatttctttggctggtatcagggtaatgctgatctcatagaatgagttgaagtgttcgctcctattttctgagtttttgcagaattggcattatttctttatgtttttgatagaggtttttacctataaattcaacttctttgttatatataggactatttgtgttatctgtttcctcctaggtgagctttggtggtttgtgtgtttcaaggaatttgtctatttcatcttaagttgtcaatttggcatagagttgcttataatattcccttatcatattttacaatgtgtactaaaaatcattgatatagtatcctacaagcacgatgggtctgatggaaggggaaaatgtagagttgcatgttgaatgctgtcttgcaattgtgagtgcatttctgagactgtactagctatttgatctgagacaaagggggccatcaagatgggcctggggtgggggccaggccagtggactctgggggacctagggggctgagggcagcctgtgtagcagcaggggtaatatcagagttaaagctcagacctctcacaaggcaaggcctgtcctgcaaatcctgatttgtgccttcttcaaaaaaaaaaaaaaatctccaccccatcacatatgaccagcttccatggcttgactggcctttctgctcacctgcaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgtgagagccacagctgccgtgtagggtgcaaagagcccaccctgttttccaaaacatggaggacatttgggctcgggggcggggagggcggtggtggttgggatgggtcaaatgctgcaggaggtgggagtcacctgggaactttaaaataatcccgatccccaggtggcactgcagaccagtgaaatccaaacacctggatggaagccaggcggtcgtattttttaaagatccccaagagattctaataagcagcaaagttcagggaccactagtctgatggctcggtcagtttggacctggaccaggggtagaaaccgttgttcctgtccagcattcacccacccctcaccattgcaaggactcccacagtcacctcctacccatgtccagtgctcattggttctcttgctgcattgttctccctcccagctgactcatgcctcacacgagcctgtgtttgtgtcggttgaggtagaagtgggtgccaggtttttatgggggacattttttcaactatggccagtctggagtcctggtgacgtcctgcctctgagcaggtgccttctcctccctgagcctcagcttacttgcctgggatgatctgggaatgatctcagagcctgggcccagccccgggcagccactgtcatgggtgtggtcagagccagtgtcccgtctcctccttccctttccggggattcaagcctggctcgtccacaggacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggtgggcctggggtgagaacgaggccggtgagcacagggggtgctgggggctgagacagctggcccacagctgggtccctctctgaggcatcctctgccccctccccaggcctacttgtgggacaacaaccaggtggttgtgcagtggctggaacagcactggcaggcaggggatggcccgcgctccaccatccgtgagaacatcacgtacctgaagcacgactctgtcctcaagaccatccgagggtgagtggccaccgcacctgcttcccagcctcctggcaaggacccgagcctggattgacccctagctacccgactcctatgcagccacttgaacccgccaccctgtgcagtctggggttgtccccgccccctccccgctccccagcaaagagaccacactccctaatgtcgggtctcccagcacagtggctggggtgggacagagagcctagaggtactctgaaggccgtgtgagatgcttccaactcatgaaccttgctggaatatggacttgtccaaagtcacagctggagcagggttggtcacagaacccacatttggaaccgctagccttcaggctgctgtcttccacgccagtgttgacctttccagagggtcccctcccccaattgccatggggtcaccccgtgaaggagggagtcgagcacaggggaccccattttggggatgaagctgagactcaaggcagtgtcttgtctcaggtcatgtcacaaagcagtgaccagtagggacggtggtgcctcaaggcattctgaacttcaggtcacagcccctcctgctgcacaggaccatcacccccatggggaccacagcagggactcgggagctctgggttctggggtgtggccccacacaaggactctgccacccttggggccactgaaaaagtggctggagtgatcccagccctcctctcacctcccccacagcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcggggatggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaa

SEQ ID NO: 1540 - DNA, 2626 bp, Homo sapiens
cggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgattcatcctacctcctgccttctgagacagttcttttttttttttttttttttttttttacttctgagacagttctgaaacaggtgtccgttgtgtaaagcctggaggtttgggaaatccaattagagtggcaaagtctgaaggtggttcgcgtaagcgaacccagcagctacatgggaggctgaagcaggagaatcccttgaacctaggaggcggagtttgcagggagctgagatcgtgccactgcactccggcctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgccggaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggaggttgcagtgagccaagatccagccattgcactgcagcctgggcaacaggagtgaaactccgtctcaaaaaaaaatagtaataatatacttgatcttagccaaaaggccgagaagtgatgaaaaaagttattattattattattattattacatcacctagcccatataggactggccttgtagaaacttaacctagactcttgaatttgttgagtctttgagcggcactcccatccttgtacaatgcaattagaagccaaacagtaaaggtttctcagcctcagcactgttgacatttggggctgggtaattcttgttggggggctatcttgtgcattgtgaaatgtttagccatatccttggcctgtacccactaggtggcagtagtacctgcgcaaccccactcccgcttccccctcccccgcccccatcacagtgtctcccgatactacccagtgtgccctgaaggggcaaaatcaccctgggttggagaccgttgccctaaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaa

SEQ ID NO: 1541 - DNA, 17316 bp, Homo sapiens
ggcgttacgcgcgggcgcactgcgggggccaaggaaggaagaaatgtggtcgcggttggtgtggctgggccttcgggcccctctgggcgggcgccagggcttcacctccaaggcggatcctcaggtaaaggccagggccatctaggcgggtggcggagcaagccgggaggcacttcggagcgccggtgacccacactccccgcctcatccctcctccagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacaggtaaactcgcggctgcagccccgaagccttgaccgtggcccgttcgcagccgtttaatgtgacgattagcgaacagttttccagggggttaaagagtgttagcaagattcaggaacttgcccacagtcacctcgcgagtcagtggcttcactcttccccttgttcattactgatgctctcgctagtgtaagtggaaacaaaacccgaactgctaatcactgcctttgtttttttttttgtttgtttgttttgtttttttttttttgagacggagtctcgctgtgttgcctaggctggagtgcagtggctcgatctcggctcactgcaacctccgcctcccgtgttcaagcaattctctgcctcagcctcccgagtagctgggattacaggcgactgccaccaggcccggcttattttttttgtatttttagtagagacgtggtttcaccatcttggccaggttggtcttgaactcctgaccgtgatccacccgcctcggcctcccaaagtgctgggattacaggtgtgagccaccgcgcctggcctaatcatcgcctttaaggccctactccatagagtccctacctactcactccaacgtactcttctcagtactctccttggctaccttgactgcttctccagcaagacaagttcttttcctctctagatctctgcactggcccttcgtttttttccttcctctcagtatttgcatggctgcctccctcttggcacaggtctcagcttatcttctcagaaagggctctcctaaccactccaaatcccttctccccttctagttagtaactcatcctattgggttttttccctaacattttaatggacttttgttcatttgttatatctcttttattaaaatgtgagctcattatgtagttactgttttattcctgccttgaatttttattttatttgtttttgagatggagtctcactctatcacccaggttagagtgcagtggcatgatctcagctcattgtaatgtccacctcccagactcaagagagcctcccatctcagcctcccaagtacaggaccacaggcgcgtgccacttggcctggctaattttttgtatttttgatagagacgggattttgccatgttccccaggcttgtctggactcctgagcaaaggtgatccacccatctcagcctcctaaagtactgggattacaggcatgagccacagcacctggccgtgtttgattctttcaaatgtcttctctactttgcaattttctttttcctttgggacggggtctcactatgttgcccaggctggtcgcaaacttctagactcaagagatcctcctgcctcagcctcccaaatagctgggactataggtgtgcaccaccacacctggctaatacttaaaatttttgtagaaacggggtcttgccatgttgccccatatggtctcaaactcctggtctcaagcaatcctcctgcctcagcctcccacttcctcaagaaagtttttttttttttttgaggtggagtcctgccccatcacccaggctggagtgcagtggcatgatcttggctcactgcaacctccaccctccaggttcaagtgatttttgtgcctcagcctccggagtagctgggattacaggcacccgccaccacactcagctagtttttgcatttttagtagagacagggtttcaccatgttgaccaggctggtctcgaacccctggcctcaagtgatccgcccatcttcgcctcccaaagtgctgggattacaggtatgagtcactgcactggccaaaaaagtccattcctttttttttttttttttttttgagacggagtttcactcttccacccaggctggagtacagtggtgcaatctcagctcactgcaacctccaccttccggtttcaagtgattctcttgcctcagcctcccgagtagctgggactacaggcgcccgccaccacgcccagctaatttttgtatttttaatagagacggggtttcaccatgttggccaggctggtctcgaactcatgacctcacagtccacccgcctcggcctcccaaagtgctgggattataggcgtgagccacaagtcttcattcttttatacttaggttctttttttttttttttaattgagacaagagtctcgctctgtcgctgaggctggagtgcagtggcgtgatcttggctcactgcaagttccgcctcctgggttcatgccattctcctgcctcagcctcccaagtagctgggtctacaagtgcccactaccacgcctggctaattttttgtatttttagtagagatgaggtttcaccgtagccaagatggtctcgatctcctgacctcgtgatctgcccacctcagcctcccaaaggtgctgattacaggcgtgagccactgtgcctggctatacttaggttctctacctgtggctctcgtgatatccaaaagggctgatttatacatgcgtttatacatctatttaagggatgtgttgagtctctgcccctctcctgctcacccaccttccacagcatgtctgtttttccttatcatgttctcagtggttggcactgagtattcagtaaatgtgttttgttttgttttgttttgtttttttgagatggagtctcactctgttgcccacgctggaggcagtggcgtgatctcggctcactgcaacctctgcctcctgggtttgagattctcttgcctcagcttcccgagcacccgggattacaggcatgcaccaccatgcctggttaatttttgtatttttagtagagaggggtttcaccatgttggcaaggctcgtcttgaactcctgacctcaggtgatctgcctgcctcagcctcccaaagtgctgggaatacagccttgagctgccgtgcccggccacagtaaatgtttaatgaatttttttttttttagagacagagttttgctcacgttgcccaggctggagtgcaatggcgcgatctcagctcaccacaacctctgcctcccaggttcaagcgattctcctgcctcagcctcccaagtagctgggattacaggtgcacgccaccacgcccagctaattttgtatttttagtagagacagggtttctccatgttggtcaggctggtctcaaactcccgacctcaggtgatctgcccaccttggcctcccaaagtgctgggattacaggcatgagccaccatgcccggtcccagtgttctttattaatatctctaggaaaggagggactagaagcacagagtcatcagaatttccccaagttatctagagggtaaatacaaagaaatataaccatcattaataagggaaaaggtcgtgaaaaaagatgaggaatttggatccagtagctagcatctcaacctcgtattcagtgatctgtactgtttttcataaatttggaaaccagtttgggttaataattcccattaatcattttaatgtgacatctgtaggactttaatgctttgaacacacagaatgtaaagtgaagacaagtattaaaccttttattttttatttttttgtagtttttataacttcatttgatgtatttgatgatcagcagttagttcccatccacactgactgtagatttgtgaaagtggtaacaagtatataaccaaagtatagagcttatttggtgaatttctaacctcattatgttttctggaccatccactgcacatggacacagtatggacattccttactactttggcccagacagctttgttgagcctggtatcaatacacatatctggagttttctatctccttcattgcaaatttccggtctctttaagagcctgaggggcacacttcttgaagcccactccatggatacacttgtgaatattaatggtgtactcttgggtcaccacctagttgatggcataatggccattcttctcaccatccttctttgcaggaggccaagttgcttaaatgttttaggtagtaggcatcttagctataaaagccctgacttggccgggcataatggctcactcctgtaatcccagcattttgggaggccgaggcaggcagatcactttaggtcaggagttcgagaccagcctggccaacatggcgaaaccctgtttctacttaaaaaatacaaaaatttgccgggcatggtggtgcatgcctgtaatcccggctactctgaaggctgaggcaggagaattgcttgaaatcaggaggcggaggttgcagtgagctgagatcacgccactgcactccagcctgggcgacagagcaagactccatctcaaaaaaaaaaaaaaaaaggtagactgggcgcggtggctcacacctgtaattccagcactttgggaagctgaggtgggtggatcatggggtcaggagttgaagaccagcctggccaagatggtgaaaccccatctgtactaaaaatacaaaattagccaggcaaggtggcaggcgcctgtaatcccagctactcgggaggctgaagcaggagaatcggttgaaccaggacggcagaggttgcagtcagccaagatggagccactgcactccagcctgggcgacagagtgagactccgtcttaaaaaatacaaaacaaggctgggcgtggtgtttcacgcctgtaatcccagcactttgggaggctgaggcaggtggatcacctgaggccaggagttcgagaccagcctgaccaatatggtgaaactccttctctactaaaaatacaaaaattagccgggcatggtggcgcactcctgtagtcctagctgttcgggaggctgagacagaagaattgcttgaacctggggagcagaggttgcagtgagccgagatcacgtcactgcactccagcctgggcaacagagcaagactccatctcaaaaaaacaaacaaacaaacaaaaaacgccttgactggctaatagaaacccctttgcacactaataacatgtcatttggtttgaggtaaaaacagtatgcttacatgccaggggctaataaattatataaattcttttttttttttttttttttgagctggagtctcactctgtcgtccaggctggatgcagtggcacgatctcagctcactgcaacctctgcctcccaggttgaagcaattctcctgtctcagcctcccaagtagctgggactacaggtgcccggcaccatgcccagctaatttttgtatttttagtagagacggggtttcaccatattggtcaggctgctcttgaactcctgacctcaggtcatccgcctgccctggcctcccaaagtgctgggattgcaggcatgagccaccgtgcccggcctaaattatttcaattttcacatgcagtcctggaaggtcaatacaagttatctattttatatagatggaaaaaactgaggttcagaaaggttatataatgtgcccaaagtttcacaggtaataagcagagaatttggaactcagagcttctgctgccaaatactgttctaagatatgccagctaaagtcgattcctaggaactttactctctttcatctgaaatccagagaatgagttgacagcaactctgcagccaaatacttaaatgtccctcatagtcttatgaaccaaaaacttcaaactcttaggctcaagccatcctcctgtctcagcctctcaagtagctgggactacaggtgtgtacccctatggccagctaatttttttctttgttactttttttttggtggagacaggatcttgctgtgttgcccaagctggtctcgaactcctgggctcaagtgatcctcctgcctcggcctcccaaagtgctggcattataggcatgagccatcatgcctggcctgaatccagaactttttttttctcattctgttgcccaggctgcagtgcagtggcgcaatcttggctcactgcagactccacctcctgaactcaagtgatcctcccacctcagcctcccgagtagctgagactataggcacacgccaccacccctggctaacttttgtattttttaggggagatggggtctcaccatgtttcccaggctggtcttgaactcctgggctcaaacaattcacccccttcggcctcctgaagtgttgggaatatagatgtgagccaccttgcctggctcagaacttttaaccaagttaattagcccccattccagtctgcatcaaactagaaataaagtaggaggaagggagaaggcttttagatggaagtagaggggtccacaagaagctattccttccagccagatagcagaaaagaagctcaaagaaagaaaagcagtgggagaacggtcccatcagtgagtccaagggctgacagaatcacaaatggagccactttgtcctccctgttgccacagcactttccaatgccaccgtagcagcatttctcacagttacttaagttattgttcctgagttttaaccagcagggacttctagtttacaactgaagtctttctcaaccagggttcctcagccaaaccagaacacagaaagattcaagtgactttttttcagttctcccaaggacagtatatgacaaatgttagcttaaacacacaggagataagttaacttatcatcagaatgggtgtcttggggtatgtaggctaacttatcttacagaaccctgattgggaaagacaggtggtgaggtagaagtttagtcaatcattaattgatctgaaaagctcatctggtcctgttcagtgttttatataattctgaggtccaagaaagtgaagcaactcaccaagtgagaggtatgcttgctgtaccactgtcacagagaccgtgggttcaggagcctgtaattaataaagctaggtatggtggtgcacacctgtaatcccagctgcttgggaagctaaggtgggaggatcacttgagcccagaagtttgagaccagcctaggcaacacagcaagaccctgtctcaaaaaaaaaaagtaaaacaacaacaacaacaacaacaacaaaaaaccaaccccagaaaatgtgtctattttaggaacaactccatcataaccaataactaaatagaaatgtatgtatgtatgtacatacatacataaatagaaaggtatgtaaaggggtgaattttgttttcctggaaatttcacttacgcaggaaacttaattatgaaacttgattacttgatgagtaaatagattagttgctattagatctactcttggggaagcagtagcatttaaccgcctattggcggtagtagagagtcttcccaaaccttcagatgctaggcaggttgtgcctcatcaggagtgcacagactttgaatgagtggtagggactgagatgtactggggtgcactaaggctttctgaaaggagcaggtgctactcagagccctcttactgccgtgaatgctggctcagcattatcagatcttgtttttttaacatttcatttaatcttcccagaaatcctatgaagcattcaacaaacaaggaaactgaaatatagagaggataagtaatgtgtagcaatgggatctgaattcagctgtgacttgagagcctaagctcttagcctttttgagacggagtcttgctctgtcgcccaggctggagtgcagtagcatgatatccgctcactgcaagctccacctccagggttcacgccgttcccctcctcagcctctcgctacaggcccccgccaccacgcctggctaatttttttttttttgtatttttagtagagacggggtttcaccctgtcagccaggatggtcttgatctcctgacctcgtgatctgcccgcctcagtctcccaaagtgctgggatcacaggcatgaggcaccgcgcccggcctcttagccattttttaatactgtccaacagaaactataaactccagaaagtccaagggttacctttgaatagtataattatgatttttattttacttttgttctcccaagttttcttaaatgaatacagtccttgtgttattcaaaaaaaaaaaaaaatctagtacaactctcttttgtgtgtgtgtgtgtgagacactgtctcactctgtcacccaggttggagtgcagtggtgtgatctccgctcactacaaactctgcttcctacattcaagtgattcttgtgcctcagcctcccaggtagctgggattacaggtatgtaccaccatgcccggctaacttttatatttttagtagagacagggtttcaccatattggatggtctcgaactcctgacctcaggtgatccacctgctttggcctcccaaagtgctgggattacaggcttgagccactgtgcctggcctttttttttttcttcttgctctgtcgcccaggcttgagtgcagtggtgccatctcagctcactgcaacctccgcctcctgggttcaggcgattctcccgcctcagcctcccgagtagttgggatcacacgtgcgtgccaccacgcttggctagtttttgtatttttagtagagatgtggtttccccacgttgcccaggctggtcttgaactcctgaattcaggtgatccacccgccttagccttccaaagtgctgggattacatgcaagagccaccacacctggcctttctcccccacaccccgccgcccccctccaagaaatttaatgtctgaaaagatcatacttgttcaaggccacacagttaagaatgtgccaggtcctgtaacagacttcaactttctaatattcataccatgagtaaatatttgttgtgtctagctttgggctgggtgccacaaaaaaagaactagtcctttcctaaaataatcttattgtgacaacttagttctctttttttttgaggcagagtatcgctctgtcgcccaggctggagtgcagtggcgcgatctcggctcactgcaagctccgcctcccgggttcacgccattctcctgcctcagcctcccaagtagctgggtctacaggcgcccaccaccacgcccggctaatttttttgtatttttagtagagatggggtttcaccgtgttagccaggatggtctcgatctcctgacctcgtgatccgcccacctcggcctcccaaagtgctgggattacaggcgtgagccaccgcgcccggctgacaacttagttcttatgtgcagccttagcccagatgtacctgtcacatctttgtccctctctgacatgactcaaacgccattagggtctgccctcagtctgtgcccactcaaagcaggaggagcgtggctactaccgaataccatatcagtgatttaacagactgcttatttttttaatctaagtatctggaagcaggcttacacacttttacaccttgaaacaatagtgaagcctcatgcaaatgttcaagctcttgtgtgttttttaccggtttgccatctgaaggctttagtaaagtcactaggtcccacagaacactgggagattcttgagctgttggtggcacatcttgctcaagggcaggcacatccaccaaagtggctgtggtggaaaaagcattcattttaggtgtatcagattgggctgagatcccagttgttacttagcagccaacatccttaagttactcttgtggcaagtttgcttccccatctctgcttagctttccagcttcatcttccaccccggcagaccacaccccagcctgctaaactccctgtccttctctgaatctctgagctctcggctctattgctttgggattcatgctgctatacgtgccaggaagtccatttctcataccttcatcccccaatccagctatttcttgcccatccttgaacagtgacatcagctattctgaggatgtgctactcacgcaggctggactaggtaccctttctatcctttggcaggctgtactaacctctgttagatttaaaatattgtttttgtaattgcttttacctgtccccaccaaaagacagttgcccatataatcatcaaaaactatttgttaaatcaatccagagaagtaattagcacttacttctcagggttgttcggtcaatctataaactgtaggctgttatttggtctactgttgatcccagcttctctatctttgaacagtgcccattaactcaagaatatactgcttccttgttctctccttcttgcccctctccatcatcccctaaaagcccccttctctgagagggtaaccttgagcttctgggttttgtagatgtctatacctgagatccgacaatgtggtagaaggcaactgtgctgatgaattactacaaaactcccatcgcgtcgtggaggagtactttgtggcccccccaggtacgtgctgcccagaatggtttaacagatagtctcacagtaaccttaggaatgaagcaggaagcatgaggaccaaagatgctatgtgaaggcactttgaaaaggatgaagtgcatacagatggtggcattaaggtggcagtagggtccagggtcatactcacctctagggggcagttagtaacaggaacaagcaaaacaggattgggggcatgcgggaggtttaaagtaggtggaaatctggagctcaagatctccctaaaggggcagctggcattcagtgtttctcaaagccacagttaagaccctgccagatcctgtaatcgactccaactttctagtattcataccatgaataaatatttgttaggtctagctttgggctgggtaccacaaaaaaaccagtcctttcctaaaagaatcctttttttttttttttttttttgagacggagtttcgctcttgttgcccaggctggagtgcaatggtgcaatctcggctcaccgcaacctccacctcccgggttcaagcgattctcctgctcaggctccccagtagctgggattacaggcatgcaccagcacgcctggctaattttttgtatttttagtagagacagggtttcactgtgttagccaggatggtctcgatctcccgacctcaggtgatccacccacctcggcctcccaaaacgaatcttattgtgacaacttagttatcatgtgtggccttagcccagatgtttctgtcacatctttgcctatgacatgattcaaacgccattagggtctgccctcagtctgtgcccattcaaagcaggaggagcatggctgctaccctatcagtgttgccaggcaggaatgtaaacccatttctccagagaacctggatacctgacattttgtgtgatatttcttaaatttttttttttttttttgagatggagtctcgctcggtcacccaggctggagtgcaatcttgactcactgcaacctctgcctcccgggttcaagcaattctctgcctcagcctgccgagtagctgggattacaggtgcctgccaccatgcctggctaatatttttgtatttttagtagaggcaggatttcaccatcttggccaggctagtcttgaactggtgatctacccgcctcagcctcccaaagtgctgggattacaggggtgagccactgcaccccgccgatatttcttaaattttaagtgctagcaaccaattcaaaatttaaaaaacaaaataccatccaagccaaataaaacacatctgcaagccaggtgcagtctgtgagccatcagtttacaacagctggtatagagatttgcatcatctacctactgtaaatattttaaatagaagctttaaaattactctgggctgacagtaaaatccagaaccttggataggttgactgtttttatctcctctgcaggtaggtgaatacttggagctgttgtactacccctctgggcatctgggagtgggactagccaaaagcaatcaggtagcctgctaagtgccaacttccagttcaggatatcctgagggagaatcattctgagcagactccacagaagacattggccctggtcagcttaaggtgccagttaaaggcaggctctggttgatgcaaggatgggaaagaaagctagaaattttgtgagctaaactttttgtttgttttgagacggagtcttgctctgttgcccaagctggagtgcagtggcgcgatctcggctcactgcaagctccaccttccacgttcatgccattctcctgccttagcctcccaagtagctaggactacaggcgcccaccacaacgcctggctaattttttgtatttttagtagagacggggtttcaccgtgttagccaggatggtctctctctcctgacctcgtgatcgtccgcttcggcctcccagagtgctgggattacaggtgtgagccaccgcacccggccgtgagctaaactcttaatcatgcctccaatccactaaaccacctgttaactgtggagagaaaggagactctccatctcagagcctgatagttgtggctccagcagaaatatcttttgatcagacatgctatctcccacacagaaccttacttcagactttgctttttgggaccacctgagttcatggtcagtgtttccttctagtcctatctgcatattagtggctaatcaacctgtatactccttactgaaaaaggtgaatttggctacacttagaactgattctttcagatactcccagttaggaaaacaggacagtagctacattacttccatattttccatgagaaagtagtgatcagttagctcagtagagccagctgggcggcaggctcagctataacattctctgttgtggccgggcgcggtggctcatgcctgtaatcctagcactttgggaggccgaggagggcggatcacgaggtcaggagatcgagaccatcctggctaacacggtgaaaccccgtctctattaaaaatacaaaaaattagccgggagaggtggcgggcgcctgtagtcccagctactctggaggccgaggcaggagaatggcgtgaaccccagggggcggagcctgcagtgagctgagattgcgccactgcactccagcctgggcaacagcgagactctgtctcaaaacaaaaacaaacaaacaaacaaaaattctcttttgttattttcaaacaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtaatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagcctcctaagtaactgggactacatatgtgcatcaccacgtccagttaatttttttttaagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagagcaactgtctatccccatataaataaagttatctacccctgctcctaactgggtacaagttatgactacaactcagtgattttttaaattagtgtgcctatttggtgaaatctgtgaacttaatcaaggacaaccacacatgtcaattactaaacatttaaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagtttaaaatgtttcactgctaatatggccctggtagaaattatgtagttttttttcttctttaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgacccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggagtcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaacgta

SEQ ID NO: 1542 - DNA, 17316 bp, Homo sapiens; identical to SEQ ID NO: 1541

SEQ ID NO: 1543 - DNA, 2452 bp, Homo sapiens
taatgatagaaactaaatgttacaatttattccatcttcaggattacagacattacagggcaggatgagtaaacaaggcaaatgaagcgagcaccttcagcttcccccctaccccgacatttaaccagatgcagcattttgacatttttaggatatgcaggttgacaattcactgacttgggttgagagctggcaatagcagatctttgcaatttaggttcttcctccacagctattccaagtatcttaattcctgaactgcacactgagagctctgaaatggtgttcactgcaacattcttgcagctttcacatcttaatctgacacctcttgtgaaggcagggaactgtgttaaaagctgtcttcctctttgctaatccaggccaccatcaatcttaaccattagttactatataaaaataaaagtgtgctcaaaagcactcactgaaactgttgtgcccagatcccttttcagagcattagttccctgagaggaaaaaaagaggtcctaaccaattgctttcataaatagtgaccccagtacagtgtatatgtcttttgcagcagaaatcaagaggtcaggcagctctgctcatcctgactagtttatcatcgtttgcatacaaggtatatttatgtaaagctgattccacgccaagtattgcaaccataatctcaaaaaaattgttcaattttagcacacagttcctgcaagataccacagcaggtgagaaatcatctcaaagagttcatcttttacaactgagaggaaaacatcgaaggaggaaataaaactcctctctcctaagttcctcatcaaatctgatggctatgttcacagagttagttgacaaaaatccagagtcctcaatttctggacttgcgaaatccttcaaggtgactgtcaaggtcaagaagaattttcaggcttttctttgccatggcccatgaactccagtccttcaataggaatctctttctcctttattgctttctggtaggaggagaaaacacattataaagacctacatgaagcttaagttgcaagctttgtaaataaaatatgacagtacaaaagtaaaatcaagctgattataaagacttataaccatgattcaaaccacatactttttaaaaaacaagtaccggtcaggtgtggtggctcacgcctataatcgcagcattttgggagaccaaggcaggtggatcacttgaggccagaagttagagaccaacctggccaacatggcgagaccctgtttatactaaaaatacaaaaattagctgggcatggtggcgcatgcctgtaagcccagctactcgggtggctgaggcatgagaatagcttgaacctgggaggcggaggttgcagtgagctgagattgtgccattgcactccaggctgggagacagagtgagactctgcctcaaaaataaataaaaaccagaagtaccataatgaataaatcaagtgtaagacctgagggagactggaaaaggagttgtgagggaaccgttaaaattaagtgaaatttgaaaaataatcatcactttgtgttagtgaaagacttaggttcaaatctgggttccaggacttactggctatgtgactaactgtaaatgggatgaagacagcaactacctcggggaattgctgtgaggatgtgttgggttaacttattggaagtgctttgcccggtgctgttcttaacaattcaaagcagttccacatccattgggccagaataaacatttcctggctgcagttgcggggactggtcaagagagagaaacaggctaacgaagggtttataacaacaaaaaaatgtgaccctccagtctgaattctgaagtataatcccgcccagaccccagcagtaatagtggaaaagtgcaccacctgcgaaagaaccaaggaaacctgatgctagtgaactcggattaatcacttcctatttctgggtgttagttttttatgtataaaatatgagtaactatgcccaccttgcgagtttagggtgaacaccaaatgaaccaaaggatgtgactgtgcttcttgaaaagcactgccccaatatttgtcattcggagagacacccaagtggcctcggtggtgatggtaggggagcgagctcctgccactggcctcactgcgacttttctccacccttccagtccagtcccaatccccgtaaaatacgatgagtgtggtgggacacagcgccgagaatgcagggcctgggaacagaggcgggagggctcacctgaacacactgctggtagcgcttgaagaggtcggtgcacgggtccccggagctgtcccccttgagaaatttctcggcgaaccagcgattgaagcactggtcgtactcgcgcttcatgtccgtgcatgcctcccccacactgttcatggcgacagtggtggcggcggcgacgacggcgcactctgat

SEQ ID NO: 1544 - DNA, 38527 bp, Homo sapiens
tctagggtggggagcatttattttaatttttgtcttgcagctctttgtagaggacctagcctttctctactgaactgaaggggtttggtcccatcacccgaagactggcccacctgcccacacaggtgggggcacaggaggtctgggaggccccaggaggtggaagttcagaggcctgcctggccctgtccatcccactggctgaggccaggccggagggccgaccccaggggccctctgtatgcaagccgacgcagacaagggcccagtgcatagttaagacacaaacaccacacagctgtccagagcctccaaagcactgtttatccaggctccatggaaccaagtgcccccagctgcctgccctagtcctcaggggggcactggcaccgcagtggcctcggcctgagaccctcgatgagccccagcctaacctgctccaaagccactgacacatgcatgtttagcccttggcccatcaagatggggccctgggaatgaactggctgcagaccctcctccatcccacacccccaggggctccatcagtcctggctagctcagcaccatgttaaatagcttccttgcaatctcccttaaataaacccatccccagagcaacctacccaccctgcaccctgaatatattatcctattggcttatgccttctagactggaggcgctctctcctcttgccctctactccaggggataccatctccctaaaaaaccaggggaggaagtttttttctcaactctggggcagagacaaagggtggcctgggttggagtggaaaagccaggaatagcttcctctgtcccttccctccccagggtacttccttctccttgccctcttagcagcctgggtcaggcgcgacttacccaaggtcacagacccaggacccagagtcatgacccatgtaggaggttaccctggttttgacagcccaaaccagctccagggcaggaggactgaacttaagcctgcctccaccttggcccctgcagttctccaggctcggagtgagctgagggaggttccagctcttgactccactctgtcccggacccctgggactatctcccaggaccctccacccctggtgtctccaggtctctcttgctctggggatactcagacagcaccaggcatggaagcaatggggcccgggacatgggcaagcctgtccctggcccgatcagcatctgggcccaggccaggcctcacacccagtactggccattcttaagggcagggttgggtgtccggcagaactgcagcagctctgggtcaggctggcctcctggagggggcccctggccaggcacagctgtgagcgggatggcctggcctggctccaccttgcgaaaggtctcggtgtcaccagccaggccgttgcggggcttggcagtcaggacctggacgtcatgcttgcccgtcttgttgcgttttcggaggtagaagagcaggggcaggatgagcgccaggagcagaagtaccaggcacatggggatgatgacgctgaacatgttggcctcaaggaagctcaggaagcctcccttggccacagcgggctcagggctggatgccatggggcctggctcgcctgtgggggtgctgctctctggcttccctgcttccgtccgggcggcctcggggacactgagcagggccacgctgtagggccgggcagcattgtaaggctcagtggcaaagtccagggaggccacagcaggcgggacgccctgtgcccacagctccagagtgagactgtcacctgcggggccgggggccctcccctctggcctgcccacctccagccccagcctcccgtcctcaaggtcctgctgagtgaactgctccaccagctggctgcccccgggctccgtcctggctcggggcacgcggaccacgcggccatgccggggtccctccaggaggcggaagcgcggcacactgcctgtgcggttggccagctcgccagcatctaggacggtggggtccaggcgcagggtggcaccctggggccatggcccacctgcccacacatgcagcagagccctcacagtgacgttcactacggctgatgcattgacacccctagccagtgccaggactctgaagtggtcatgagaggaggagaagttggtgaaggcaaagaccacctcgccctggtctatctggaattggctgaaggccgaggtgggccgcccgcccaccaggagatgcccatactggggtccctggatgaggcggtatgctgcctctggctcctcccgatctgaaaccacccggagctgctgctggctcagtgaggagcgccccaaagcttggggcacctccaggggtgcccgcagctgcacctcgatggcggatggtaggatgtccacagccagggacatgggcaggggtgggctggccccatcagacatgctcagctggaagatgcctgccacgctgctcccgttggccacgaaggccagccgccctgaatccacatcggcttgcgtgaagcgggtcacgggccccaggccaccacccaccaggctgaggaagccgttgtggggtgcccgctggacctcgtactcaatctccccaggagctgagtctgggtccaccacactcagctgggcccgggagatgggggcacgagagcctcgggtgagccggagtgggacagaggcctgtggctgagggggccgctcatttacatccctcaccgtgatggcaaaggcctctgaggtttggggtccagccacggaggcccctgctggcccctggaggtgggcacgaaagtggaagccatcctgctgggtgcccccaccgccgtgggcatacactagctgccctgcagccagctgggactgcaggaagtggggctgcccagcatggaggggctcctcggacaccaacagctggccccggctggggaactgtgtgacctggaagagcacatcatgctctgagcgctggggtgatggaacgctggccaagagattggaggcatccagagcagccacggtgatcctggcccgctggccctcggggacccagagacctgggggtgggacataggctatgagggtccagcccactgaggggagagtgatggaccctcagctgggggtgcctcagggcaaggatgtgcctccccccaaccatcaagccaggtcctccagggtggggctcagggttcccaggaggataaggactatgtccccgctgtgatgtcaaagcttccccactcaccctccctgtgacttcccaggtcctgggggctgagacaggagctgctgaccctggcctcgtgtcccctcctcctgggcctctcccattgtccctccccacaatcttgccagcttatcatgctgttcacctttgttcttccagaggtggctggggcgctggggacaggcagcctcaaaagacacagccacagcaagggtggcggccacgtcccgggcaggcggcgaggacagctggagctctagggtatcatgggcctcccaaaagggctcggggggcatctcatgctcatacagaatattcccagcgtagacctaggggagacaccatcgtggggtgagaggcaggtccagcctgtgttgtccagacactgagcacttttgtctcctcaggccccactctgggctctcctgggtgtgcccaggtctgtgcgtgtgacccgctgtctccctcactaactcactgggtcacatcaggcaatgcagtgcagagctgggctctggagccggagcctgggctcaaaccccaactctgccaccctggggaaatcgcctaatttctctgacctctggggaatgcaatgatctgtctgtgctgctctctaaagcgagtacttcctcttgtgcacaggatcctatcccctcttgccttctgaagacaccacttctactgtctcttggctttctcctatggtgtcagttccccccagatgcatcattcccttcattatgcaactatgctattcttttgtctcacttacattaaagctatttaattaattattattattattattttgagacagggtcttgctctgttgcccagactggactgcagtggcgtgatcatggctcactgcagcctcgacctccagggctcaagcgatcctcccacctcagcttcccaagtagcggggactgcaggcacatgccaccacacccagctatttttttttattgtttgttgagacagggtctcactatgttgcccaggctggtcttgaacttctgggctcaagcggtccacttgcctcggcctcccagagtgctaggattacaggcaggaggcactgcacctggccagaaaaaactattcttgacttcacattttccaccagcttcacccctgcccctttgcttctctttgcagcaaaacttcaaaaagcatagtccacgctctcccccaggcattcttgggtctctctacccaggattttgctcccccatcgccacatctccttttgccaagggcaccagaggcctccgtgttgttggatccagcggtcggctctcagcctcctcttaactgctcagtggcactggtgccgccaagcaacccttcctccaagagagccacaggctctgggatacttcactctggggttcctcctacctcacagactctcctggctggtcctcctcttctccccaacatcttatggccaggtctccaggctcttttctgtctacaggcactctccatgagtccttattcagtctcctggcctcaaatgccagctgtgctgagacccccttatttgtagctccagcctagcctgctctcccctgaaccccagactcatgtttccagctacctctgccgatatctaatagacacctcaaactcaacctgccccggctgcactcccgatcggcccccacctcctacagtcatcctgcttcagagactatagctccgttttcaagggctcaggccacacccttggaaccacccttgcatcctctctttccctcaaaccaccgcatctctcacctggattatcgtaacagcttcctgtgtcccagctgcagtcccccgcccattacattttgttcctaacacagcagccagagtgagccttttgaaagggaagattatggggctctttggctcacatagtgcagtgtctccccatctgaccactaaggcctggctgtgaccatatcacccctgcgacctcaactcccctcacctccactccagacacacctgctgttctatggtgctgcctgcagttcaacaccaaagaatattcttcgctccaggaagaaaaacggttttctccacctccaatcacaatgtgttcttttggcctatcttttgctccccacccacccttttttttgagacggagtcttgctctgtcgcccaggctggaatgcagtggcacgatcttggctcactgcaacctccacctccacctcccgggttcaagcgattcccctgcctcagcctcctgagtagctgggactataaatgcgtgccaccacgcccagctcattttttgtattttagtagagatggggtttcaccatgttagccaggatagtttcgatctcttgacctcgtgatccacccgccttggcctcccaaagtgctgggattacagctgtgagccaccgcgcccggccttattttccccttttaggaaacactgggaactattttcttctcagagaaaaacaggacttgcccaatagtaacatggaaacttaacagggtcttaacctgtgaagactctaggagcagaacccggagtaagggggagcaggggccggagtaaggggagcagggccccgtctaagatggggcagggcctgggctaagggagagcagggccgggctaaggggaggcagggcccagtctgaggtgggggcagggcctggtctaaggggagcagagcctgggctaaagggcagctgagcccagtctgaaggagagccgagctatctgaataggggctagcacctgttctaaaggaagtggctgctcccctgctttcgctgtaagagggaacacaggccttttaagaaaatgggaatcaagttttttgtttaatttcccaaaggttatatgttgacaattaacttcaaagtattagctgctttttgtaggccaaataaacacgtctgtgggccagatctggcccaggactagagttgccagtggcaacttctggcccaggctgaatggtgggcaggaaggaaatggagcccccaggagtgggagtgggagctgatgcctgggtacgggagctctgtgggtgggagtgagacaaaaaacagggtcttgagctctggggagcaagcagtgtcctccagtgaaggaaatcctggactcgcaggcagaagttttgcctcttactcgccatgtgctctgaataaagttacctgccctccacgagcctgtttccttatctgaaaaatggggacacctgaccccttccctgcccagtttagtgttgtgggacagggctgctgtcaagacaatacccagtcctgccctcctcccagagtgggccagggtagcccacgtagcctcttccctgctttcctgggtggcactgccagcctgaccccctggtgtccattcagtctagtccttcatatttctggggcacggggaagctctgagtaacgtgggactataaagtgcaagagggttgctgatggcctggtcccgtgccctctccattcctgggcattcttgacaaaggctcccagcaactgagggtacgcagcagctgcagacaccagcctgacaaatatctcattgtggggagggggccatagcaggagtggggagccagggaaatacagaacctgggactgggaggtgttgatgtgagaagcccaagaaacttcattccacctgtcaaagccacctccttccagatgcccaaatctgagccacttgctgggcagggactttgcctttgcacttgctgaataccatctgcacctctcaggagggagagtgccaggctcaggagtccctgccgagctaggaaagggggctggggtgggctctgccattttttgaaggctggcagggggacccctcaggaggtacttggggcagtaccatatgctgtggctcctgagtgagagtcagctctgcgccccacaagaccactccctacccagaattcactgtcatcatgtgctgggtccagatgcccatgcagcctcctggcgggagcatcacatgtgccgcctgcctgggatggcccatggaagagtctgccccgctctgccctgctatggaacaactcctgttctgtcttcagcgagtggtgttcatttaagtgatgactgggctggcccccatggcacagttatcacagagagtctgctgctacccatggctgagagctctaattcttcctggtggtctctgaagccaccaggacggatgaacagcagcttcaccctcttggctgactcagctgcctttcatcagctcatctgcccctaggatccactctgcctctggctggcacttgacctgagccccaggctcacacctctgcccacaggcccagccgctgcttcacgtccaactccatcccccaccaagcactgcccctcatcagctactggggtaccactagtgcccccacatggtgccccctctccagaccctcgggtccggctgtagcttccttctggaagctataccccaagaccccagccctgctctagggccctgtatccccgactttctgcatccttctccctccttctgggaacatgaacttgccctgccagcctggcggctcctggaggacaggacactagcgcctggacaatggcaggcccgggaacgtctgctgccagtgatgctggagctggcatccatgtccacatgatgtccatggcacagcggccacctgaggctgggggcatctgagtggtggctgcaaagttgggcccttacctctgcctgagtgaagttcaccagggcctcccctgtgctgtcctgctgggcgtggaacagccggcctagctgggggccccgcaccacacggtagagcaggagctgggggtcagtgcctgcgctggagctggccctgagggtctgactgctgagtggctggacggaccctgccagaggcaaaaggggatatcagattttgactgggagccaggtccaggcctgtgtttgcaaagaggcagcgtgaccctggcatgccaccctcagctccgccccagctcctggcacccaggaatgcccatgatcagcacacccacctgggcagacagtcagtgtctggctgcccttcagcgagaggagcacttgcttctgggccgtcactcggaagaagtgtccgggggaagtgtgctcgccgtcagagaggcggaagcggaagcctccatccagggttcctggggacaggggcattgggtccagctggcccgagccggctccccatctcagggcacccccgtgggcagcaggaacccgaggcccggccctcagcacccacctctgtgtgagaacagcacgagcccgccgtccagctgggcctgcgtgaagctgcgcacctcagtgcccggcgccccccgcagcactacccgcccgttgctgggctgctcgatggtgtagaccagatcctcagacccagagtcgccgtccgtgctcctcagagcctccgcagggatgggcgcagtggccccctcccacatctgggaacacaggcctgtgaaggttctgccttgccgcactcacccaccccttcctccccggccctgggctgccaccagggctccagtcctgctgcggctcagcccctcgggtggcatcgaggctggcgccactctggctcccctgcacaaagggcctcccgcattcaccttccctgtcaccccagggaaggccccagggaaggtcaccctccaggcccagcctccctgctctccatctgccctagtcctgtgtgtccctcaaggccagcttatgtcccctacccaggaaggccccagctcttaccctcaccaagttctcactcccagaaacccccagcgctgaccaacagtgctccctaatctgtctcactggtgggacaggggtctcctttcagagcctccgtgtgtgcctggccggggccgggcacaggtgggaatggtgattttagaaatgggccctccttccagctgagggaggggtgcgtggcgcagagagtggggggctgatggttggcactgttctgcagcacagaatcagcgtgggatgggcccaggtgcttccagagcagttaggggccctccttatgttgggcaaaggggacccctttttcaggcctcccacttgcaagcagagcaggtgcctgttcctgaggtcctggtaccagtcttgctgggtcaattacttgcgggcagagctgcagtgggactcacatgcccggaaaacagagccttctggcattcctgggcttcctcccccggccccagggagccctcaggcccagccctggcaggaggggccataatgttgcggggcaggaccccagcactaggcttctggagcaaacacaggtagatggcaccacctggtggctgtgctgccacacagccgtcctggcctgtggttccagagcactgtgtcccactctttggcggcttccgcaccaccaggccacccgctacgggcacatcctagaccaccaaggccccgcccccacccccgccccaggcaccccatgccagagacagcccaagtcagccctttatggaaacttcagtggctcctgctgaccggggaggatgcaccccagaagctggggttcaaagccctgccatgtgggctttgtaaagccatgccctttctgttccaccagaactacttttgcaaccatggagaagttccatcccacgtctgggcctcaacttccacctgcagagtggggcccttacctctgcctgagcgaagttcaccagggccttccctgcactgtcctgctgggcgtggaacagccttgtgcaggagtttggggagccaagccatggccttcacttgctgggtgaaggtgggaaacttaacagcttccgccctgatgcctgcccttaagggcttgtaagtgattctgtcagatgttctggtccttagccacagaagaaggaacagcagagccacccgtggccgctcagaagtctgcctaccatacttgcaaacatccaataaaaaaacttcccacctgtgttctatttcagcacaatctcacttctctccttccaacaaccccgtgaggcatgtggcagcgtccccattttgcagaggaggaaactgaggatcagagctgggggagctctgagccgcgaagtaggggacgctggcctctttctcgaagcagacatgggggtgttcccagggatgctctcacctgcaggcctgtgtttgtagtgaggatggggggttggtcattgacaggcaggacagtgacagtgaaggccacaggatggctctggcgatccatctcggaggcattagccatcaggacaaaactgtctgtcagtgtctcgctcccgtcatgcacgtagcggatcagctgctcttccacctaggggcaggcccagggctggcagtcaggccccagcagcacccttcatgccctgcctttgggtgcaggaggagactgactcttttagggcttcattttccattggtagaaaatggggaccataagttctggctccgaggagttgtgaggaagaaaagatatatggtatttaaagcataggtgcttctgaaatgtgactccccgtctcctctctgtgtataacccccagactgggagtccccagggctccctccactctgcccccagagctgggctgcagcccctgggcctctctcacagccataccattctccaggagaaggcgctgagggtcctggcttgaggtccgtcctccttctgcagggctccatgctggggtggctccagcacctgcaggctgaggcccaggagagtggggaagtagggcccggagacacggagcagtggaggggccagggtgaggctgccaccctcagggacgctgaagttttgcgcctctagtgggatggcagcgggcagcacctccagctccacaaggacgccctcgaggggagcacccaggcctgaggccacatccagcgagaaggcatcgctccaggcctcagggcgggagtgcaggtacaggaccctgcctgtgtccactgcctcctgggagaagctctgcacagggtccaggctgggtggctcatctgccaaggcgccacgcgacaccatcaccaggtagccggcactcggtgggctcttcactgagaatacgatgtctgcaggtggcactgcctcctgggctgcctggttaacagaggtcacaaggactcacagggggccacagagggggtctcagaggggtccactgtggccctaagaagccggaacaggcttgatcttgccccacttattcctctagataccactgctcatttagacacacaaacacacacgtgggttcacacacacagcagccagacatgcagctggtcacattttttgttttttgagacagggtctcactctgtcacccaggctggagtgcagtggtacaatcacagttccttgaagcctcaacttcccaggctcaagggatcctcctacctcagcctcccaagtagctgggaccacaggcatgtgccaccaggcccggctaatttttaaattttttgtgtagagatggggtttcactgggttgccccggctgctggtcacatgttaatgcccaccccacacacggttgcagggggtcggtcacacagcttgagatgcactccctcagggaggtgcataatcacatgtccccagactcagtgacacagacacacgagttcatcatatgctgacgcagtcacacatgtacacatgcgtgtgtgcacacacacacacacaggcccccctgctcaggatccgttcaggcctgtggctggtttgcaggcagcacctccccagcccctgctattaccacccaggaccatcagagggcgccccgccccacccctcctggaggcacagccgccttcagctcaggccctacagagctcacgccccaaaggccacacgggctccctcacctgatgggccagccacaagaggccaaaccaccccccaaactcacattcctgttctatgcatttgcccggaatgttccttctgcctggaataccactccccattctctgctcctgatggcctgtgctcttcagagcccggcccaaacgctgcctcctcccgcgaggccttcctgactccagatctgctggcttgctgtcggccccaagctccagacatgcagaccagaagggtctccgaaatgagcagtgtaggagagtaaggccaagagcgggcaaggactggcctgaggtcacagggcaagtcagtgagcctgctggagggcccgtggttgctctgtggggttcctgggtgggcagaagccacccaggtctgggctctgagaaaagagtgggggacatgagggtctgaggagtagcggcctgtctccacggtcagcaatccccaaagctcaggacccgtgatgtcctcccagggaactgactgcaatggagattctcgggctccacgtcagagattctgtagggctgggtggggtccaggaatctgcatgctcagccatgtcatacacatgagtggacacaacctctggaggcgcacacaactcccaggaggatgggtgtatagcaagctccccagaaactcctgggagcacaacatatacgggagcacatctgaggcacgtgcacacatgtaacctggagccaccacagccacagcccaagtcacgtgtgttcctggcatggaggctgggagaaggccctctacctggcccacacccctgctcaccacctccaactcctcacctccagctggtcccttctgatctcagctgcctctccctggaagacgtagatcttcttgtgccggaccagcttcagtggggccagtgggccctctagggcaatggtcacttgtagggtggcatccgtgtgcactggccctgcttccacggagaaggccatggtgtcgcgggggctgaggctgccattgtggctatagagaacggccccatccagcaggtcctgctgggagaaggctgtggctggctgaccagcccggactagctgtccccagcgagggccagctgtgacgtggtagtggacctcatccccactgcggatgtcgaggttggtgtccaggtggagcacggccgtgtcgatggtgccctggcctccttgagggaccacaaggctggagccgttggccacacggaggtagggttccgaggcctgcacctccagcagcgcagtggcctggtgttgcccgtcggacacctgcagctggatccagccacggtcagcccctgagtgcacgaacagtactcgcctcttcctgaggtcctcctgggtgaagcggtagatgggccgcgtgggctcatctacggccacgatactgccaaagaggaggtccttgcgggtaagcaccagctgggcgtcagcaaagcccgagtcagcatcgctgaaggccacgtcgtctgtagtcagcagccgccgcccaccccgggccacatggaagatccggctgatggtctgcacaggggcgtggtcattcacgggctggatggccactcggaagacaccccgtacctcctcccaggccatgtcaccactgctctcgccctggcgggtagcaacaaatgggatatcatcttctgtggtctcggagtcatcatgctggtagaccagccggccacgcaacaggtcttcattggtgaaggatgtcaccatagtggtcttgtcctgtgtcccacgccaagccaacctcccatggcggggccgctccatgacctcatagaggtagctggcactgttgagactcttgacaaagaggtggtcagcagagaggacaccctcaccaccctcaggcaccacgaggaggacattggtgaggacaggcgcatctgggtcaccaccaatgtggatggggaaggtatagagtggggagaaatatggtggagctgtgacacggaaacggaaggtgtcctcgactgcctctgaggcacgtgctgtggccccataggtcacccggccagcctgtatgtcatcctgggtgaagccctggccatctgacagccttgtgccctgtagttgaaggttgcctttcctgggagcctgaaccacctcataatggaaggttggggggcttgggcctgcctcctccagggtggcctccaggtgggctgtggtgagggtctcctgctgggtgttctgagtgtgcagtggctccagccgcagcatccacacagtggctctctggatggtcactgggaaggacagattgctcaggatctcctggcccacctgcacctccagggccaggttctccacggtgtcgtaagcgtggtgctgtgggtcagtgctcaggtacctcacgcggccctgctccacatcccgctggtggaacgcctgtgtggcccaccactcagcaccctccaccccacctgccccctgcttctgcagctccccaaactgcagggccccagtgacgcggaacagcacgctcacatcctgccccacggcattggtctccaccgacaggttggcgggcaagatgggcatggcagagccttgggccagtcgcaaccctgtgctgcggtggatctgtatggccggccggatggccaccaccttcagcgtggccggggggctggcctgcagtccatcgctgacccggaacgtcaagtcctgtgcaggaccaccgcggtggacatagactaggctgccggcctccaactcccggcaggagaactcggtcgccggctccccaggctggtctcggcgctccacggggaggccagaggaggtgccaaggacctggaaggtgaggccctcacaggcagagtccgggtcataggcctggaaaacctcaggccccagcggcttctgcgtgtgttccaggatcaccatgaggctgccatgtgggaagatgatgtggggtgggtcattgacagggttgacctggatgggcaggaggtatgtttggcccctccgaaggcatgagggcatgggcacccgagccgtcaccgacacctccagcaccagctggtcggaggtgtcctcagagccatcgtggatgaagcgggccttgcggttcaccacgtccaggagggtgaacatttttcgtgcctgggctcccgggatgtccagctcgagctcgccatggcgtgcccctcgggtcacgctgaacagcacctgggatttgcgcagctcagcctccatcaggtccagcgtgggctgcacatgcctccactcaagccaggctgtgcccccctcggccaccaccagtgggctgatagtcagcagctgggtgaaattggcaaagacaggaggcagccctggctcaggcacgcatggctcaggcagctccatggctggccaagcctcaggggccagggtggagaaagcttcataatgtccataggcatcgtcctcatactcctcctcctccagcctgcagccggctgccatgttgcgcgtcagcaaagcttcccgcagcccccgcctctggccattgacactgaggtcttccatgcagcccagcagggaggcattggtggcctctggtgtcaggcccaggcggtgttcctggaggtgacgagaggcctctgcatccagccccccgagaaggagactgccccgtggctccaggtagctgaggactcctcggttcgaagtatgcgtagggtactggtccacggagatttccagccggtgagcattgatgtggacactgacctcatggggctgcccatcggccacaggcacactgttgtggagcaatacggtaccctggcccttctccaccacggcccgcaggtggccctcaaatatgtccacatagatgaagtccccacgccggccccctgcctggaaggccaagggtgcctgccggctctgtgtggtgagtgtaaactctagggttccttcgtcctgagtgccccaggcagggaaggcagccagagagtggggcccagagaagcccagggccacatcatcactggcagaaaactcttcagcacagccctcatgcacatcgggggtcagaggccggaggaggctgcggccattgagggtggctgcatggaggcaacccctcaggggtcggctggttcccctcaggtagggcaggccaagggtcccagtgcccccaacaaagagcccataggggacctctaggggggctcctgggactgctgaggaggcgttcagaaacccatcgactgacaacgtggcccagccctctacgacagtcagcaccacagtgtgggggatggagtcactcagcagcgtctctgctggagtctgcagcctcagctcctcctggcccagaacaagtctgacctgaagagagatggggagtgggagatagtggacagcactttggatccatcatttcccttataaaagcatagagccgggcgtgattgcagtggtggctcatgcctgtaatcctagcactttgggaggccaaggcaggcggatcacctgaggttaggagtttgagaccagcctggccaacatggagaaaccctgtctctactaaaaacacaaaattagctgggcatggtggcgcatgcctgtaatcccagctactttggaggctgtggcaggagaattgcttgaactcgggaggtggaggttgcagtgagctgagatcatgccattgcactccagcctgggcagcaagagcgaaactctgtctcaaaaaacaaacaaaaaaaaagcatagtgagttccccacacttggggccccagagtggaaaacctaggacaagagcctctggtgccactcctcttgccgtcctgccatctctttattcatcctccaaacactcaccaaaggaaactctgggccagggctggatgggctctggggaccctgatatgaatcagatgtggtcctcgcccacaaggaactgacatacagcaagatgctctcctagaaatccaacctgtgtttttaaattcttcccctctttccttgagtgagaggtgccagaaatattgtcttggaatctggatttcaactttggaataatgggtaactgggaatcccttgatcagtccccttcaacagagcaaagtttcttggggtcattgaaggcagccaggctcactgttcaggaataggctaatttttaaattaaaatttaaatactctgtgttctgaaaaaaagctccctgacctggggtggaaggagatcttggggagagatgaaggacatagttctgtctccatgacattgacagcagaaatggctctggtacggtgctcccagatggtagaatgggaggtggcagagtatggtaactgcagaaccagggcactaagaactataattttggagtcctggtatggagcatctctgtaggggtgtggcatcattgtacctacagaactggacagccatcagcaccagcctgcaccacgctggtgtttaacagtgaaagcagcagactgaccaagccctagtcctctccccatggggtgtggaaggagatggctgccccaaatttgtttttttttgagacggagtttggttcttgttgcccaggctgaagtgcaatggtgcggtctcggctcactgcaacctccttctcctgggttcaagtgattctcttgcctcagcctcctgagtagctgggattacaggcatgtgtcaccatgcccggctaatttttttgtatttttattagagacacggtttcaccatgttggccaggctggtctcgaactcctgacctcaggtgatccacccgcctcagcctcccaaagtgctgggattacaggcatgagccaccgcgtccggttatttttttcttttaaaaatagagatggggactcattgtgtggcttaggccagacttgaactcctaggctcgagtgatcttctcaccttggcctcccaaagtggtgggattataggcatgagccactgcacccagcctggcacaaattcggaataagaccctgggttcttaaactcttcatggtttaggggaagactcaaaaaagccacaagactccttgctaacaaagcttgtggtgtcttgaaggatgaaatggaaaaatgaggaagctgaggcagtactggtgctgttactgtcgtggacagaccatggtgctgcagagaaattggtgcagtgccaccgggatgcacaggggtcatgggggctcaggagggggcctagcccaggaggaggggatgcccacactgagacttcaaggagaggctggagttaggcatgtgcagggaacgggagaggcgcacacctggcagaaggagtgtgcatcaagagcctggcagcaagcgactgtaagatggccaggaactgaaagcagttcagggctgtcagagcacaaagggccagcgaggggttgtggcgggaaacatggttggagggagccagtgggcagagccagttcatgaaggatttaccatttctgggctgctgctgcccatcccacagtggagaacttaagaccccaagataaaagtgacttacacaaggtcacacagccagctggggttcactcaaagctagagaaggaatcccaccccgaatcccgcccagatctcagggggacgtcactcacctgcaggcgtccagagtagagctgcagcaggaggtggtcagctgggcctgctgccaggagaaggagggcttcgggctgggacgtggagaactgcagctgcaggtctatgtcggtcagagccgtggccacaggcacctccaggtggttctcaccgaagaaggaagctgtgtgagagagggagctgtggtcaaggctcagactcttgcctggaggaggcgaggtgccgcaaagagggacgggtgggttgcagaaaggggtccgtgctggcgcaccctcatggttctgctgtatggtgctgcctctgagcactgcccgggtcccagcatcttcttggtcctggcaccagaaggcacaggctcaccttgtgtccagcccagatcttgtatttacaggaggtcagacccagaaattcccagcaactcaggtctcctccttggaggttcctggagccagaggcctccgccagctctgactcgcctcccctgggccccagaggagtctccctcgtgggtctggctcctggacccagcccaaagggaaccgcaactggcctgaccatctggcttggtggtcacagccccaaggaatggagtttctggagaatcacccccagtccagactgatccctgctcagattccttctcctaagtgcccttgtgcttgggctcctgtgcagcgcctgctgtgccatgccccgcctccatgggttggctgaggccacgactgggatctgggggtggtgtcagcatggcccacctatccccgcttctctctcaggccattcttccagctgccattgagcgtcggggcaggagcttattggcctgagtctgccaaggagcaaaggctctgaggccagatggggaccatgtgcagtgtcaaaccaaagtgggcccacacttcctccattacccttgctattgcttcctgctggagagctattcacagtccccgatgagcagtcagatccggccccattgtttccaccgtggccaaggaaccagggatgagaacagctgagttcctaacttccccaggccaccacgcaggctgaggctgaagacagggcttgggaggggctgagggtctgctgggcaggccaaagagggcctccccaggcagaaggccatgtctgggcttgcctggggttagtggttcctatgcagggcccgttctgtcccatactgggactcctcctcttttgaattgctgcttcctccagtcagtttccccagattagcctccctgacttccaacccgctgccacaatttctggtccatgccttttgtggtgataagagccaaatataactttgactttgcctgcagatgtccagggctggggggtagagaaacacgggttaaaaacggtgattcattcctgttgggcttccctcaaacccgagagcgagcacaggctgacggccttgatagggataatccggcaccagccccatgtgctggtccctggccagcctgagccagctgccatccgcctgagtaagcagcttcagccgttggaggagtcggagacttgtacaccctaagggcagccagccccactgggagggatgtccaagaaagatcccgtaagaaccccttgggctgagttaaatcccctctagttatctcctcctgccagcactgctggcaataccagcaccttgtctgggaagctacgggaatcaagggagccctgcagaccatctgcgcgggggcggcccagctggttcagcagagcttggcgccagcaagggacagaccagggaactgcaggtggcggccacctaccggggtgccttatctgcaaagacattgattcctaagagcaaaacacagcacactaaagtgagggaggccatagcacaaggggtgggggcacatggccctgcaggatagagccaccaccgtcacctgctggagcggctgacagcagctgccaggagtctactgttgaattttcaggaattttgagagccaggtgatactgcccacagtgagaacatttataccaggaaaagaggcaaatactgcaaatcagggttccccctccccaagaaagcccattgctaaacatttacctatccagcacccacagagaagggggcacatgtccctgcccctacccacccttgcactaaaggtatatgtagacccgccaagtcatggtcaacatcagggctctgggccaggcaggaactgaactagatggttggccctaaccactgaaccacctgcctgcagccccctcccagcagaggagagtagagcctgtttggccagagtgggagggtggcaggaagtagaggtactttccagagcgctggggtctgaatgggtccattgaggggctgggccctgctgcttcctgtggggctgagcgggaggggctcacacaggctgtcttgtgctgctggagcgcgtggccaggcagccccccaccccaacagaggcctctgaggccttgctggccagggctctggaaactctgacagcgccactccctccacctcctggtctccttttttctgcccctcttacactctctgaggggcttcagttgcaagaactcagaatccctgtcttggaggtggtgggggggcagttgaagaggggcttcaaatggagagggtgtgcagaattaagatgtaataagctaggagtcaatccagaggacttcctggaggaggtcacggtggtgtacagacacagagagggaggaataggcagtctcagaggacagcagcaaggccgagtgagactggcaggaagtacacaggtcccctttgggtggggctaggagggtttctgctccatcacccgctaaagcctctggctaacttgaaggaagagaagtagagggaaaagtagaatgggtcaagctaggctcggctgcgtgactggggcggggggatggaggaggttgtggggagacattggcacaggctggatcagacctgccgttgattctcctgggtcaagaggacccatgattcatcaaaacagcagaccaaacctgtagcagccccatgggctgccctctgagccaggagaaggggcccacttcaggcctcagtgtcaccattctgtaaaatgggcacagtccctcccaccccttccccctcctgactgtggggattagtcctgggggtctctccctgatctaggagtttgctgtccatatggatgtggggaaggttaatggcatggggtgcctggaggtgccaagccttgggcatgagaggagcaggatgccccacaggtctgggggcccgtgggaggggcaggaagagtgctgcgtgtatgggtttctctctctggaaggcgcgtcagtgggcgtccagggctgtatattaatagatgtgtatttgtgtgtgcgcaagcatgtgggtggctgctgggggtgtgctttgggtttgcgtaaggctgtgtgtttgtgtgtgtgtgcgcgtgtgtgggccgggagctgccaggacagagcaatgattgtgcccgggcctgtcctgcccttcggtgcccgcctgccattacttggctgggcctggctccatgaaaggggctgtgtgttcttggagggttcctgcccctcctgctcagcgcccatagagaggtttgctaaaggtgggtacatcctcaggcttcccacccttcctccccataaacagggcactgctgtctgggcctgagggtggggtggctccatccttcttcctgagatctaggcctgggggcacagaaaaagcctgtttccttccctgccaagtcccttctcaggggctagaggaaacctcggtcaaggtccccagcaagccccctctgtcagggcaagggctgcgctggcatctccgggctccccggaggcactactaggaggagtgtggatgggcccctgaggcttccagcctgacacccagccctctgtctgacaccaggctccggggacaaggagtcgctgtgaggggaacatctctgcccatcaggcccgcctcccccggccagggccccaccttccccagccaggccagggccgggtctcaggcacagatgcctcttccaggctgagggctgctgtgggctctgttccttctgagtcctcagaaggctgcctgtgtccctgtatctgccccatctctccttcgcctccggccatccctgctgccaggctctgcctctgctccccctggtctccccctagctctttggctccctcttccctctgccccatcctggctgtccctgggcacatcaccctttgctctaggacagtctggagggccccggcctggggccccaccctccatgggtgctgagtcccacagcatcagcattctctgtagctcaagcctgctgcagggcactcagcttccaccttccagacagacaaactgaggctccagaggagaagcgatttgacgaagagaagcagaaagagatccagcaggtcccagcaccacccgtgtgagccctacccacccaggcacccccactgtaccccactctctggcaatggatccctgtgtgccccactcccgccatgttcctggttgcctgggggcagccccacagccaggctgcgtcatgggagcagcagcattcctgggtgtctgctgctgcctgactttataagggagaaattctgggagcccggagctgctggcccgtggggagtgcctgggcccgtagttgagggtgagggcaggagacctggacatctgtatgtgggggagggacacccagtgccacagagacagagcaggaggtgagaggtggaatgcgtaatagagacccattcattcattcactcaatcacaaatacagcaatacagtgatgggaatggaagaagacagctaacatgggagaaagttattaaaactgagaaggagaaatcaagatgccctcctccataaagactggattcacatacagaccaaggcctgaggaaggagacggaggaggaaaactcgagggagacagagaaggcgggatgttggcagcaagcctgctgctgtgcacaggagtgaggaggggatgcccagccagcctgctggggagggagggccctgctccaagacgaagccagacttctccatcaccgcccctcggggtttggcaccacggcgggagatcctggctccaggtctgggcaggcaggggtgagggagtctgagggggctgtgggatggggtattctgggagggccaaggccgggatgaagggctctctgtctcccctcataggtgtgtatgtggtggggcggggggtggtcgtggcccacctgggggctgaatgccggctctgtgagagcatggacgggccaggtgtgcttccccagcagcggaccctccctgaggtcacctggccctctagacctcaggtcagttcccctcccctccccttgcacctccaagggactccccgattttacttccgccaccaatctacttccaaccaagcaggcagggcatgggtgagtgtgtgcaggaatgtgggtcagtgtcacatgtacacacgtgtgtggcggcaaggcaggcgaggaaggggtgcgctgggtccctggtctggccccactgtgggccctggataccgagacataactgggggtcccctccccagcacattggtctccctgggctcctcaggcaagggagaagctgtctggtgtgcctactcaggggtgagcccctctcaaacctcctcccagcagactccccaaggctcagccacccacactgagctatcaccttcacccaaccctgttactctgagggtaacaagggggtaggttacaggggagacttaaggtcagactaaggggagcgacctgcccagtgatgacactggggtcaccagggcccaggcctagaaggctcatcactggccagggtgggctgcctgggagacgctcacacacctgcagacccctcagggctcactgctctttagcaactcttcctggctgcttccagactgggattccaccacccagggccatccccgcggcccaaggactgcctgctcctctcctgtcccgtgagctaccgaaatgcggacaacagtaggttagttccaaatcccatggagcttacaacagcagccatcatctcaggagacactgctttatcccagtggggtgctggagtgctaggcacctgctcaggtgactgcctccacgtctaaatgctgcagagacctctgtcggggtcagggcagcaccaaaaactcttgagccaagagacacacactcaggtcagctgaccttctgtttagttgcctttctggtcccttgcaaggccaagggggccagggaggaaaacagtttcctcagctattggctgggccctgaccctggtcactggcctcagctaccatcctctaaccaagcgctttgagtcacccacgtagaggggcatgtgctggggaacatttccagttgagggaacccgtctggaagatgagtggaagcaggggcaggtggggtgggagaagctgagcttggtccacagaggctgataggggctgcaccctgggctcccagccacatgtcccaaccctggggccttgtggagcacagaggaagcaggaggggaaatgagaggttttgagggaagaagcagcccagagtccacccaggcgggagggctgggccgggggaggaggaagcggggcctcaatggtgtctttgtggaagtcttgctgctccccaggcctcaggcgaggagggtggggtggctgcggtggggagcggttccaagaggcttttccctgccttataatcttccctcttggacagggagatgggtgggtttccaggctccatccgtaccctcctttcccccactttcctggccctagaggacctgggaccctcacctcagtggacccaggctggggtagggtttctggcagggaagagaagagtgaaggaccctcacttggcactgggcctgcacagccccccagccctagcagggctcctgggaggcatctcccatgttacaggtgaggaaactgaggctcagagagggcagtcctccgtgctagcctgtggagcagcggcagggctgggacttaagctcctgtgggtgtggctccagagctaggggctgtgggtgtcagcagggcacatgcaccgtgtgtgcacccagagaggcgtggtgggtttgcttgctgcctgtgaatcggaagtggagcatctgccaatggccccagtgggaggagggtgtgagagctggaccccagcctggggaacacacactctttcccttcctgtcccctgggactcttctgtcagggccgggtggagggggcagcgaggagggggggacagcgaggaggggagggaagcatctgctctccttgggcggtttggcagcccctcctctgtggctctggggctggccgaatcgggagggcccttctgcaggggctggcgggggatgactaggtccagaagccagtgataagtgccagccctgcccactggtgacttggaggtctgggaggagggtggagagacaggggtctgggtgggagctgcccccaggaggctgagggccaggctctctcctgggctgtgtccaggaccaggcagcccatggctcatctctgagttccccttggctctggcagcagaaactgctgaagacagggctgctggggcggcgtctcggggcttccccagcctggcgggctgggtctggagatagtgagtgtgtgagttgggatgggggaagaacagaggaaatggtgactgtgggtctggacggctgcctggacctgaaatctggtggcacaacttgtgcacagtagccttgtgtgcctcctcctcagttcccccatctgaatacagagggtgggctcaccccacagacagaagtccatgtccagggcagaagcctgggtcagggctcacacccccagcacacacacagggctcagagccatgtgcttccatgctttccctggcctcagtgtccccatctgtaaaaggggacctggatagagggactgacacacatctggcctctgaccagcccagcagactggcaagaggtgtggccactaccgtgggtacagtagagccacctctggcctaaatggccacaggtctagccagactggaagctcttgaggacaggaccagggcccacatctccttcccagggcatctgtgcagcaagaaggccatggacctgtgatgagggaggtgatgtcagcatctaagggaacgaaaggatcaaatgagatggcatttgtcccgtgtgagggtttttctatcaggcagagctgtcccaccacagcaagtcccagcactggtggtgctccagtgggagggcgttgccggggggtgcaccaggaaacctcagtgtccttgctagtgaagctctgggctacccaggcccatcagagatcccgagactgagacctctcttcctgggcaggcctgactcctcctggaataggttcctgcctagcacccccacctgccaactgcctggaagcctgcagcctgtgggccccccctggagctgtgcccaccgccaccacactccctctggccctccttttctctcccggcctcaggcccagcctctgctaatgcaccacgtctctctcactggcaccaactctccagggctccaggcccactgccagtgtccctcagatgtccatggcaggaacacccacaggaacccccaagcccaaccccacccaaagcaaggaggactcagtgtactctcccctacagctggctcgccagccccgtgaaggcccgactgtccacctgttgctgagtagacatctgagggtcgcactgaactctcctcctcctccctccccacagccactgctgattaatactcaggttccatccatccagtccccaaattctccttcaacttcatcttcctctcttgctccctggtccatccataaggcggctggccaccgtcctcggtctggcttaatcaatctcctgactccctttgctaatagcagccccagttaacccaaactgaaagccactccctcagcctcccttgcctttggtggctcccattgccccagggtcaggcccccacccccgggtggcactgaaggccagggtgccctcaactctgcctgcagggtctcttgctctcttccaaggacactccacgcctccgtctcactagactctgcactgactccgtgcacacctagcagggccgacctgctgccttcgctcaggctgggcctgctgctgggccagctcttctctcctgtccacctgtgaaatgtcctcatgctctttcaggaaaaaagcccaaagcaccttctgtgtccttggggtgcaaagacactcgctgcggcccagggggctgtgctgttgtcacctctctccatttacactgtgagccttggggacaagactgaccttgcttggggacaggacgtgggaggaaaggagggaggggcccaccagggcatgagggccatgggcccagtgggaggggctgcctctgggagctcgccccagccctccccaccttgtcttacctccagtctcctttccaggcctcctctgccctccagagccccagggctcagaggcaggggactggacactatggcctgggagggctcgagggactgccagagccagagactgcttttctgggcctgtggtgacagagtctggtgcttgtttttaaagaaaatagaatccgagcccctatttatagccggaggccacagccacagacagaagacggatggggtttgaggcttacaggcccctgctctagcatggactgggaggtggggccattcccaggcccccctgcccgcctttgtcaacccccaaggaagtgcctgtgggatcctgacactccctgggacaggatgtagcctgcactttggggcacgggaggacctggtgaggggagcggaacatttctcaggattggtccctggggcccagagtcccttgtgggaatgggaggaggtgagggtctgttatgtctactgagaaggcagagagggccctggggacgggtggggtgctggcggcagggagcacttctgactgccgtggaacccggtaaaggagaagggaaggagaacagagcaggactggagagatgggcagacagacagagagacagggtaggaaagacagacagaaagagatggaggaaccacagccaggggtgggaaaggacagagagatggagagagcgggatggggggatggactgagagatcgggggtgctctgcagcccgggtgaccctgcgcaggggcagacagaagccgtgaggggagactgaagtgtggcttccgtcccatagagtcttcatggtgctccaggcagcgtggtcagagtccgggtggagccggtgaggagggaggaagcaggcgtctctgtggcctcgcccacccccagcctccagggtctaggggctggagaccctccgttcccggcagtctccacggggaaggcccaggcctgttggaggcaacgcaatgcggtggggcagagcccagattgaccttgtcaccaagatccccaagggctgtcttgggcacggccgggaccttgagggacaggtctggtctctggcttgttatggagtgagttccctaggcctggagggctcacaagctaaggctatggcctggactcacacctgctgccagcctctacgcagacccctcccttggctgcgcttgtaggggctgtggggtaaccgtagcctggggcatgtgtcatggagccacaagcagtgactcagacagttaaaaaaggagcagctctgagtggtgactcaattggctctggaggggctgggtgggtctggctggtacaagatggggtggtctgggtttatttttggcagggcggggctggggccagggggtggaagatgggagccgggggtggagaggagccgctgctctcatcccggggggagccccagggctccatgccaacttaggaaagtggctttccaatgccagggagtcctggcaggctgggctgcttctcagccccattccaggcctagcctgccttgctgcttggcccaggacaagcagctggctctctctagatagaggcagaggcccctgtcctgttcccaagaggctcaagctcagaatttagagctgacctaggagactgaagattccacccagaggcccagatagggccaggggtctccccaaggccacatagcagggccaggtagcccaagggctgtggcaccatcagccagctggctcaggcctctacaatatctcgctggccccagggctgtccacggttggagggacagcccccgtctgagtacccacccctggaggggctcagccaggctccagatgggtggccagaagcacacgggccccagatgcccagagatggaaccttggccaggggcagccacctggattccattaaaacatgtgggtggggggcctggccgggccctgtccaggggtctgtggagaagagtcacctctacgtgggtgaaggcagtgggggcctgcacaatgggatcttgccctgagggctcaggcacaggcctgcccttgtccggggtccctccagtgtccctgccccgagctgtgcaccccactctgcagtcacctcagtcacctccccacacctccccctactctgagctcacatacacccataccactgaggggtcctagcagcccagagcggagagggctgtcccctccctcagtccggatttctgctcctcgtgatgcagccaccactgcttatatcatgagtggtggtaacagccccatggtgactctggcaggtgagctgtcccacgtccctgggccctggcctccagcccccacctccagagagggactcgcgaggggttggtagagagcagggaaaagacaggcttctagggtccccgtcccataaaaggtcttggggcctgctcattctcttctcctcactcacctgctctggggacagggggttcctgctgtgccccggcccagtgagccccatcctaggggctgttaggcttgggagaaacaggccctggggagggccaggcaggggctgtccccacttcttctagcactgagagaggggtgtgggcctcagcccagttagccacagagatgcagacccccaccccctcccaccttctgaagggtcctgggctggcaggcagccgctggctgataccctctccagagcccacctctccttttccatgtcacttagtcccacacagactcacggggccacctcctctaggcctttgcctcggaatcttccttaaacactcctaagcagaagtccccatgttgccgggccactccaccctgggaagaagatgctaatagcagagtgactgcagcttcaggagcagatgtccaccgagcattgattccaggcaaagtgtcttgcttaatccttacaacacgtaagaggttggaattatttatccccattttagagaggagaaaactgaggctcagaaagacagagtcacttgcccaaggtcatgcatagagcgtcagggctggaattcaacctgagctctctaatgccgtgtttcaccaccatgtgcctggcctcctgcttccctgtgtgggttcccacagctcaggactcagaggagggagagatggggcctgggtcagggctgaggggcaggggaggggctccctctcagctgctcgcagactcccaaaaagggtgatttgctcctccttgaccagggtgggaagtaaaagtgtgtgtgtgtatctgtgtctgtatgtgtctgtgtgcatatgtgtgtgtctgtgcctgtgtgtatatgtctgtgtgcgtgtgtgtgtgcgtatgtgtgtctgtgtgcatgtgtctgtgtctgtatgtctgtgtgtatctatgtctgtgtgtgcctgtgtgcgtatgtctgtgtctctgtgtgtgtgtggctaggcctcaggcctgcctggctggactctagctgcaggagagctggtctggccccagcaactgtgcacagggaaggggcagggagaagcgggtgtcgtgggaatcagtgtcctggtcccactggtatttatagctgccccttcctgaaatgtgggtgggggaaggggctgctcttaggtgggaacggaagttcgtctcctctccccagccccctctgtctccccagagagtggactggcccaggccagagggcctgccctggcgggggaacgaggcactgtgtcctgattttgggggttttccctggggctgctggctcggggcaggacactctccttgcctactgagcaatactgcgtgtgtgtgagtgtgtatgtgtgagtgtatgtatgtgtgtgtgaatgtgtatgtgtgtgtgtgagtgtgtgtgtgcacacacacgcatgtgcacttactgggtgtcaggctgaagaaggtcatgaaccggggacagaggccaggtgagggtaggggaagaaaggcctgtaaccccacagagatggagggcagggccccaggagaggggccatccaggtcatgggtctcagagcaatctgtggttagaacaggctcctgggggtggcgatactggagctgagccttggaggatgggggaaaagggaaggcctgttgcatggagcagcttgagtagaagtggaaaggtgccagcggttgtggattattatctgatggcctagttctatctgatcagccagtccgtgggacacaggatcaccttgaccagggaggatgatatatttggggagagaaggacatagcacagcacagttgagcatccctaatctgaaaattcaaaatccaaatgcccctaaatccaaaattttttgagtgccaataggataccaccagtggaaaatctcacacataagaactttttttttttttttttttagatgaaccctcactgactctgtcacccaggctggagtgcagtgacgcgatcttagctcactgcaacatctgcctcccaggttcaagcgattctcatgcctcagtatcctgagtagctgggattacaggtgtcgccagcacgcccagctaatttttgtatttttagtagagacagggtttcaccatgttggccaggctggtctcgaactcctgagctcaggtgacctgcctgcctcagcctcccaaagtgctgggattacaggcgtgagccaccgcgcctggcctccacacataagaacttaacataaatttctctcaggcacaaaatttctttaaaaaaatctataatgttaccttcagcctatgtgtataaggtgtatatgaaacataaatcaatttcatgtttagacttgggtcccatcttcaaaatatctcactatatataacaaatattccaaaagccaaaaaattccaaaatctgaaacacttcaggtccccaacatttcagataagggacactcagccagtgtggagtgagggccagcaggcagtgggcaggagtgggaagctggggcaggagaggccacacagccccaggcctgctgtgaggaagctgggaccaccttctgctcccggcctccaggctcccagacttggggaaggacatcttccaagggcccttagtaccaatcttcatggaacccaatctataaacaggtttgtggagtggctctgcatgaattggggtggggcaggcgtcccatattcccaagctcagctgcctccaggccggctcagctggagagccctggggtgcgctggagtgcagtcagaaaatccctggttggctcagtgatctctacacccctctgggggccaggctgtgagccctacaatgggggagacccctgagcaaagcaggtgggatgtgtgctcccggggagctgctggtcctgagggtgaagctaccccccaaaccagggccaaagagtagggagccctccccctaatctcctgaggactcactgtgtgactctgaacaagcaggctcctctgtctgagcccgggtttccccaggatccatggggggctggtctggggtcaggggtttctgcagtaagttccgggaagggaggcagcgtcactgacacacctcaaccttaggccgcaggagagccacacactgaagtgttgaagcaggagcgatggctggaggcctggctaacgcatgcatgccagggctggcagagccagcggcctcctccacaggctgggagccggcctgggtgtgggaaggagctgagcgagaggcaggaatgctcaacaggacaggcactgtccctgatggggcccacccctgccaccaggccaccttgacagcagccctacagctatcaccctacatcagagacaaaagtggcttcattggcaaccctagctttggggggagagggttttttgaaggggatttgcttaggctgtgagaaagtggggagggtttggaaagggagagaacgctggctggtgggggatggggagacagaacaaacatctggagtcctcagcgagctgtctgtccctgcagacctctctctttcccctgctggggcctgagcccactggtgggtggttgtccacctggcctgatgtggggaaactcgctgctgttggggtgagtgagaacaccacggcctgtgtgcccaaagagagacctgaggcagtccctgcttttctctgagcctcagtttcctcatctgtaaaataggactgttggacaggtatggtggttcacacctgtaatcccagcactttgggagtcccaggtgggaggcttgcttgagcccaggagttcgagaccagcctgggcaacatagtgagacctcgtctctacaaaaaataattaccctggtgtggtggcacatgcttgaagtcccagctactcaggaggctgaggtggggagatcgcttgagcctgggaggttgaggctgcagtgactgtttcctgacctgcagggctgctgtggggctgcaggactaacaacatggttagtgcacactatggggtgtccctgaaggtaagagcacagcaataagacagctctgtcctctcctgtttggagttacggaccctcctgagaagcggagagagctaggaacccttgccccacggaggagccaagtacaaaattgttcatacaaattcagttcattcaaaaattcctcatacaaactcagtaggaatggtaatacagtaaatctgaaacctgccctaagcctgcagctggaggaagagccttaactctggaaggctctattgaactgacatatgctggggcggagggcatgttggaggcaagaggagagctggatggggcgggagtcagggggaaaggcagtgaaggagcagagggaccagggagggaccaggcctcagtcccatgcccacaggccccttgttcatttgcccctggccttgaatagaagacacacctcaggtggcacccctgtccccatcctgtgctcacttccttccccgcaagtgccactggcccagatctttaaggtaggggacttggagacagaggcagtagccacctcgtccaggtctgtgagagtggccgtgtgcaagtgtgtgtgcccacatctgtgtgcgccagtaagtgcggacgtcaaggctatttccaactccccctcccctgcccgcccctcctgggcagcacgcccagttcccagacacagcctatacacttcctctgagagctccacacgcaccctactcccctcctgccgtcatcgacagccgcctggcccacctggcatggcccaccccaggccccccaggcgggcagcactaaaaggcccttcttgtcctgcccgggcgggcaggcgtagggagggaggctccgttacacttgctctagaacagtttttctcgagtccgggtgggctgggccaagggctctggcccctgggccctgccctgctccggaggcctggggtggcacacaaggtgcacacaaggctcagtgcctgtcccgagcaccatcggtccccccaagccatcctcagaggcagcaggatctaccctgcttcaatttcttgtacctggtgtccctgtggccctgctcactaagatacccccatcagttctgagtccccacccaggtaacacacaagccctccctgccaggtactccccaacctgggtcccacttcaacccctcacattctgcctttcagtcagtgatgccagggaagaggtgtgggagccaccacccctgcctgccctgtgctcactgtgaccccccgactagaatgtcacctccttccttctctgcctgtccttccagtatcagctcaaatccaatctcccccaatgcttggctctctgctggggcctcccatacagctcagaaggagctggacaccgcatctgtcacccacactgtctcagtggcccaagcctaggccccgacgcaggctgggagcaccctcgaagcagggctgggggctcttcctgggctgctggggttcttggtggaactcagagtacttttcttcctctctggggcctcagtttccctctctatacaagtggaagattggcccagatggcctctagggtgctgactgccaggccccctgacctggatgcctcaaatgttgatgagtagagggagagcctcccagcacgcctcattcggatacgggaggacgagggcctttgcagccaggggcatccaggaggggtgggagggacgccttcctcaggcaggggctgcccctactgcagaaatcagggcaggcagctggaccaggagtggtgacagagatgggttgctggacgggagctctcacagcccctcctcatttccgagtcctcctaaaggcaggggatggtgtaactttataaaaccccacagcaccatgctgctctcttgccctaaaacccttgtggcatctcctttgccaacagggcataaggccgtgggcttcattttgccatttaaggcttctgtgccccagcccagtggttctccctggcctgtgctcgaaatacgcctcccagccaggctgctggccttcctgtctcaacacccctctgcttacgcccaccttggtgcctctgagtcagcgcccctgcctggaggactgactcccttcccatccaccaaggcttggtttgaggcccaccctgtgtcctgccccagcttgcccctgcttttctcccctctgtacttttcatccagatttttgctgtttgagatttaatttgcctttctgcctcctgaatgagtctcagttcagcctctcaatttcccgtgcccctgcgagcctagcaccatgcctgcatgctgtcagggctaagaaggtatttgagaatggctctcagttgaagcccaaggaggtgggggtactggaatccctccttggctggaggctggggcctgaatgagctgaccaccctggtcaccttggatgctcccttcccatctccctggcggcccagcccatccctcaggccctgagatcttaggggatctggtccctgcaggaacagggagcctggagatccagccctgattcaccccgcgggggtcctcccttgactcacttcccttctgggaaccatgtgatgccctcttttagagctggcttctccatctgaaggagagaagggtgtggcctgggcccttgtgaaggaggctcaggccctgcctttgctccatgttgctcttgggaatgatctcgaaggtgtagctgaagcactgaatcacacgtgggtagtgatgatggatgggccctaaggccacagttcttatggcataactagagctgccttcgctgaaggaagaatgctgtcatgttggggtttctggcatcgggacagagaggggatatatcccagcacttctcggaaagcgaacttccattcagcctctgctgggtcaggcatcagtgctgggatgaggaggtgtggcagggggtggtccagagctatctgtaggacaagccccgctgaggggcaccagctctccctctaggaggctgagagtgggtagtgggtggggggtcctgcctgtcaccaacaggaggagggagaggagagaatgaagaggggaggtggcagatagacggatctgcaaggaagcaaggggaggaaagaaggggcagagctggggggcagctggaggggtgtgggggtgctcctcacaggggagggcagggtggctcattcctcgtttcccaccttgtagcactccccattcctggcccagggcatctgaagctggaggacccacttctcactgtcgccgggtccctttggaccccaacatactcaccccaaacttgcctggcaaacaaagctcggccagcattggggtggccccactggtgtctcagacaatccaaacgggcaaagccacgccctaggcaatccatgcctggggcgcctgctcccgcccctaactggacagccttggctagctagaaaccccataacctgagatagcggggtcccgtgtccgccccaggattgaacccctggcgaccccagctagtggtgggagaagcgcagcctgcttgactcccgatctgggggccacttctggctcctcctgtcccttttccctcccggaggaacccctctagttccgccaggctgggtcggggtctcaggcccctcactcacccgcggatgcaagtctggccaacatagtcagggtcaaagccaaggccaggccgggggctggaagtgggggccgcggcccggactgcatcccggcgggctgggcggcaggacttgcgaggagccagcggagtcctgggagctgggagctgagtggagcgagcgcggctctgctcctgggcgc

SEQ ID NO: 1545 - DNA, 28023 bp, Homo sapiens
ttctttcttacaaatcacatatatttacattgtggatctgggatacacttatcacagtaggagctgctcaaatcaatctgaatgctacgcaatctgggaacctccccataactgtttgagccagcatttcagattatagataagctgtttccagctggactgggtttggaaagttcactctaaagaatgaagtcacctgttgtcactgtcctcctctccaggattccttttggggccaggtaccatcctgtggctccttaaggaggcttctctctttaattctccatgaggcatccagggtggtctgggctatgggaagaacccttcaacttgggagtagacaggtgctccaattcatagtgcccattctcagaggccttgtgtgtgagtttctccttcatgccttccttctggctcttcttgtgctccataatctgctggagctggtgcccagcatagtctggcttggtggtcagcgggccagccggcacagctacaccaaggacatctgacaccatgtaggggcgcagccagcccaccaagggagtgcttccggggctgtagtgggtctgtttgtggtagaagagaagtccatctacctataagacaaggggaaattgaggatcaaatgacttctggggccacatgtttccaggagagcctatacacacaagggcagctcttgtggtccgactcctttttctgggtcactgacagaggaaagagtcccagcttctcacacatgccgtttctctaaataaagaaatggcctagaaaactaaatttgagaaaataaaaacattggctgggcgtggtggctcatgcttataattccagcactttggaggctgaggcaggcagattgcttgagctcaggagtttgagaccagcctgggcaacatggtaagactccatttctactaaaaattcaaaaaaatagccaggcatgtgtggcacatgcctgtaatcccagctactcgggtgtctgagacacgacaaccgcttgaacccagtaggcagaggatgcagtgagctgagactgcaccactgcactccagcctggcgacagagtgagactctgtctcaaaaaaagaaaaaaaaaaaggaaaggataaacataaatagcactttcctgtttacagagtgctttcctgcccactattttactatcttacccatgacggtgtctgagagatggggctgctcatactcagggagttctgaggacctccttaaaacacacagtgagtaggaagcaggacttcaacttgaactctggtcttctgtccccagattccacggactttccaccacttaggggtctgtgttgtggtggatgagctctgtgcatggaatgaaaagcagaggaactggacaggcccctccggggcagcagattgctgcacacagtggaaacaggctgtccagatgccctgcttccctggctactgttggttgcctaaacctccccctaaattgtttgtgagccatgttctgggaaacagtttttctcaacgggaagacctcctacagtcccacattttattttctatgattcagtgactcatctctaaaaagcatttattgtcactggggcataagggttataaataaagatggtattcttaccaccttcttaattgactcccagaaatgctggcaactcagcctttgccatttccttatttgggaagctgtgatccttatataaaattacatccagttcaagcaaatgcttgcagtgactgggcagatttttttttttttttttctttctgagatggagtttcgctcgttgcccaggctgcagtggagtgcggtggtgcgatctcagctcagtgcaacctccgcctcccgggttcaagagattctcctgcctcaacttcccaagtagctgggactacaggcgtgtgccaccatgcctggctaatttttgtattgttagtagagccggggtttcaccatgttggcgaggctggtcttgaactcctgacctcaggtgatccaactgcctcgacctcccaaagtgctgggattacaggtgtgagccactgtgcccggccaaggcagaatttttaagggaatgatgggcaaaggaaaatgtgcttgttgagcctagagaaggtagctgcaggttctgaggctgacaagactgttgaggactggggagcctctggggctgtgaggtttgttttttgttttttttttttgagacagagtcttgtgctgttgcccaggctggagtgcagtggctcaatctcggctcactgcaacctctgcctcccaagttcaagtgattctcctgcctcagcctcccgagtagctgggattacaggcatctgccaatacgcccagctaatttttgtatttttagtagaaacgaggttttgccatgttggccaggctggtcttgaactcctgacctcaagtgatccaccggcctcggccttcccaagtgctgggattataggcgtgagccaccatgcccagccgctgtgagactttcagtgctaaaacagggcgagtcctgagcaaactggaatgaggtggtcacctgactcatgctcctgctcagcaagtgctgctgtccccaagggccatcttctttggtgaggaaaggattagggatttggacatttgttggagtcattcagtcacagaagcaccttcactttacaagcagccacgacagccaaaccagggacctgggtctcagcttgcagtaggaagaggcacacaagaaggatctaggcatgcaagtcttgctcctatctgggcctcagtttctccggacctcagtttctccatctgtaagatgagggagttggacgagctgtccattaagggcccttccagtgccagcattctgacttatccagcatgggtggagctcaggctctgaagggcagcaagtacatcctttctccagaatcagctttgtcccattctgatgctttgacacagcacaatcaaggaatattttaagactttgtgtaactaagtctctctgcagcctatcatcatgtcaaggcaataaagacaatggtttcgttacctcaaaagggaaatccatagatagcacatcacacaggctttcgggagtgcaagggaagttctttagccccacaaatttaaactgaaatagaaattagaacaaggaattagtacgttataaatgatactggcccaagcaattgaaaatctctgtcaggccaggcatagtggctcacacctgtaatcccagcactttgggaggcaaagtcaggaggatcacctgaggtcaagaaatcaagacaagcctggccaacatggtgaaaccccgtctgtactaaaaatacaaaaattagccaggcatagtggcatgtgcctgtagtccaagctacttgggaggttgagggaggaaaatagcttgaacccaggaaggggaggttgcagtgagccatgatcatgccactgcactccagactgggtgacagagcaagactccctctcaaaaaaagcaaaaagaaaagaaaatctctgtcaaagaagaaaaacttgtagtcccagctacttgggaggctgctgaggtagaaggatcgcttgagcctgaggtcaaggctgcagtaagctcagattgtgccactgcaccccagcctgagtgacagagccagaccctgtctcaaaaaccaaaccaaaccaaactaaaccaagccaaaacaaaaaaacaaagaagaaaagttttcagtctcatccttctctactaattcccctctacttactctcttaactactaggtcgtggttcccaatctttcctcccccttttttttaagagatgagatctcattctgtcacccatgctagagagcagtggcacaatcacagctcactgcatcctcaaattcctgggctcaagggattctcccacctcagtttcccagtatgctgggattataggcatgagccactgtacccagccccaaccttcttttatccacaagaatcatctagggagcttttaaaaattactgatactcaggaggctgaagcaggaaaatgacatgaacccgggaggcggagcttgcagtgggccgagattgtgccactgcactccaacctgggtgacagagcgagactccgtctctaaaaataaaaaataaataaaaataaattactgatgctggccaggtgtggtggctcacgcctgtaatcccagcactttgggaggccgagaagggcggatcacgaggtcaggagttcgagaccagtctgaccaatatggcgaaaccccgtctctactaaaaatacaaaaattagccaggcatggtggtacatgccagtagtcccagctacttgggaggctgaggcagaagaatcgcttgaacctgggaggcggaggttgcagtgagctgagattgtgccactgcactctagcctgagcaacagagcaagactcggtctcaaaaaaaaaaaaaaaaatattactgatgcacaggccctactctgagattctgactgaactggtctggggtgggatccaggttttttgttgttttttttgagacagagttgcgctctttcacccaggctggagtgcagtggcacaatcacagctcactgcagcctcaacctcttgggctcaagtgatcctcccacctcagcctctcaagtagctggaactataggtgcacgccaccatgcctaatctgtttttgtatttttttgtagagatggggttctgctgtgttgcccaggctggtctcaaactcctgggctcaaacaatccacctacctcagcctcccaaagtgatgggattataggcacacatcaccatacctggctaatttttttgtttgtatttcttttgtagagatggggttttgccatgttgcccaggctgctccgaactactgagctcaggcagtccacctgccttggccacccaaagtgctgggattacagatgtgagtcactgtgcctggcccaggtattttttttttttgagacaaagtctcgctccctcacccaggctggagtgcagtggcacgatctcggctaactgcaagctcggcctcctgggttcacagcattctcctgctcagcctctcaagtagctgggactataggcgcccaccaccacgaccggctaattttttgtatttttagtagagacggggtttcactgtgttagccaggatggtctcgatctcctgacctcgtgattcgcctgtctcggcctcccaaagtgctgggattacaggcgtgagctaccgcactcggcctggcccaggtattttttttaaagctcttcactgggccgggtgcagtggatcacgcctgtaatcccagcactttgggaggctgaggcaggcagatcacaaggtcaggagatcgacaccatccttgctaacacagtgaaaccccgtctctactaaaaatacaaaaaattagccggtcgtggtggtgggcgcctatagtcccagctactcaggaggctgaggcaggagaatgctgtgaacctgggaggcggagcttgcagtgagccgagatcacgccactgcactccagcctgggtgacggagcgagactctgtctcaaaaaaaaaaaaaaaaaaaaagctctccagctgattttaacatacagtcaggagtgggaaccactgtattgtactaggttgagtggttgtgtgttattctcttggccccatgacagctaccactaataaagggctagtgaaatccttttcacacctgcaaggatttttagactgaagcagcataactaagtgattagaactacaaactctaaagtcagattgcttgggtttgaatcccattctgccaatcatttaacctccatatactttcatcttcccatctgtaaaatgggataacaacagcacatatctacttcgtagggttactgtgtggattcagtgagataatatacatagagcacttaaaccagtgtcttagagagagcagtcttccccttcctcaatgcatgttcctccaggacctacatgataataacatcactgaaagtactgatcatatttattctcctataactggttgtccaattccctttaactttttttttttttttttttttgtgacagagtctcgctctgttgcccaggctggagtacagtggcacaatcttggctcactgcaacctccgcctcccaggttcaagtggttctcctgcctcagcctcccaagtagctgggattacaggcgtgcaccactacacttggctaattgtttttgtatttagtagagacagggttttgccatgttggtcaggctggtctcgaattcctgacctcaaatgatccacctgcctcggcctcccaaagtgctgggattacaggcgtgagccacggcgcctggcccttggctttaacattttttgtgagcaatccaagcaaatgccaatctgcagggctaataaaatgccctgaaaatagctgtcacatatttaaatcactgattattattgagtgcctaccatgagtattatgttaggaggacttgcatatttatataatttggttcttataacaaccctgtaaattagatgttattaccctatttttcagatggaaaatctaagggtaagtgagattattaacttaacttagtaataaattttttttagtctttttttagttattattacttcaataggtttttggggaagaggtagtgtttggttacatgaataagttcttttgtggtgatttctgagatttggtgcacccaccacccaagcagcgtacactgcacccaattatccctcatcccccttacccttccccagagttcccaaagtccattgtgtcattcttatgcctttatatcctcatagcttagctcccaattatgagtgagaacataggatgttaaattagtaataataaaagccaaaaatggaattcagatctacatgattgatactcttccctttataccatgctgcctcaaaaaagatcatttcatacataatgattatatttagataacagaccaatccacactactccccataaggaactcagtgatcctaacaccaggccttacaggattaagcttggttttctctcccagtccttcttcttctggtaactttgaatgcatccagtagaatcggaaatcagtctgccacagagaagggaaacagaaagatgaaatactttccatttcaaactctaatataaacaaaaacaccccatgctatttttttttttttttttttgagatggagtgttgctctgtcacccaggctggagtgcaatggtacagtctcggctcactgtaacctccgcctcccaagttcaagcgattctcctgcctcccaagtagctgggactacaggcgcccactgccacaccaggctaatttttgtatttttggtagagacagggtttcaccatgttggccagagtggtctccatctcctgacctcttgatctctccacctcgagcctcccaaagtgctgggattacaggtgtgagccactgcgcccaccgggcctcttcattcttttaaattattttgcttttggaaatttaaaaagatacatacagtcttttgtttacgttataaaaatatatttggttttagttaccaaatttgtaggttgtgaatacatgtaataaaatatccttcagcagaattaaaggaaaatatgttctagattgaatttatgttctgagttgtaggcttggttctacacgtgggcaaggtacttaagacctgtgcttcttagcatctcagcttccatatctatatgtcaaggacaggccaggtgcagtcgttcatgcccagcacttcggtaggccaaagtgggtggatcacttgaggtcaggagttcaagacagcctggccaacatggtgaaacgccgtctctactaaaaatacaaaaattagctgggtgtggtggcaagcgcctgtaatcccagctactcagaaggcggaggcaggagaagtgcttgaacccaggatgcggaggttgcagtgagcccagatcgcagcactgcactccaacctgggcaacagagcgagactccgtctcaaagaaaaaaaaggatgataatagtacttaccttacaataaggacgtgttgtaagggatttaatgagctaatgcagaaagtgcttagcaatgcacatcttgattgttattgtttgaatgagatgcaccttagaattctgagtaccaatacctagtgtgttttggaaacctagtatgcgggaatggcttagaaagaagcagcctatggtgacagcctgcatgaagatcactggaggcctgttcacacatcagcctcaggcccatttctacaacgttctgatatgcctggtctggagactacacaccgagaaccactatgataaactaattgacagggagcaaaaggaagtaccaaaacccccaaacccaccattatacaactgggacaatgacggggagagtgttcttaacagggatggaggccggtggggctcactcagcctcacctgatgactgctgctgttacctgttaagaatcaccaatagtaaaatgttgggggtatggtgaaacagaaggggagaatattggggcctctcctcctttgaaaagtctcctcctagagctaacctttgagatttgaggttctgggtcataccaaggaggccctgccattttcagggtcaggatgtggttggtgaaggagtggaggttgcaggagtctagtagatggtgacttacattcaattccaccttctcttcctggggctgctgcacaaggtggcatccccacccccttgccccacaatcttcactgccagaaatcctcccatactctggagagagataagggggtgggtgcagctgctatcaagtcccagcctacacccctgccatttctttctttcttcctctcaagaactgcatgtttctcttagttcctcctatttctcttttaaaactaagctaatttaaacacactcaaagatgcagggagcattagataatgttcttgatataccacatcctgtgcacaccaagaagttggtcacataccaaacccacatgctgagccgctttcccaggaggagaggagaagacaggaagagccacgagaggaggatccatccctacctggcaatcataaaaagggtgtccccgccagcacatcacatccagaacgtagtaggtctggtttacctcattgtaaatgcaatctagaatggtgtagtctgaggacacaaagcagaaagtcagcacagagttcttcttccaaccaggttccctccaccacaacctagggagccccatcccagaggcttgagtccaacaatcctcagtgcttgcagcagtcactggcactaaggactaaggattcactggggagagaaccctgcctggctaccagctacagcttcatggtgactcagggtaagacagcacaagacgcatcaaggcaaaccttaagcaaagtgagaattctgaagttttagataaactggcacatttactcacctcaacgaggtttaaaagcaagtcatcttccattttagtttacaactgctttttgagttcctatcataggcactgtgttatgtggggaatattaactataaatattccctgcctttaaggaagttaccatttggttaaggggataagatgatcacagaagaactaagagctaaattacagagctcatactaagagcaacaggagttcccgaaagagaaggctggagcagcaggaaatgcttcaagggagagatgccatacaaatagtcttctgggaccagccgggtttaaacaacagggcagaggggagaagagagggcatttcagacccaagtactgatgtggcatgagcaaagccccagaggcagaatgaactgggcacatgtggggagataagtcagctgaacagaaggtgggtataaggagtaggggaaagacatgggatgggtgggacaaagcctgcatgtgaaaggtactaaacgccaacagagaagtcagagcaaggccaggtgcagtggctcacacctatactcccagcactttgggaggccaaggcaggcagatggctttgagcccaggagtttcagaccagcctgggcaacatggcaaaaccccatctctaccaaaaatacaaaaaattagctgggcatggtggcacactcctgtagtctcagttactcaggaaattgaggtgggaggatcacttgagcctgagaaataaaggctgcagtgagctgtgatcatgcccttgaacccgagcctgggccacagagtgagaccgtgtcaaaaaataaaaaagagaagtctgggctcagtacagaggacatgaggaaccaccaaaggagcctgagcaggtagagaagaaagcaagcccagctctgccaattccttactgaataactgtgggtaagttatttctcccccacgaccttagtctactcagctaggcccagtggggaggaagaacctaaggttacaacaatgagaaaggagaaaagggagtttggcagggaagccccagcatcagctggctgtaccattatgcttagtattctctcagagacgtttccccccaaatctgtatctgttgtcccgtaatagaagtccaaagatatgttgaccttaattcaggaatttacggaccatcaggcctcatggggctgcatttattctgcaactggggacgcttgaccttgaaggggaggtccttggtccaggggccaggatggtgtctacatgcagtttcaaagataagctttcaggccgggtgcagtggcttatgcctgtaatcccagcaatttgggaggccaaggtgggtggatcactttgaggccaggagttcaagaccagcctggccaaaatggtgaaatccagtctctactaaaagtacaaaaattagccgggtgcagcctataatcccagctactcaggaggctgaggcaggagaatcacttgaacccaggaggcggaagttgcagtgagccaatatggtgccactgcactccagcttgggtgacaaagtgagactctgtctcaaaaaacaaaaaaaaaaaacaaagataagctatcaaagtgggtcttttttttttttttttttttttttttgagacggagtctcgctctgtcgcccaggccggactgcggactgcagtggtgcaatctcggctcactgcaagctccgcttcctgggttcacgccattctcctgcctcagcctcccgagtagctgggactacaggtgcccaccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcccaaagtgggtctttaaagcaaattacactgtcttttactgatcaataagtagacactctatgtaggtaccttttgctgttgagtttcgcctgttgcctcctggcagaagtgaagaaaacctgttgacacagtagccactcttggtgtaggcactggtagaaccctgcatggagagaaagttaccattcttattagacctcaaggtctcctcgccctcttgcctcctcattctgcaggaatgttactcgaccaaagatggctctcaacaaaccttcctgcaggaaagtgtttcaagctccactccaggcacagctgttgtggcgtatgaggaaaatggagcacaaagaatccctcccactacagaccaggcctactggcatagggggcaggcagctactcaccctggaggccacgataagggctctttttccaacagggcacacgaccacaatccattcctgccccaaatctgaaggaacgtcaattaaccactcagaaagcatcaactggaaatgcaaaaaatagtgttaaagatcagcaggggtgtgctactcgaaagtctgcaatgacaaggcattaatatcctgtgtgtatattaaaaacctgagtgaaagaatgagggcagagagccgggcacgggggctcatgcttgtaatcccagcactttgggaggctgtggcaggtggatcacctgaggtcaggagttcaagaccagcctggccaacatagtgaaatctcgtctctactaaaaaatataaaaaattagctgggtgtggtggcaggcacctgtaatcccagctactaggaaggctgagccacgagaattgcttgaacctgggaggcagaggttgcagtgagccgagatggtgccattgcactccagcctgggcaccaagagcgaaactctgtctcaaaaaaaaaaaaaaaaaagaatgagggcagaaaaggctgacagtggcacctccaccccatgtgctctagggagttggctgtgtctcctgcacagctgacaggatgatgggggccactgactatgaactttggcttctctcctccatctccacctgcaaccacaccatgcttactgcctcacctcccgggtcagggtgatgaaccctcttcctttccttactttgtccatctgctcctatcatcattactattatgtttgccacaactcagagatgaataagatccctgaccttgagatgctcttagactagaccagcatttctcaaaccgatgccccaaatactatactacaggatgttaggaaatctgtcttaaaaaacgaaacaacgccaaaccaaaccaacaaaaacagtgatgtggtgaaattaatttgggaagacaaactcttccactcagtctcttccatctgtaaagactttgtcccatgggctgggcgaggtggctcacgcctgtagtcccagcactttgggagaccaaggcgggcggatcacgaggtcaagagattgagaccatcctggccaacatggtgaaaccccgtctctaccaaaaatacaaaaattagctgggcgtgttggcgggcacctataatcccagctactcaggaggctgaggcaggaaaatcgtttgaacccaggaggcgcaggttgcaataagccaagatcacgccactgcactccagcctggtgacagagtgagacttcgtctcaaaaagaaaaaaaaaaaaagactttgtcccatcaattaatctctctcattgaatctttcatttctccttccctttaggcactcactcccaatctttttttttttgagatggagtctcgctctgtcgcccaggctggagtgcagtggcgctatctcagctcactgcaagctgcgcctcccgggttcacgccattctcctgcctcagcctcccgagtagctgggactacagtcacccgccactgtgcccagctaattttttgtatttttagtagagacggggtttcaccgtgttagccaggatggtctcgatctcctgacctcgtgatccgcccgcctcggccccccaaagtgctgggattacaggcatgagccaccacgcccggctcactttaaaaaaaaactttttgtggccaggaacggtggctcacgcctataatcccagcactttgagaggctgtggcgggcagatcatgaggccaagaaatcgagaccatcctggccaacatggtgacaagccgtctctactaaaaatacaaaaattagccaggcgtggtggcatgcacccgtagtcccagctactcgggaggttgaggcgggagaatcacttgaagctgggagatggaggttgcagtgagccgagatagcaccactgcactccagcctggcgacagagcgagaccccgtctcaaaaaaaaactttttgtcactcagcatttctgttgagctactccactttctcctagtttaaaaactacttaatacttcttgatgctgccttcttgctcaatctgacagccacagtccagatttcctaccccacagtcctactgaaggccctctgacctcttctcataactcttcctttttttcctttttttttttttgaactggagtcttactctgtcacccaagctgaagtgcagtggcacaatctcggttcactgcaacctccacctcccgggttcaagcgatcctcccattttagcctccctagtagccgggactacaggcacacgccactacgcccggctcatttttgtatttttagtagagacagggtttcaccattttggccaggctggtctcgaactcctgacctcaggtgatccacccacctcggcctcccaaagtgctgggattacaggtatgagccactgtgcctggcctcccatacctctttcttatcctccccactctactcctcgccttacgtaatgctaccagccacatctcccttcctgacatccgttcccttggcaccatgacatagcactactctgtttttccctctaaacattcctccacacactcccccaaaatatgtaatcttcagggggctgttttaggtcccccttttctcttagatgctgttcccattaggggtggatctcatctatttctatagcttcacttgtgcctcctaatgctccttcatctccagacttctttcctccacactcatctatattgcgagatgtctgcttggtatctctttctgtttgtctcctctgcaccgaaaactcagtatatccagagtggaattaactgccttctgttgcctaagtacttcccacccctgaaacacctacccttcccttctgcgtctcataaccttgttaatggcatcaccactccgttactgaatcttagagtttaagcataatctaggcaaattagactacatcaaaatttaaaaattctgtgctgccaacaatatcaccaagaagacaaaaagacaacccacagaatgaaagaaaatatgtgcaaatcatgtatctgataagaaacttgtatctagaatatattaaaaactcttataattcaataataaaaagataaataactcaattaaaaaacaaggagggcagatcatgaggtcaggagatcgagaccatcctggctaacacagtgaaacctcgtctctactgaaaatacaaaaaaaattagccgggcgcggtggcgggcacctgtagtcccagctgttcgggaggctgaggcaggagaatggcgtgaacccgggaggcggagcttgtagtgagccaagatcgcgtcactgcactccagcctgggcgacagagcaagactccatctcaaaaaaaaaaaaaaaaaaaaaaaagagcaaaggatttgaatagacatttctccaaagaagatatacaaatgaccaatacgcacaagaaaagatgtttaacatcaggccaggtgcagtggctcacacctgtaatcccagcactttgggaggccgaggtgggcggatcacaaaatcaggagttcgagaccagcctggtcaatacgctgaaaccccgtctctactaaaaatacaaaaattagccggaagtggtggcgggtgcctgtagtcccagctactcgggaggctaaggcaggagaatcgcttgaacctgggaggcagaggttgtagtgagctaagatcgtgctattgcactccagcctgggcaagagagggagactccaactcaaaaaaaaaaaaaaagaaaagaaaagaaaagatgtttaacatcattagtcactagggaaatagggaaatacaaatcaaaaccacaagaaaccacttcacacccactaggatggctatatttaaaaggatggacaataacaagtgttggcaaagctgtggagaaattggaacacttatatgttgctggtgggaatgtaaagtagtggagtcactttggagaacagtctagcacttcctcaaaaggttaaacagagttatcatatatagacccagcaattccacttctaggtatatacacaagagaaatgaaaacatatgctcacacaaaaacttgtagtacaagaatattaataatggcattatttggctgggtgcagtggctcacacctgtaatcccagcacattgggaggccaaggcaggtggatcagctcaggtcacaagttcgagaccagcctggccaacatggtgaaactcccgtctctactaaaaatataaaaattagctgggtgtgatggcacacacctgtagtcccagctactagggaggctgaggcaggaagatcacttaaactcaggagatggaggttgcagtaagccaagaacatgccactgtactccagcctgggtgagagagtgagacttcatctcgaaaaaagtaaataaataaaattaattaaaaaacaaataaaaatggcattattcataatagccaaaaagtaggagcaactcaaatagccataaactgaagaataaataaacaaaatgtagtctatccatacagtggaatattatttggcaataaaaaggagtgaagtactgatacatggtacaatatgatgaacgttggaaacctcatgctaagtaaaagaagccagtcacaaaagtccacatattatatgattccctttctatgaaatgtgcaaaataggaacagaaagtagattaatgattaggggctacagggaagaatggagagtgacactaattagtatggggtttcttttggggataaggaaaatgttctagaattaaatagtcgtgatggttgcacagtcttgtgactacactaaaaaaaaagaaaccattaaactatacaataaaaataggcaaattgtatggtatgtgaattatatctcaatataactgtctaaaaaatagtagtagcagctaatacttgtggggcacttccagactctgggctaggtatttaaggcatattatttcatttaatccttctaccaatcctatgagataagtactattactatccccattttacagataagaaaccaaagacttagagtggctaaaataccttgcttaaggtcaacacagagcctagctttgagatcagatctgtgtgacctcaaagcttacatcctttcccacttcttatactgcctctcatatccagtccactgctaagttcttccattctatctggcaacatttcttttttatttgttttatttattttttattttttatagaaatgggatcttcctatgctgtccagctgggattacagacacccatcacacctggctaatttttgtatttttaatagatggggtttcaccatgttggccaggctggtcttgaactcctggccttagcctcccaaagtgctgggattacaggcatgagccactgtgcccagcctctgcacatatttttgaggccctttacatctcttctgccatactccttctcccaactctatgccactctaccctaactggcctgcaaactgctcccgggcacaccatatactcctttctggcttctgggcctcgtgctcagcctgtttgttcccactgcctggaatgccctaaaatgcactgcacttctatctattaatgtcctacttacccttcaaggctgcctcttccttcattaacccttctctgatttcacaccccctccttcctccttggttggaaggaatctcatttttttttttttttttttttttttgagacggagtctcgctctgtcgcccaggctggagtgcagtggtgtgatctcggctcactgcaagctccgcctcccaggttcacaccattctcctgcctcagcctcccaagtagctgggactacaggcgcctgccaccaccacgcctggctaattttttttttgtatttttagtagagacggggtttcaccatgttagccaggatggtctcgatctcctgacctcgtgatccacccgccttggcctcccaaagtgctgggattacaggcgtgagccactgcacctggccagcatctcacttttttatagcacaaaacatcttctacacctattctaggagcacaggggctatttctgctccacatctatcttcccatgtcatagcctagtttaacacagagcaggtctttcaataatgcttactgaacaaaattgaattgtactttgtcacagaggatgttatctgtactgtatttggggtaaagaaaggggctgtgggagtgcatccaataaccatattctattgtgtttttttttttctttagagatggggtctctccgggtgcagtggctcactcttgtaatcccagcactttgggaggccgaggggggtggatcacctgaggtcgggagttcgagaccaacctgtccaccatggtgaaaccctgtctctactaaaaatacaaaaacttagccgggtgtggtggcaggcatctgtaatcccagctactcgggaggctgaaacaggagaactgcttgaacccgggaggcagaggttgcagtgagccacgatcgtaccactgcactccagcctgggcaacaagagcaaaactctgtctcaaaaaagaaaaaaaaagagatggggtctcactatgttagccaggttggtcttgaactcctggcttcaagtaatcctcccaccttggcctcccaaattgctgggattacaggtatgagccaccacactcaggcccaggaaccatattctaaaggcaggggagaattctgagatgacaagatacttgggttctagacacaagtatatgatagcagggtagacctccatcccaacttggacccataccctgctttctgaaatacctgagctgcctggaacacaagaacagtctctctccatacctctttccctatggtaccacagccatgttggtttcctctctggatctaaaagggcactgagtcaggtttattatagtgatctgctgcttcatggcctgaacctcaccttggccagctggctggtctggggtggctgggcaggctcactttattcaagggcagctgtacttcccacttgccaccacctgagtgtgaaatttcaagactggcctcatagtacactgcctgggaaagactctaccacccagggaagtggaaggagtcagtggtaggctgggcaggcccaatccagaacagctgtgcagtgacaactaaaaaaaatgacaaggatatggagtgtgttactatatcaatagctcaggggctttctgcagtgggctggcagcctttggtaacagcacaggctaatagttcccaaaccccactacccacagattccatcagtgattcctagtcagtccatagcacagtaagccatctctacttatcatcccatatgatctacgtacactggcatgttctttgcagttcctattcctttttcctgcctcattctcctctctttatgacagcatttatttcagtgggctttgactgcatagtaaagggagtgagattagctgggtctcatcttctctggaccacttacttgattagcatagtgttttggtaacttcttgacagtgtcaatgtccatttcttcatcatctttcttattttcttcctcactctccatccctgtccagtcatcttcagccagtcttctggcatggttcacataatccagccgcttgctggaaggaaaaaaaaggcataaggacatatcttttcttctttttttttttttagacagggtctcgctctgttgcccaggctggaatggtgcaatctcagctcactgcagcctcaacctcctgggctcaagtgatcttcccacctcagcttccacagtaggtgggactacaggcacacaccaccacccctggctaatttttgtattttttgtagagatggggtttcaccatgttgcccaggctggtctcaaactcctggcctcaagtgatctgcctgcctcagcctcccaaagtgctgggattattaggcatgaaccaccgcatctggccagggcaggtctttatgtcttttaggaagatgccctataatgcgacacatttaattcaaaagctccaaatttgggagcaacttggggattctggtggaagtaagaaatgatggaatctcctttgcaaggctaaaacagtgaccgccccctcaaaatcctaaatagcgaaaccccctctgaatacactcagccttcctcagagtttcctaagaatgcaaaataaaatatctaaagaaatttccaaggttcactagatggaaaggctagcttcacccctaccccatcccaccccagatgagagctgacaccttcctgcctagcagacatctcatccaaagaccccaggggtggaagagaagagccactgagatgcagtgagaagtctaaagcaaggacagcttctggagatttctgccttatacaccttttttgtttttaaagagaacttttttttttacggaccgtaggtgtatgccactgtgcccagcttatacagctttctcagaagccaggcctttctccagttcctgtctaactttcaaaaaaggtcacttagtttacaatttaatatattttatttatttgtttccctttatcgttatcttgttttaaaacaacacatgctagaaagtttgggaaactgaaaagaaaaaaaaagaatcttttggaacctaattgtttcaaagtgatttggaaataccacataacctcccacatttgatttcttcaatgctaaggcaggaattcaaccactgaggcagtgaaaccaacacagctggtttctcttaaacacatacatgttcatgctcattataaaaaggcacacaccagagagaacatatgaaagcacaatggtcttttatctcgagaataaaagagctggtatatttgtacatgtgtgaaagaaagtctgtctgtggttatttcctgaacattgtttgtaatcacaagagaagaaaactgcccagatgcccatcaggagggactggcttgatggcattatgaagtatccattccacggaatacctagcaccacgaaaaaggaatgatgtggtactttatgaactgatatagaatttctcccccaaaacaccactaaataaatgtgcagaacagtatatagtatactgctacttgtgttaaaaaaaaaaaaaaaaaaaaaaaaaaaagccaggtgcagtggctcctgcctgtaatcccagccctctgggagggtgaattggccagatcacttgagctcaggagttcaagaccagcttgggcaacatggtgaaattgtgtttctaccaaaaataaaaaaattagctgggtgtggtggcctgcaccagtggtcccagctacttgaggggctgaggttgcagtgagccaagatcatgccacagtactcagcctgggagatagagtcaaaaaaaaaaaaagcttttgtacacatactaccacacacacttgctcatatatgtatagaatatcttcggaagggccaggcgtagtggctgacgtctgaaatcccagcactttgggaggtcaaggtgggaggatcagttgagcctaggagttcaagatcagcctgagcaatatagggagaccctgttcctacaaaatataaaaaaattagccaggtgctatggagtgtgcctgtagtcccacctacttcagaggctgaggtgggaggatcacctgagcctgagaggttgaggctgcagtgagccgggatctgcacactccagcccgaacaacacagtgacaccctgtctaaaatatatatatatttggaaggatacaccagaaactaataatataggagaggaactggatagctaggggacagaaatgggaagacctcaccatatactcttctatttattttatttatttatttatttattggagagagtctagctgtgttgcccaggctggagtgcaatggcgcgatttcggctcactgcaacctccacctcccgggttcaagtgattctcctgtctcagcctcccgagtagctgggactacaggcacgcaccaccatgtcgggctaatttttgtatttttagtagagacaagttttcgccatgttggtcaggccagtctcgaactcctgacctcaggtgatccacccacctcggccacccaaagtgctgggattacaggcgtcagccaccatgcccggcctcttatgtatattttaaattttcaaccatacaaatgtattacctattcaaagataactacatttttaaaaatggggagaggaatgatctgggaatgtattctgcaagccacccagagccacagggaaccatctctgccaaacacaaccagtgatgcaacactgggcaaaatgcagactgtatggaaactatgcagctgttagtagtttcttctgatccctaattccttaatttatgacccagaagaggcccatgctgcattgagaatacaaggatcggccctgccttcagagtagctcagcctcaaacactcttatcctgccctctttccctgtttgcacatcttggcacttagaattaagtatatggaagacatttcctcagattcccttaggaattatttgtcttgaactcccaagagtgccacagaaacatttgggctgaaggcagatgggaagaccacaccaataccagcattcagagtgcagaagccaaacacaagcatcccaggaaatgtggggagtgaaagtctgggcgtggctttcgcaagttcctaaaccacagagctcagtacagctgccaggaaaaaaagaaaaacttaaccaaataattgagcttttggtttcaaacttcggtgtctccctaattcctcatcttctcctaagctctgggtataaaagaaacctacctctgccaggatttacccctcccaacctgtgggcaagaagatcagcctacaaagagtctactttgaagggagagtctgtagagacaagcctagagccttcggaatggttcatagctcctagcccagagaaagaagacaaggagttaaagcttccttacgatttctgcagttccagtaacctccggcggcgctcactctgctccaaggaactgtacttggacttgtactgggataggcgggggtgtggggcagctgtgctgttcagatcttgagacacagaaaagctactagccagggcctgactcaactcttccatcttccctacaaaggaaaacgtaagaaaatggttcattcatttcatatcatctcctgtatacagacagttatgcagttatgatatgatggccacattcctgaaaaaaaattaacttaatgcaaaatcacaagtgtttccatgagacaaaaggaagttaaagggtaaatgagtcatatattagcaataacattattttcctacagatatttccttttttttttttttttgagacagggtctctctctatcacccaggtcggagtgtagtggtgcaatcacagctcactgttgcctcaatctactggacccaagcaatcctcccacctcagcttccccagtaactgagactacaggtatacaccaccacacccagccaattttaaaatttattggtacagacgggatctccctatgttgcctaggctagtcttgaactcttgggctcaagcaatcttccctcctcagcctctcaaagtgctggcattataggtgtgagccactgcgcccggccttttctgagcagttcctctacagtttcctgaatagccatcactcattaaccaatataactctccatgcagtttattcaattggttatttaattctcaactaagtgccaactcatattatgaaaatttaattccagaggaaacactggttctagggtccctggaggaagacaaaagcaatcaaaaaccccaaactcgccaggcacgatggctcatgcctgtaatcccagcactttgggaggccgaggtgggtggatcacaaggtcaggagttcgaaaccagcctgaccaacatggtgaaaccccgtctctactaaaaatacaaaaactagctggatgtggtggcaggcgcctgtaatcccagctactcgggaggctgaggcagaagaatcgcttgaacctgggaggcggaggttgcagtgagccgagatcgtgccactgcactccagcctgggcgacacagcaagacttcatctcaaaaaacaaacaaacaaacaaacaaaaaaacaaactctagcgacctgggattacaggtggctcatgcctgtaatcccagcactttgggaggccaaggcaggaggatcacttgaggccagtagttcaagaccaacctggacaatgtagtgagactatgtctctactttttaaataaaaaagtaaaaaattattttaaattataatttattttttaaaaaatctgattgttacttcctcatattctagttgtgttttgtttttgggtgggcagaaagaaggtttcagggctacttatgtgggactcacttggaaaagagctaggatgtggaaggctgcttaacaagtaacgtcaatgctccagtagtgtgaagaacttccataaagtacattagggaaacaagacaggcatggagtagatgtcattttgaaaacagacttcccactttaggtggaccctaaagaatgggagtggggagaaaggtgaattcacacttcattcaagcgcctgtgagccttagattataagaaaacaggaacatttgggagaaatctgacttgcactgctgggctggcccagccctttggttctagtgtaaaccagagggcacctccagtgcttaacctccatcccaggccaggtccagtgctctgagcatcaaaatcaacaggttcattccagagcctctacagtgaaaaatacaactccataggcctctacttggccagtgagttactttccattgcacaagtgaagtcagatatttttcttgatttgaaacattagattttgtttaatttaaaaggaacttaaaaatcgtggtttgccaggtgcagttgtgcttgcctttagtcccagctactctggaggctgaggcaggaggtatgcttgagcccaggagttcgaagccagcctgggcaatatagcaagaccttgtctgtaaaaagaaaaaaaaattgtggctaaatacacatatcatgaaattcatcatcttaaccatttgtaggtgtacagttctgtaaagttaagtatgttcaacactgctgtgcagaactctccagaactccttttatcttgaataactgaacctctgtaacctttaaacataaaagaaacttttttttttttgagacagagtttcactcttgttgcccaggctggagcacaatggcacgatcttggctcaccacaacctccgcctcccaggttcaagtgattctcctgcctcagcctcccgcgtagctgggattacaggcgcccgccaccacgcccggctaattttgtttttgtattttttagtagagacggggtttcaccgtgttagccaggatggtctcgatctcccgacctcctgatctgcccaccttggcctcccaaagtgctgggattacaggtgtgagccaccacgcccggccttttttttttttttgagacagggtctcactttgtctcccaggctggactacagtggtgtgatctcggctcactgcagcctccacctcctgggttcaagtaactctcctgcctcagcctcctgagtagctgggattatagacatgcaccaccatgctcggctaatttttgtatttttagtagagaagaggtttcattatgttggcgtggctggtctgaaactcctgacctgaagtgatctgcctgcctcagcctcccaaagtgctggaattacaagcatgagccactgcacccggcttgaggtgtgccttaatatctttgcaatgcaaccaagggttgccattcctgagtgactgaggcctcatgatgagtgcttgggatccatatggtatgttattcaaatcatccataatggtatgtatgctattgtctctacttttctgtacttttgtgtaagtttgaaagctttcatgataaaattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttcagtagagacggggtttcaccgttttagccgggatggtctcgatctcctgacctcgtgatccgcccgcctcggcctcccaaagtgctgggattacaggcgtgagccaccgcgcccggccgataaaaatttttaaaaagtcattatgttttcagttcatcaccaaagtaatgaccaaatccaaagcacctttattaggcctatcatgcactatcttggtgtgggctcccgctctgccaagaaccacacaacctttgaaactgatgtcctgggcctggcgcggtggctcacgcctgtaatcccagcactttgggaggttgaagcgggcagatcacctgaggttaggagatcgagaccatcctggctaacacagtgaaaccccgtctctactaaaaaaaaaaaaaaaaatacaaaaaaattagccaggcatggtgacgggcgcctgtagtcccagatgctcgggaggctgaggcaggagaatggcttgaacccgtaaggcggagcttgcagtgagtcgagatcgtgccactgcactccagcctggacttcgtctcaaaaagaaaaaaaaaagaaaaactgatgtcctggatactggggcggttcctttaccttccttcaaggctgttcttggcgggttcctgctgtttcgttttgttttttctttgttgttgttgttttttttttgagacagagtttcgctcttgttgcccaggctggagtgcagtggcatgatctcggctcactgcaacctccatctcccggattcaagcgattctcctgcctcagcctcccgagtagctgggattacaggcacgcgccacaacgcccggctaattttttttgtatttttagtacagatggggtttcaccatgttggtcaggctggtctcaaactcctgacctcaggtgatccgcccacctcggcctcccaaagtgctgggattacaggcgtgagccactgcgccccgccgggctcctgctgtttcaacccattccttggatggtgctgcctccaagtgttcggaccttagccccaggtggtcttagcaccagtaacccccgctccaactccctaaagtccgacccgccccaggccccgcccacgctccaccctccctccctgtctagccccctcccccatccccttccccctccttcgcgtctccccatccggcgcccccgcctcgcgtcccctgggtccgcatcctggcagcctccgcgtttccctacccctgctaccgggctccagccccggggacgctatctgcttcactcggccgtgcgcgccgccaccgccccgcactgcctttttctaggcatggggtcatctaggccatgcatgattcgcccctgccccacagaagtccctgaggggtcctggccggacagcacggaatagaagaacggaaactctcccaaaaggagtcccaggcctggctctatccctccagatgacgtcccaggaggccagagtgcagggccggccagagggagtcacagtccggcaccgagaggcaactcggcagctggcggggcccgggctcgaacccagggactcacccaaaccgaggtgaccgtcgcacgcgccgccgccaccggggccgacgaatcacctgccctgggaagctaggtccgccctccccccgcccccagctgctgcctcaccgctgggcccacaggcctcgcgccctgagtttccggctcctccctcctttgcgaacgctgggagttccgttgcctacaggccgttatttccgccttcaacggctggggcatttcccatcggctagggagggggtcttcttgcatttgctttgcactgtccgggactcttcctgctagatgacttgaccaggccgaggcctccctcctgaacacaagctcttcggggctcctttcgccaatgggaggaggctgatcttgtggccgggcattcaacgccctgggccctgccgcctcccgcagatcttcccgggccttagggcttcacctggagtccc

SEQ ID NO: 1546 - DNA, 28296 bp, Homo sapiens
ttctttcttacaaatcacatatatttacattgtggatctgggatacacttatcacagtaggagctgctcaaatcaatctgaatgctacgcaatctgggaacctccccataactgtttgagccagcatttcagattatagataagctgtttccagctggactgggtttggaaagttcactctaaagaatgaagtcacctgttgtcactgtcctcctctccaggattccttttggggccaggtaccatcctgtggctccttaaggaggcttctctctttaattctccatgaggcatccagggtggtctgggctatgggaagaacccttcaacttgggagtagacaggtgctccaattcatagtgcccattctcagaggccttgtgtgtgagtttctccttcatgccttccttctggctcttcttgtgctccataatctgctggagctggtgcccagcatagtctggcttggtggtcagcgggccagccggcacagctacaccaaggacatctgacaccatgtaggggcgcagccagcccaccaagggagtgcttccggggctgtagtgggtctgtttgtggtagaagagaagtccatctacctataagacaaggggaaattgaggatcaaatgacttctggggccacatgtttccaggagagcctatacacacaagggcagctcttgtggtccgactcctttttctgggtcactgacagaggaaagagtcccagcttctcacacatgccgtttctctaaataaagaaatggcctagaaaactaaatttgagaaaataaaaacattggctgggcgtggtggctcatgcttataattccagcactttggaggctgaggcaggcagattgcttgagctcaggagtttgagaccagcctgggcaacatggtaagactccatttctactaaaaattcaaaaaaatagccaggcatgtgtggcacatgcctgtaatcccagctactcgggtgtctgagacacgacaaccgcttgaacccagtaggcagaggatgcagtgagctgagactgcaccactgcactccagcctggcgacagagtgagactctgtctcaaaaaaagaaaaaaaaaaaggaaaggataaacataaatagcactttcctgtttacagagtgctttcctgcccactattttactatcttacccatgacggtgtctgagagatggggctgctcatactcagggagttctgaggacctccttaaaacacacagtgagtaggaagcaggacttcaacttgaactctggtcttctgtccccagattccacggactttccaccacttaggggtctgtgttgtggtggatgagctctgtgcatggaatgaaaagcagaggaactggacaggcccctccggggcagcagattgctgcacacagtggaaacaggctgtccagatgccctgcttccctggctactgttggttgcctaaacctccccctaaattgtttgtgagccatgttctgggaaacagtttttctcaacgggaagacctcctacagtcccacattttattttctatgattcagtgactcatctctaaaaagcatttattgtcactggggcataagggttataaataaagatggtattcttaccaccttcttaattgactcccagaaatgctggcaactcagcctttgccatttccttatttgggaagctgtgatccttatataaaattacatccagttcaagcaaatgcttgcagtgactgggcagatttttttttttttttttctttctgagatggagtttcgctcgttgcccaggctgcagtggagtgcggtggtgcgatctcagctcagtgcaacctccgcctcccgggttcaagagattctcctgcctcaacttcccaagtagctgggactacaggcgtgtgccaccatgcctggctaatttttgtattgttagtagagccggggtttcaccatgttggcgaggctggtcttgaactcctgacctcaggtgatccaactgcctcgacctcccaaagtgctgggattacaggtgtgagccactgtgcccggccaaggcagaatttttaagggaatgatgggcaaaggaaaatgtgcttgttgagcctagagaaggtagctgcaggttctgaggctgacaagactgttgaggactggggagcctctggggctgtgaggtttgttttttgttttttttttttgagacagagtcttgtgctgttgcccaggctggagtgcagtggctcaatctcggctcactgcaacctctgcctcccaagttcaagtgattctcctgcctcagcctcccgagtagctgggattacaggcatctgccaatacgcccagctaatttttgtatttttagtagaaacgaggttttgccatgttggccaggctggtcttgaactcctgacctcaagtgatccaccggcctcggccttcccaagtgctgggattataggcgtgagccaccatgcccagccgctgtgagactttcagtgctaaaacagggcgagtcctgagcaaactggaatgaggtggtcacctgactcatgctcctgctcagcaagtgctgctgtccccaagggccatcttctttggtgaggaaaggattagggatttggacatttgttggagtcattcagtcacagaagcaccttcactttacaagcagccacgacagccaaaccagggacctgggtctcagcttgcagtaggaagaggcacacaagaaggatctaggcatgcaagtcttgctcctatctgggcctcagtttctccggacctcagtttctccatctgtaagatgagggagttggacgagctgtccattaagggcccttccagtgccagcattctgacttatccagcatgggtggagctcaggctctgaagggcagcaagtacatcctttctccagaatcagctttgtcccattctgatgctttgacacagcacaatcaaggaatattttaagactttgtgtaactaagtctctctgcagcctatcatcatgtcaaggcaataaagacaatggtttcgttacctcaaaagggaaatccatagatagcacatcacacaggctttcgggagtgcaagggaagttctttagccccacaaatttaaactgaaatagaaattagaacaaggaattagtacgttataaatgatactggcccaagcaattgaaaatctctgtcaggccaggcatagtggctcacacctgtaatcccagcactttgggaggcaaagtcaggaggatcacctgaggtcaagaaatcaagacaagcctggccaacatggtgaaaccccgtctgtactaaaaatacaaaaattagccaggcatagtggcatgtgcctgtagtccaagctacttgggaggttgagggaggaaaatagcttgaacccaggaaggggaggttgcagtgagccatgatcatgccactgcactccagactgggtgacagagcaagactccctctcaaaaaaagcaaaaagaaaagaaaatctctgtcaaagaagaaaaacttgtagtcccagctacttgggaggctgctgaggtagaaggatcgcttgagcctgaggtcaaggctgcagtaagctcagattgtgccactgcaccccagcctgagtgacagagccagaccctgtctcaaaaaccaaaccaaaccaaactaaaccaagccaaaacaaaaaaacaaagaagaaaagttttcagtctcatccttctctactaattcccctctacttactctcttaactactaggtcgtggttcccaatctttcctcccccttttttttaagagatgagatctcattctgtcacccatgctagagagcagtggcacaatcacagctcactgcatcctcaaattcctgggctcaagggattctcccacctcagtttcccagtatgctgggattataggcatgagccactgtacccagccccaaccttcttttatccacaagaatcatctagggagcttttaaaaattactgatactcaggaggctgaagcaggaaaatgacatgaacccgggaggcggagcttgcagtgggccgagattgtgccactgcactccaacctgggtgacagagcgagactccgtctctaaaaataaaaaataaataaaaataaattactgatgctggccaggtgtggtggctcacgcctgtaatcccagcactttgggaggccgagaagggcggatcacgaggtcaggagttcgagaccagtctgaccaatatggcgaaaccccgtctctactaaaaatacaaaaattagccaggcatggtggtacatgccagtagtcccagctacttgggaggctgaggcagaagaatcgcttgaacctgggaggcggaggttgcagtgagctgagattgtgccactgcactctagcctgagcaacagagcaagactcggtctcaaaaaaaaaaaaaaaaatattactgatgcacaggccctactctgagattctgactgaactggtctggggtgggatccaggttttttgttgttttttttgagacagagttgcgctctttcacccaggctggagtgcagtggcacaatcacagctcactgcagcctcaacctcttgggctcaagtgatcctcccacctcagcctctcaagtagctggaactataggtgcacgccaccatgcctaatctgtttttgtatttttttgtagagatggggttctgctgtgttgcccaggctggtctcaaactcctgggctcaaacaatccacctacctcagcctcccaaagtgatgggattataggcacacatcaccatacctggctaatttttttgtttgtatttcttttgtagagatggggttttgccatgttgcccaggctgctccgaactactgagctcaggcagtccacctgccttggccacccaaagtgctgggattacagatgtgagtcactgtgcctggcccaggtattttttttttttgagacaaagtctcgctccctcacccaggctggagtgcagtggcacgatctcggctaactgcaagctcggcctcctgggttcacagcattctcctgctcagcctctcaagtagctgggactataggcgcccaccaccacgaccggctaattttttgtatttttagtagagacggggtttcactgtgttagccaggatggtctcgatctcctgacctcgtgattcgcctgtctcggcctcccaaagtgctgggattacaggcgtgagctaccgcactcggcctggcccaggtattttttttaaagctcttcactgggccgggtgcagtggatcacgcctgtaatcccagcactttgggaggctgaggcaggcagatcacaaggtcaggagatcgacaccatccttgctaacacagtgaaaccccgtctctactaaaaatacaaaaaattagccggtcgtggtggtgggcgcctatagtcccagctactcaggaggctgaggcaggagaatgctgtgaacctgggaggcggagcttgcagtgagccgagatcacgccactgcactccagcctgggtgacggagcgagactctgtctcaaaaaaaaaaaaaaaaaaaaagctctccagctgattttaacatacagtcaggagtgggaaccactgtattgtactaggttgagtggttgtgtgttattctcttggccccatgacagctaccactaataaagggctagtgaaatccttttcacacctgcaaggatttttagactgaagcagcataactaagtgattagaactacaaactctaaagtcagattgcttgggtttgaatcccattctgccaatcatttaacctccatatactttcatcttcccatctgtaaaatgggataacaacagcacatatctacttcgtagggttactgtgtggattcagtgagataatatacatagagcacttaaaccagtgtcttagagagagcagtcttccccttcctcaatgcatgttcctccaggacctacatgataataacatcactgaaagtactgatcatatttattctcctataactggttgtccaattccctttaactttttttttttttttttttttgtgacagagtctcgctctgttgcccaggctggagtacagtggcacaatcttggctcactgcaacctccgcctcccaggttcaagtggttctcctgcctcagcctcccaagtagctgggattacaggcgtgcaccactacacttggctaattgtttttgtatttagtagagacagggttttgccatgttggtcaggctggtctcgaattcctgacctcaaatgatccacctgcctcggcctcccaaagtgctgggattacaggcgtgagccacggcgcctggcccttggctttaacattttttgtgagcaatccaagcaaatgccaatctgcagggctaataaaatgccctgaaaatagctgtcacatatttaaatcactgattattattgagtgcctaccatgagtattatgttaggaggacttgcatatttatataatttggttcttataacaaccctgtaaattagatgttattaccctatttttcagatggaaaatctaagggtaagtgagattattaacttaacttagtaataaattttttttagtctttttttagttattattacttcaataggtttttggggaagaggtagtgtttggttacatgaataagttcttttgtggtgatttctgagatttggtgcacccaccacccaagcagcgtacactgcacccaattatccctcatcccccttacccttccccagagttcccaaagtccattgtgtcattcttatgcctttatatcctcatagcttagctcccaattatgagtgagaacataggatgttaaattagtaataataaaagccaaaaatggaattcagatctacatgattgatactcttccctttataccatgctgcctcaaaaaagatcatttcatacataatgattatatttagataacagaccaatccacactactccccataaggaactcagtgatcctaacaccaggccttacaggattaagcttggttttctctcccagtccttcttcttctggtaactttgaatgcatccagtagaatcggaaatcagtctgccacagagaagggaaacagaaagatgaaatactttccatttcaaactctaatataaacaaaaacaccccatgctatttttttttttttttttttgagatggagtgttgctctgtcacccaggctggagtgcaatggtacagtctcggctcactgtaacctccgcctcccaagttcaagcgattctcctgcctcccaagtagctgggactacaggcgcccactgccacaccaggctaatttttgtatttttggtagagacagggtttcaccatgttggccagagtggtctccatctcctgacctcttgatctctccacctcgagcctcccaaagtgctgggattacaggtgtgagccactgcgcccaccgggcctcttcattcttttaaattattttgcttttggaaatttaaaaagatacatacagtcttttgtttacgttataaaaatatatttggttttagttaccaaatttgtaggttgtgaatacatgtaataaaatatccttcagcagaattaaaggaaaatatgttctagattgaatttatgttctgagttgtaggcttggttctacacgtgggcaaggtacttaagacctgtgcttcttagcatctcagcttccatatctatatgtcaaggacaggccaggtgcagtcgttcatgcccagcacttcggtaggccaaagtgggtggatcacttgaggtcaggagttcaagacagcctggccaacatggtgaaacgccgtctctactaaaaatacaaaaattagctgggtgtggtggcaagcgcctgtaatcccagctactcagaaggcggaggcaggagaagtgcttgaacccaggatgcggaggttgcagtgagcccagatcgcagcactgcactccaacctgggcaacagagcgagactccgtctcaaagaaaaaaaaggatgataatagtacttaccttacaataaggacgtgttgtaagggatttaatgagctaatgcagaaagtgcttagcaatgcacatcttgattgttattgtttgaatgagatgcaccttagaattctgagtaccaatacctagtgtgttttggaaacctagtatgcgggaatggcttagaaagaagcagcctatggtgacagcctgcatgaagatcactggaggcctgttcacacatcagcctcaggcccatttctacaacgttctgatatgcctggtctggagactacacaccgagaaccactatgataaactaattgacagggagcaaaaggaagtaccaaaacccccaaacccaccattatacaactgggacaatgacggggagagtgttcttaacagggatggaggccggtggggctcactcagcctcacctgatgactgctgctgttacctgttaagaatcaccaatagtaaaatgttgggggtatggtgaaacagaaggggagaatattggggcctctcctcctttgaaaagtctcctcctagagctaacctttgagatttgaggttctgggtcataccaaggaggccctgccattttcagggtcaggatgtggttggtgaaggagtggaggttgcaggagtctagtagatggtgacttacattcaattccaccttctcttcctggggctgctgcacaaggtggcatccccacccccttgccccacaatcttcactgccagaaatcctcccatactctggagagagataagggggtgggtgcagctgctatcaagtcccagcctacacccctgccatttctttctttcttcctctcaagaactgcatgtttctcttagttcctcctatttctcttttaaaactaagctaatttaaacacactcaaagatgcagggagcattagataatgttcttgatataccacatcctgtgcacaccaagaagttggtcacataccaaacccacatgctgagccgctttcccaggaggagaggagaagacaggaagagccacgagaggaggatccatccctacctggcaatcataaaaagggtgtccccgccagcacatcacatccagaacgtagtaggtctggtttacctcattgtaaatgcaatctagaatggtgtagtctgaggacacaaagcagaaagtcagcacagagttcttcttccaaccaggttccctccaccacaacctagggagccccatcccagaggcttgagtccaacaatcctcagtgcttgcagcagtcactggcactaaggactaaggattcactggggagagaaccctgcctggctaccagctacagcttcatggtgactcagggtaagacagcacaagacgcatcaaggcaaaccttaagcaaagtgagaattctgaagttttagataaactggcacatttactcacctcaacgaggtttaaaagcaagtcatcttccattttagtttacaactgctttttgagttcctatcataggcactgtgttatgtggggaatattaactataaatattccctgcctttaaggaagttaccatttggttaaggggataagatgatcacagaagaactaagagctaaattacagagctcatactaagagcaacaggagttcccgaaagagaaggctggagcagcaggaaatgcttcaagggagagatgccatacaaatagtcttctgggaccagccgggtttaaacaacagggcagaggggagaagagagggcatttcagacccaagtactgatgtggcatgagcaaagccccagaggcagaatgaactgggcacatgtggggagataagtcagctgaacagaaggtgggtataaggagtaggggaaagacatgggatgggtgggacaaagcctgcatgtgaaaggtactaaacgccaacagagaagtcagagcaaggccaggtgcagtggctcacacctatactcccagcactttgggaggccaaggcaggcagatggctttgagcccaggagtttcagaccagcctgggcaacatggcaaaaccccatctctaccaaaaatacaaaaaattagctgggcatggtggcacactcctgtagtctcagttactcaggaaattgaggtgggaggatcacttgagcctgagaaataaaggctgcagtgagctgtgatcatgcccttgaacccgagcctgggccacagagtgagaccgtgtcaaaaaataaaaaagagaagtctgggctcagtacagaggacatgaggaaccaccaaaggagcctgagcaggtagagaagaaagcaagcccagctctgccaattccttactgaataactgtgggtaagttatttctcccccacgaccttagtctactcagctaggcccagtggggaggaagaacctaaggttacaacaatgagaaaggagaaaagggagtttggcagggaagccccagcatcagctggctgtaccattatgcttagtattctctcagagacgtttccccccaaatctgtatctgttgtcccgtaatagaagtccaaagatatgttgaccttaattcaggaatttacggaccatcaggcctcatggggctgcatttattctgcaactggggacgcttgaccttgaaggggaggtccttggtccaggggccaggatggtgtctacatgcagtttcaaagataagctttcaggccgggtgcagtggcttatgcctgtaatcccagcaatttgggaggccaaggtgggtggatcactttgaggccaggagttcaagaccagcctggccaaaatggtgaaatccagtctctactaaaagtacaaaaattagccgggtgcagcctataatcccagctactcaggaggctgaggcaggagaatcacttgaacccaggaggcggaagttgcagtgagccaatatggtgccactgcactccagcttgggtgacaaagtgagactctgtctcaaaaaacaaaaaaaaaaaacaaagataagctatcaaagtgggtcttttttttttttttttttttttttttgagacggagtctcgctctgtcgcccaggccggactgcggactgcagtggtgcaatctcggctcactgcaagctccgcttcctgggttcacgccattctcctgcctcagcctcccgagtagctgggactacaggtgcccaccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcccaaagtgggtctttaaagcaaattacactgtcttttactgatcaataagtagacactctatgtaggtaccttttgctgttgagtttcgcctgttgcctcctggcagaagtgaagaaaacctgttgacacagtagccactcttggtgtaggcactggtagaaccctgcatggagagaaagttaccattcttattagacctcaaggtctcctcgccctcttgcctcctcattctgcaggaatgttactcgaccaaagatggctctcaacaaaccttcctgcaggaaagtgtttcaagctccactccaggcacagctgttgtggcgtatgaggaaaatggagcacaaagaatccctcccactacagaccaggcctactggcatagggggcaggcagctactcaccctggaggccacgataagggctctttttccaacagggcacacgaccacaatccattcctgccccaaatctgaaggaacgtcaattaaccactcagaaagcatcaactggaaatgcaaaaaatagtgttaaagatcagcaggggtgtgctactcgaaagtctgcaatgacaaggcattaatatcctgtgtgtatattaaaaacctgagtgaaagaatgagggcagagagccgggcacgggggctcatgcttgtaatcccagcactttgggaggctgtggcaggtggatcacctgaggtcaggagttcaagaccagcctggccaacatagtgaaatctcgtctctactaaaaaatataaaaaattagctgggtgtggtggcaggcacctgtaatcccagctactaggaaggctgagccacgagaattgcttgaacctgggaggcagaggttgcagtgagccgagatggtgccattgcactccagcctgggcaccaagagcgaaactctgtctcaaaaaaaaaaaaaaaaaagaatgagggcagaaaaggctgacagtggcacctccaccccatgtgctctagggagttggctgtgtctcctgcacagctgacaggatgatgggggccactgactatgaactttggcttctctcctccatctccacctgcaaccacaccatgcttactgcctcacctcccgggtcagggtgatgaaccctcttcctttccttactttgtccatctgctcctatcatcattactattatgtttgccacaactcagagatgaataagatccctgaccttgagatgctcttagactagaccagcatttctcaaaccgatgccccaaatactatactacaggatgttaggaaatctgtcttaaaaaacgaaacaacgccaaaccaaaccaacaaaaacagtgatgtggtgaaattaatttgggaagacaaactcttccactcagtctcttccatctgtaaagactttgtcccatgggctgggcgaggtggctcacgcctgtagtcccagcactttgggagaccaaggcgggcggatcacgaggtcaagagattgagaccatcctggccaacatggtgaaaccccgtctctaccaaaaatacaaaaattagctgggcgtgttggcgggcacctataatcccagctactcaggaggctgaggcaggaaaatcgtttgaacccaggaggcgcaggttgcaataagccaagatcacgccactgcactccagcctggtgacagagtgagacttcgtctcaaaaagaaaaaaaaaaaaagactttgtcccatcaattaatctctctcattgaatctttcatttctccttccctttaggcactcactcccaatctttttttttttgagatggagtctcgctctgtcgcccaggctggagtgcagtggcgctatctcagctcactgcaagctgcgcctcccgggttcacgccattctcctgcctcagcctcccgagtagctgggactacagtcacccgccactgtgcccagctaattttttgtatttttagtagagacggggtttcaccgtgttagccaggatggtctcgatctcctgacctcgtgatccgcccgcctcggccccccaaagtgctgggattacaggcatgagccaccacgcccggctcactttaaaaaaaaactttttgtggccaggaacggtggctcacgcctataatcccagcactttgagaggctgtggcgggcagatcatgaggccaagaaatcgagaccatcctggccaacatggtgacaagccgtctctactaaaaatacaaaaattagccaggcgtggtggcatgcacccgtagtcccagctactcgggaggttgaggcgggagaatcacttgaagctgggagatggaggttgcagtgagccgagatagcaccactgcactccagcctggcgacagagcgagaccccgtctcaaaaaaaaactttttgtcactcagcatttctgttgagctactccactttctcctagtttaaaaactacttaatacttcttgatgctgccttcttgctcaatctgacagccacagtccagatttcctaccccacagtcctactgaaggccctctgacctcttctcataactcttcctttttttcctttttttttttttgaactggagtcttactctgtcacccaagctgaagtgcagtggcacaatctcggttcactgcaacctccacctcccgggttcaagcgatcctcccattttagcctccctagtagccgggactacaggcacacgccactacgcccggctcatttttgtatttttagtagagacagggtttcaccattttggccaggctggtctcgaactcctgacctcaggtgatccacccacctcggcctcccaaagtgctgggattacaggtatgagccactgtgcctggcctcccatacctctttcttatcctccccactctactcctcgccttacgtaatgctaccagccacatctcccttcctgacatccgttcccttggcaccatgacatagcactactctgtttttccctctaaacattcctccacacactcccccaaaatatgtaatcttcagggggctgttttaggtcccccttttctcttagatgctgttcccattaggggtggatctcatctatttctatagcttcacttgtgcctcctaatgctccttcatctccagacttctttcctccacactcatctatattgcgagatgtctgcttggtatctctttctgtttgtctcctctgcaccgaaaactcagtatatccagagtggaattaactgccttctgttgcctaagtacttcccacccctgaaacacctacccttcccttctgcgtctcataaccttgttaatggcatcaccactccgttactgaatcttagagtttaagcataatctaggcaaattagactacatcaaaatttaaaaattctgtgctgccaacaatatcaccaagaagacaaaaagacaacccacagaatgaaagaaaatatgtgcaaatcatgtatctgataagaaacttgtatctagaatatattaaaaactcttataattcaataataaaaagataaataactcaattaaaaaacaaggagggcagatcatgaggtcaggagatcgagaccatcctggctaacacagtgaaacctcgtctctactgaaaatacaaaaaaaattagccgggcgcggtggcgggcacctgtagtcccagctgttcgggaggctgaggcaggagaatggcgtgaacccgggaggcggagcttgtagtgagccaagatcgcgtcactgcactccagcctgggcgacagagcaagactccatctcaaaaaaaaaaaaaaaaaaaaaaaagagcaaaggatttgaatagacatttctccaaagaagatatacaaatgaccaatacgcacaagaaaagatgtttaacatcaggccaggtgcagtggctcacacctgtaatcccagcactttgggaggccgaggtgggcggatcacaaaatcaggagttcgagaccagcctggtcaatacgctgaaaccccgtctctactaaaaatacaaaaattagccggaagtggtggcgggtgcctgtagtcccagctactcgggaggctaaggcaggagaatcgcttgaacctgggaggcagaggttgtagtgagctaagatcgtgctattgcactccagcctgggcaagagagggagactccaactcaaaaaaaaaaaaaaagaaaagaaaagaaaagatgtttaacatcattagtcactagggaaatagggaaatacaaatcaaaaccacaagaaaccacttcacacccactaggatggctatatttaaaaggatggacaataacaagtgttggcaaagctgtggagaaattggaacacttatatgttgctggtgggaatgtaaagtagtggagtcactttggagaacagtctagcacttcctcaaaaggttaaacagagttatcatatatagacccagcaattccacttctaggtatatacacaagagaaatgaaaacatatgctcacacaaaaacttgtagtacaagaatattaataatggcattatttggctgggtgcagtggctcacacctgtaatcccagcacattgggaggccaaggcaggtggatcagctcaggtcacaagttcgagaccagcctggccaacatggtgaaactcccgtctctactaaaaatataaaaattagctgggtgtgatggcacacacctgtagtcccagctactagggaggctgaggcaggaagatcacttaaactcaggagatggaggttgcagtaagccaagaacatgccactgtactccagcctgggtgagagagtgagacttcatctcgaaaaaagtaaataaataaaattaattaaaaaacaaataaaaatggcattattcataatagccaaaaagtaggagcaactcaaatagccataaactgaagaataaataaacaaaatgtagtctatccatacagtggaatattatttggcaataaaaaggagtgaagtactgatacatggtacaatatgatgaacgttggaaacctcatgctaagtaaaagaagccagtcacaaaagtccacatattatatgattccctttctatgaaatgtgcaaaataggaacagaaagtagattaatgattaggggctacagggaagaatggagagtgacactaattagtatggggtttcttttggggataaggaaaatgttctagaattaaatagtcgtgatggttgcacagtcttgtgactacactaaaaaaaaagaaaccattaaactatacaataaaaataggcaaattgtatggtatgtgaattatatctcaatataactgtctaaaaaatagtagtagcagctaatacttgtggggcacttccagactctgggctaggtatttaaggcatattatttcatttaatccttctaccaatcctatgagataagtactattactatccccattttacagataagaaaccaaagacttagagtggctaaaataccttgcttaaggtcaacacagagcctagctttgagatcagatctgtgtgacctcaaagcttacatcctttcccacttcttatactgcctctcatatccagtccactgctaagttcttccattctatctggcaacatttcttttttatttgttttatttattttttattttttatagaaatgggatcttcctatgctgtccagctgggattacagacacccatcacacctggctaatttttgtatttttaatagatggggtttcaccatgttggccaggctggtcttgaactcctggccttagcctcccaaagtgctgggattacaggcatgagccactgtgcccagcctctgcacatatttttgaggccctttacatctcttctgccatactccttctcccaactctatgccactctaccctaactggcctgcaaactgctcccgggcacaccatatactcctttctggcttctgggcctcgtgctcagcctgtttgttcccactgcctggaatgccctaaaatgcactgcacttctatctattaatgtcctacttacccttcaaggctgcctcttccttcattaacccttctctgatttcacaccccctccttcctccttggttggaaggaatctcatttttttttttttttttttttttttgagacggagtctcgctctgtcgcccaggctggagtgcagtggtgtgatctcggctcactgcaagctccgcctcccaggttcacaccattctcctgcctcagcctcccaagtagctgggactacaggcgcctgccaccaccacgcctggctaattttttttttgtatttttagtagagacggggtttcaccatgttagccaggatggtctcgatctcctgacctcgtgatccacccgccttggcctcccaaagtgctgggattacaggcgtgagccactgcacctggccagcatctcacttttttatagcacaaaacatcttctacacctattctaggagcacaggggctatttctgctccacatctatcttcccatgtcatagcctagtttaacacagagcaggtctttcaataatgcttactgaacaaaattgaattgtactttgtcacagaggatgttatctgtactgtatttggggtaaagaaaggggctgtgggagtgcatccaataaccatattctattgtgtttttttttttctttagagatggggtctctccgggtgcagtggctcactcttgtaatcccagcactttgggaggccgaggggggtggatcacctgaggtcgggagttcgagaccaacctgtccaccatggtgaaaccctgtctctactaaaaatacaaaaacttagccgggtgtggtggcaggcatctgtaatcccagctactcgggaggctgaaacaggagaactgcttgaacccgggaggcagaggttgcagtgagccacgatcgtaccactgcactccagcctgggcaacaagagcaaaactctgtctcaaaaaagaaaaaaaaagagatggggtctcactatgttagccaggttggtcttgaactcctggcttcaagtaatcctcccaccttggcctcccaaattgctgggattacaggtatgagccaccacactcaggcccaggaaccatattctaaaggcaggggagaattctgagatgacaagatacttgggttctagacacaagtatatgatagcagggtagacctccatcccaacttggacccataccctgctttctgaaatacctgagctgcctggaacacaagaacagtctctctccatacctctttccctatggtaccacagccatgttggtttcctctctggatctaaaagggcactgagtcaggtttattatagtgatctgctgcttcatggcctgaacctcaccttggccagctggctggtctggggtggctgggcaggctcactttattcaagggcagctgtacttcccacttgccaccacctgagtgtgaaatttcaagactggcctcatagtacactgcctgggaaagactctaccacccagggaagtggaaggagtcagtggtaggctgggcaggcccaatccagaacagctgtgcagtgacaactaaaaaaaatgacaaggatatggagtgtgttactatatcaatagctcaggggctttctgcagtgggctggcagcctttggtaacagcacaggctaatagttcccaaaccccactacccacagattccatcagtgattcctagtcagtccatagcacagtaagccatctctacttatcatcccatatgatctacgtacactggcatgttctttgcagttcctattcctttttcctgcctcattctcctctctttatgacagcatttatttcagtgggctttgactgcatagtaaagggagtgagattagctgggtctcatcttctctggaccacttacttgattagcatagtgttttggtaacttcttgacagtgtcaatgtccatttcttcatcatctttcttattttcttcctcactctccatccctgtccagtcatcttcagccagtcttctggcatggttcacataatccagccgcttgctggaaggaaaaaaaaggcataaggacatatcttttcttctttttttttttttagacagggtctcgctctgttgcccaggctggaatggtgcaatctcagctcactgcagcctcaacctcctgggctcaagtgatcttcccacctcagcttccacagtaggtgggactacaggcacacaccaccacccctggctaatttttgtattttttgtagagatggggtttcaccatgttgcccaggctggtctcaaactcctggcctcaagtgatctgcctgcctcagcctcccaaagtgctgggattattaggcatgaaccaccgcatctggccagggcaggtctttatgtcttttaggaagatgccctataatgcgacacatttaattcaaaagctccaaatttgggagcaacttggggattctggtggaagtaagaaatgatggaatctcctttgcaaggctaaaacagtgaccgccccctcaaaatcctaaatagcgaaaccccctctgaatacactcagccttcctcagagtttcctaagaatgcaaaataaaatatctaaagaaatttccaaggttcactagatggaaaggctagcttcacccctaccccatcccaccccagatgagagctgacaccttcctgcctagcagacatctcatccaaagaccccaggggtggaagagaagagccactgagatgcagtgagaagtctaaagcaaggacagcttctggagatttctgccttatacaccttttttgtttttaaagagaacttttttttttacggaccgtaggtgtatgccactgtgcccagcttatacagctttctcagaagccaggcctttctccagttcctgtctaactttcaaaaaaggtcacttagtttacaatttaatatattttatttatttgtttccctttatcgttatcttgttttaaaacaacacatgctagaaagtttgggaaactgaaaagaaaaaaaaagaatcttttggaacctaattgtttcaaagtgatttggaaataccacataacctcccacatttgatttcttcaatgctaaggcaggaattcaaccactgaggcagtgaaaccaacacagctggtttctcttaaacacatacatgttcatgctcattataaaaaggcacacaccagagagaacatatgaaagcacaatggtcttttatctcgagaataaaagagctggtatatttgtacatgtgtgaaagaaagtctgtctgtggttatttcctgaacattgtttgtaatcacaagagaagaaaactgcccagatgcccatcaggagggactggcttgatggcattatgaagtatccattccacggaatacctagcaccacgaaaaaggaatgatgtggtactttatgaactgatatagaatttctcccccaaaacaccactaaataaatgtgcagaacagtatatagtatactgctacttgtgttaaaaaaaaaaaaaaaaaaaaaaaaaaaagccaggtgcagtggctcctgcctgtaatcccagccctctgggagggtgaattggccagatcacttgagctcaggagttcaagaccagcttgggcaacatggtgaaattgtgtttctaccaaaaataaaaaaattagctgggtgtggtggcctgcaccagtggtcccagctacttgaggggctgaggttgcagtgagccaagatcatgccacagtactcagcctgggagatagagtcaaaaaaaaaaaaagcttttgtacacatactaccacacacacttgctcatatatgtatagaatatcttcggaagggccaggcgtagtggctgacgtctgaaatcccagcactttgggaggtcaaggtgggaggatcagttgagcctaggagttcaagatcagcctgagcaatatagggagaccctgttcctacaaaatataaaaaaattagccaggtgctatggagtgtgcctgtagtcccacctacttcagaggctgaggtgggaggatcacctgagcctgagaggttgaggctgcagtgagccgggatctgcacactccagcccgaacaacacagtgacaccctgtctaaaatatatatatatttggaaggatacaccagaaactaataatataggagaggaactggatagctaggggacagaaatgggaagacctcaccatatactcttctatttattttatttatttatttatttattggagagagtctagctgtgttgcccaggctggagtgcaatggcgcgatttcggctcactgcaacctccacctcccgggttcaagtgattctcctgtctcagcctcccgagtagctgggactacaggcacgcaccaccatgtcgggctaatttttgtatttttagtagagacaagttttcgccatgttggtcaggccagtctcgaactcctgacctcaggtgatccacccacctcggccacccaaagtgctgggattacaggcgtcagccaccatgcccggcctcttatgtatattttaaattttcaaccatacaaatgtattacctattcaaagataactacatttttaaaaatggggagaggaatgatctgggaatgtattctgcaagccacccagagccacagggaaccatctctgccaaacacaaccagtgatgcaacactgggcaaaatgcagactgtatggaaactatgcagctgttagtagtttcttctgatccctaattccttaatttatgacccagaagaggcccatgctgcattgagaatacaaggatcggccctgccttcagagtagctcagcctcaaacactcttatcctgccctctttccctgtttgcacatcttggcacttagaattaagtatatggaagacatttcctcagattcccttaggaattatttgtcttgaactcccaagagtgccacagaaacatttgggctgaaggcagatgggaagaccacaccaataccagcattcagagtgcagaagccaaacacaagcatcccaggaaatgtggggagtgaaagtctgggcgtggctttcgcaagttcctaaaccacagagctcagtacagctgccaggaaaaaaagaaaaacttaaccaaataattgagcttttggtttcaaacttcggtgtctccctaattcctcatcttctcctaagctctgggtataaaagaaacctacctctgccaggatttacccctcccaacctgtgggcaagaagatcagcctacaaagagtctactttgaagggagagtctgtagagacaagcctagagccttcggaatggttcatagctcctagcccagagaaagaagacaaggagttaaagcttccttacgatttctgcagttccagtaacctccggcggcgctcactctgctccaaggaactgtacttggacttgtactgggataggcgggggtgtggggcagctgtgctgttcagatcttgagacacagaaaagctactagccagggcctgactcaactcttccatcttccctacaaaggaaaacgtaagaaaatggttcattcatttcatatcatctcctgtatacagacagttatgcagttatgatatgatggccacattcctgaaaaaaaattaacttaatgcaaaatcacaagtgtttccatgagacaaaaggaagttaaagggtaaatgagtcatatattagcaataacattattttcctacagatatttccttttttttttttttttgagacagggtctctctctatcacccaggtcggagtgtagtggtgcaatcacagctcactgttgcctcaatctactggacccaagcaatcctcccacctcagcttccccagtaactgagactacaggtatacaccaccacacccagccaattttaaaatttattggtacagacgggatctccctatgttgcctaggctagtcttgaactcttgggctcaagcaatcttccctcctcagcctctcaaagtgctggcattataggtgtgagccactgcgcccggccttttctgagcagttcctctacagtttcctgaatagccatcactcattaaccaatataactctccatgcagtttattcaattggttatttaattctcaactaagtgccaactcatattatgaaaatttaattccagaggaaacactggttctagggtccctggaggaagacaaaagcaatcaaaaaccccaaactcgccaggcacgatggctcatgcctgtaatcccagcactttgggaggccgaggtgggtggatcacaaggtcaggagttcgaaaccagcctgaccaacatggtgaaaccccgtctctactaaaaatacaaaaactagctggatgtggtggcaggcgcctgtaatcccagctactcgggaggctgaggcagaagaatcgcttgaacctgggaggcggaggttgcagtgagccgagatcgtgccactgcactccagcctgggcgacacagcaagacttcatctcaaaaaacaaacaaacaaacaaacaaaaaaacaaactctagcgacctgggattacaggtggctcatgcctgtaatcccagcactttgggaggccaaggcaggaggatcacttgaggccagtagttcaagaccaacctggacaatgtagtgagactatgtctctactttttaaataaaaaagtaaaaaattattttaaattataatttattttttaaaaaatctgattgttacttcctcatattctagttgtgttttgtttttgggtgggcagaaagaaggtttcagggctacttatgtgggactcacttggaaaagagctaggatgtggaaggctgcttaacaagtaacgtcaatgctccagtagtgtgaagaacttccataaagtacattagggaaacaagacaggcatggagtagatgtcattttgaaaacagacttcccactttaggtggaccctaaagaatgggagtggggagaaaggtgaattcacacttcattcaagcgcctgtgagccttagattataagaaaacaggaacatttgggagaaatctgacttgcactgctgggctggcccagccctttggttctagtgtaaaccagagggcacctccagtgcttaacctccatcccaggccaggtccagtgctctgagcatcaaaatcaacaggttcattccagagcctctacagtgaaaaatacaactccataggcctctacttggccagtgagttactttccattgcacaagtgaagtcagatatttttcttgatttgaaacattagattttgtttaatttaaaaggaacttaaaaatcgtggtttgccaggtgcagttgtgcttgcctttagtcccagctactctggaggctgaggcaggaggtatgcttgagcccaggagttcgaagccagcctgggcaatatagcaagaccttgtctgtaaaaagaaaaaaaaattgtggctaaatacacatatcatgaaattcatcatcttaaccatttgtaggtgtacagttctgtaaagttaagtatgttcaacactgctgtgcagaactctccagaactccttttatcttgaataactgaacctctgtaacctttaaacataaaagaaacttttttttttttgagacagagtttcactcttgttgcccaggctggagcacaatggcacgatcttggctcaccacaacctccgcctcccaggttcaagtgattctcctgcctcagcctcccgcgtagctgggattacaggcgcccgccaccacgcccggctaattttgtttttgtattttttagtagagacggggtttcaccgtgttagccaggatggtctcgatctcccgacctcctgatctgcccaccttggcctcccaaagtgctgggattacaggtgtgagccaccacgcccggccttttttttttttttgagacagggtctcactttgtctcccaggctggactacagtggtgtgatctcggctcactgcagcctccacctcctgggttcaagtaactctcctgcctcagcctcctgagtagctgggattatagacatgcaccaccatgctcggctaatttttgtatttttagtagagaagaggtttcattatgttggcgtggctggtctgaaactcctgacctgaagtgatctgcctgcctcagcctcccaaagtgctggaattacaagcatgagccactgcacccggcttgaggtgtgccttaatatctttgcaatgcaaccaagggttgccattcctgagtgactgaggcctcatgatgagtgcttgggatccatatggtatgttattcaaatcatccataatggtatgtatgctattgtctctacttttctgtacttttgtgtaagtttgaaagctttcatgataaaattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttcagtagagacggggtttcaccgttttagccgggatggtctcgatctcctgacctcgtgatccgcccgcctcggcctcccaaagtgctgggattacaggcgtgagccaccgcgcccggccgataaaaatttttaaaaagtcattatgttttcagttcatcaccaaagtaatgaccaaatccaaagcacctttattaggcctatcatgcactatcttggtgtgggctcccgctctgccaagaaccacacaacctttgaaactgatgtcctgggcctggcgcggtggctcacgcctgtaatcccagcactttgggaggttgaagcgggcagatcacctgaggttaggagatcgagaccatcctggctaacacagtgaaaccccgtctctactaaaaaaaaaaaaaaaaatacaaaaaaattagccaggcatggtgacgggcgcctgtagtcccagatgctcgggaggctgaggcaggagaatggcttgaacccgtaaggcggagcttgcagtgagtcgagatcgtgccactgcactccagcctggacttcgtctcaaaaagaaaaaaaaaagaaaaactgatgtcctggatactggggcggttcctttaccttccttcaaggctgttcttggcgggttcctgctgtttcgttttgttttttctttgttgttgttgttttttttttgagacagagtttcgctcttgttgcccaggctggagtgcagtggcatgatctcggctcactgcaacctccatctcccggattcaagcgattctcctgcctcagcctcccgagtagctgggattacaggcacgcgccacaacgcccggctaattttttttgtatttttagtacagatggggtttcaccatgttggtcaggctggtctcaaactcctgacctcaggtgatccgcccacctcggcctcccaaagtgctgggattacaggcgtgagccactgcgccccgccgggctcctgctgtttcaacccattccttggatggtgctgcctccaagtgttcggaccttagccccaggtggtcttagcaccagtaacccccgctccaactccctaaagtccgacccgccccaggccccgcccacgctccaccctccctccctgtctagccccctcccccatccccttccccctccttcgcgtctccccatccggcgcccccgcctcgcgtcccctgggtccgcatcctggcagcctccgcgtttccctacccctgctaccgggctccagccccggggacgctatctgcttcactcggccgtgcgcgccgccaccgccccgcactgcctttttctaggcatggggtcatctaggccatgcatgattcgcccctgccccacagaagtccctgaggggtcctggccggacagcacggaatagaagaacggaaactctcccaaaaggagtcccaggcctggctctatccctccagatgacgtcccaggaggccagagtgcagggccggccagagggagtcacagtccggcaccgagaggcaactcggcagctggcggggcccgggctcgaacccagggactcacccaaaccgaggtgaccgtcgcacgcgccgccgccaccggggccgacgaatcacctgccctgggaagctaggtccgccctccccccgcccccagctgctgcctcaccgctgggcccacaggcctcgcgccctgagtttccggctcctccctcctttgcgaacgctgggagttccgttgcctacaggccgttatttccgccttcaacggctggggcatttcccatcggctagggagggggtcttcttgcatttgctttgcactgtccgggactcttcctgctagatgacttgaccaggccgaggcctccctcctgaacacaagctcttcggggctcctttcgccaatgggaggaggctgatcttgtggccgggcattcaacgccctgggccctgccgcctcccgcagatcttcccgggccttagggcttcacctggagtccccttcccctcttgggcccgtgctcttaaacgggcagtgccaattgcctggattactccaactaacccctcacacccaagtttcagacacagaccttcgctcccccacttgcccttaacaaaagcagatacatacctcgattactgcctgtttgctgcttttgcgagcttctttcccactcggctgcgggctgagcaatggtagggacctggcttgattcctatttaagtagccagagtccagcacaagggatggcgctcagtagaccctgcgtg

SEQ ID NO: 1547 - DNA, 28023 bp, Homo sapiens; identical to SEQ ID NO: 1545

SEQ ID NO: 1548 - DNA, 9621 bp, Homo sapiens
attcagctgcgagtgcattcttggactgccttgtgagcatccccggtctgggcaggaccctctccttcccatctttctataccacccagcccagccatggcactgaaaggccgagccctctatgactttcacagtgagaacaaggaggaaatcagcatccagcaggatgaggacctggtcatctttagcgagacctcactggatggctggctgcagggccagaacagccgtggggagacagggctctttcctgcctcttatgtggagatcgtccgttctggcatcagcaccaaccatgctgactactccagcagccctgcaggctctcccggagcccaggtgagcttgtacaacagccccagtgtggccagcccagctaggagtggtgggggcagtggcttcctctcaaaccagggtagctttgaggaggatgatgatgatgactgggatgactgggacgacggatgcacagtggtggaggagccacgggctggtgggctgggcaccaacgggcaccctcccctcaacctctcctaccctggtgcctaccccagccagcacatggccttccggcccaagccaccactggagcggcaggacagcctggcatctgccaagcgaggcagtgtggtgggccgtaacctcaaccgtttctcatgctttgtgcgttctggagtggaggccttcatcctgggtgatgtgcccatgatggccaagatcgctgagacatactccattgaaatgggccctcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagaaggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctggtgcgtaaacatgtggggggcttccgcaaggaattccagaagctgggcagtgccttccaggccatcagtcattccttccagatggacccccccttttgctctgaggccctcaacagtgccatttctcacacgggccgtacctatgaagccatcggggagatgtttgctgagcagcccaagaatgacctcttccagatgctggacacactgtctctctaccagggcctgctctccaacttccctgacatcatccatctacaaaaaggtaaggcccagtgcaggcaggaaactcgtcctgagtctggctctctgctgggccctggggagatggggatggcctggatagaatggagcaacttgtctttatttctctgtctcaatcattcatttaacaaatgtgttgggctgggcacggtggcttacgcttgtaatctcagcactttgggaggttgaagtaggaggatcacttgggcccaggaggttgagactacagtgagcccgattgtgccactgcactccagcctgggtgacagagtgagaccctgtctctaaaacaaacaaacaaacaaacaaacaaacaaatgtgttgaatatcaactctgtgtctgtggcaaatgtgcttctaggtgcagggatattgttgtgcacaggcccggtctctgtcctcatggagcttgatatttaccttcttgtcagttcattcattttctctgtttgcatctcgtttacccatcatgcatggtgtcatgctgggttctgagaacacatagatgaccaggccccaggccttgcccttgaggagccggtaggcccttgggagacacagacccaacccagataacaagagctcagagtgggggcctgtcttgtgctccttgcaagttaacctccccacctttgcagctttggaagctactctcaccactgtgtattctctttatgagcgtcttgtctgtgtgcaggaagatccctgtccccattttgcagatgaaggagctagtgtccacagaagagtggttgcacagcctgtggcccggctgggactgtcccttcctcctgccacctccccaaggacacgtccatgttggccacttcccaagcctagccatgttttcagttctcatgaccccctctgtgggggagggacaggatgggcctctgcctgttactgctggggctgtccatgaactgccggggaaatgactcatcctgggtcacacaggggcactctggctgggccaggggtgcagaatcaggggtccagggcactgtccacatggcctatccaactcctgcttcccaagcctggcttctcttcttgcctgaggagagagccagtggctgccccagcaggtgcctgagtcctgggcacagctgggagggcagatgtcaggagagaggtgtgatcctccctggggctgcttggtaactcgtctgcagggcgtggagctggctccctggcccttgggccctgaggttagacctggcttggtggggagtttgactctgggtggggccagggggcagacctctgcactgagcctggggaacaggaaacatgtcacccaccaccaccagggagggcctggggtaagctggccttgctttcctttaccaagaggttgacttctataacttctccagctcccagcctcctttctccccttgctatatcctcttcctcttcctttctttctgtttttttttttttttctctcatctctacctttcttcctcctcctctgaactccaggaaacacaaacctgagtgctagtcttggctctgcccctagattgctgtgcgtccccggggagtgcctttgcccctctgggccttagtttcctgatctgtaaaacaagggaatggggtcccagtgagccatcaggccttcaagggagtgggtgggaagggactcctggggagggtatggctcagaaacagaatgacaccttagctctggctctgagcactggggcaggagtagggcaggggaggtggccaggcctgctgggggcccactggggcaggtgtctccctgagcacaagtgggaaggctggttcaaccagctccttagatggcttgttcctgtgcaggcagcaggagggggaatgcaatgattaaacagatgctcccatgcagtggctggggaccccccacccagagcagagctgaggacattagggcagccccacacctaggaaggacaccagggcctcccaggctggggggaagccagaccagcctttctgaccctgggcagagagacagagctgagataggccatttctgagtttctacttgaggtgtttctaagagtcagaggccactgtcctctgtgctggtgcatttgacctgaaacagaggccagcccactgccttccctccccgggaggacccctcccaatgggccaagccctctctggcttactctaagttctgggctctgcactgctcctcccaggcctgtggtgtggggcaagttagggagggggtactgagacagaactggacaggctttggggaccacagcccaatgggagtgataaggagggggtcctaatgctggccttaggggtggagcccttctcaaagaaaagagaagaacagttgggtcctgggcccccaggattctgtccagcctgtctggacatctgaatgggtggtgagtgtgtgggaggaaggacagtggaggcctaggtgggagtcaggagaccaggatttggacaaactttgcatctgacatgactttgggagagatttctcccctcagtctctaggtgagtaaaatgggacccgagggtcttcatttccttaggagggctccatgtcatgtgaaacttacattaaacaaatttgtatgcttttcagaaaaataataaaatgaaataaaatgggacataaaccctggctggagctgagaggagcctggtcctcccacgggcctagtccctgtagcccaatccaggggtctcctaagagaagggtaaccatataattaaccagggcagtttggggcataaaagggggccctagcaatagtgatcccgggacaacaggggaaagtaactgtccagggcaagctgggacgtatggacccccaacttgacagccagcaagagcggggctggtcctaaggctcacgacaggtcaggagggcgatgtggtcacttccgttttacagacgaggtgcagcgatgcagatgagcctcagagcaggagctggagtccagtgtgtctggctccgcagcccaggctgtttccactgtgccctcccagatgggggaggggatccccagggatggagagctgagccagaaggcgaaagaggagggaggaaggcttgggtgctccttcactggtcctgtgggctagagagaggcccaggaccacagagcttccatggaggggccatagggacagcgtggccaaggcaaagtggcgactgtagggacaagttcttgcctgggggatgggtgggttcagcctctgggttctgagccatcatctagccttccctctaccgctcatcctgtaatctcagcactttgggaggccgaagtgggcggatcacaggagttcgacaccagcctggctaacatagtgaaaccctgtctctactaaaaatacaaaaaaatagccaggcatggtggcaggtgcctgtaatcccagctacttggaaggctgaggcagaagaattgcttgaacccagcaggcggaggttgcagtgagccgagatcaagccactgcactccagcttgggcagcagaacaagactccatctcaaattaaaaaaaaaaaaaaaaaagaaaagaaaagcagttttcaagccataacatgtagcatctggagcttctattgtatctcaggtgcgctcctttgaactgtgtacatattagttcagttaagcctcaactatactatagggcaggtactattattatcccattttacagatgtggaaactccttaaagcactataccgtgtgagaggttgtcaacagcatcacatctagtgcaacctgtcccactgggcagtggggagacctggagcccaggcaagagcagtggcttgctggagaggatacagctaggactaggactcagacctcctgctccctcctgcccccaacctggggtggatgttaactgtctccaagaggcaggggcaagatggattgaggtgggagcttagggaatatccctgggacttgcagctggtgggctccaaccctcctttctgcatttttgggacccagcctgtaagaggagtgctgaggcaggaggtccccctgggtcctcagctctcaggttaagtcttaagtagaatgtcggggggatgctggacaggcctgagccctgactcccagcctgtggggtggggtgcattagcattagctggtcctggccccagagctgagtcacagggtggaggggtaacggagaacagggtggggcctctgtttccccccgacctctgcagcctttgctccccatccctggcctcctgcctgtctgtggatacctaaccattgcaatgggttcattcttactctttgggctcctcatcagcaaaagaggcctttccttcctctaaggccatggacaggaaaagtctatagatgcacttccactgtgccaactttctcggcaggtggaatccaggctagttcagtatctcctctttagctaggttccttctgcggaagtttaactccagtttcttcaccctgctgttttctacctttcttcttacggttcttcctactccttgggaccttcttgaatccctgtgtccaacgtctgggggccccacacatatgcctgaaggacctggcatgggctccctgcagcagaagtggtgtccgacccccagctgtggaggaccaggcaggaaagaggctgggagtcctgggcaagttcctgcccctcagggccttggcctcctctgtacagtagtaggatggaggtggaatcgagggttggacacctgatcttttgggcctttctagctctgaagtctcttactgggtcctatcctgggccttggggtgatcccccttctgctgcccagggctgggctgttgagatggtgcaggaggtggtccagggaaggtggcagaaggactgagtgggctgggagctggggaatgcagatttcttttgggcgctgtgtgagcagccctggagactctctgaacttgagtctgtttgcctgaaatgctactattagccgattagccatgcacttatcaactaacatggatgttgccccttctaaaggcatccagagttattcccagcatgtagagccctgggcctgatatacagtaagtgctcaatgaatgcatttagaatgcactggacaatttgagccagggagtgaagagaatattatctagacagccctcaagagccctccttaaaggagaagtgggaaagcatgggtattgagcatgctatctgtgtgtagtgggtgcgtttgcagtgctcaggggtgtgctgtcctctatgccaacccttccctgctcctaatcttctttgtatggtggattctctgcagccctcggcgactgagtgccaggcacaggcaaacttccttctcttcccagcaactgtccccactggcttaaaggcagaattcgtcaagtcccttttaattcagaactgaaattcattcaccagctgcttgttcattcattcagattcttctaaattgggtcctctgcccaggttcatctccaccccccatctgtcacctggttattacacaacctcctcgagttccctgggggctgggatgaggagggaacagggcgtgcatgtctgggagatacaccaggtggcctttgaagagttgttttagaatcagcagtgtgatgggggtgggggtggggagccagggcacaggtgacatgggagagacattctgtcaggggaactgggagaggctccagtgtagaagtggcacctgatcggggccatgaattatgaataggaatccagggggcagaggtaggaaggtaggaaagagccaggtgagtttgacgaacatgggggtcagtgtggaatgcgtgcaggggccaactcccagaggtgagggccccccaggccaggcagattggtgtggaccttgatctgtaggtagtggagagctaggaaaggtgcccagcttgggatacctctttagatgctgcagagaacctgtcagaggctggggcggagggcagggagacgtggcggggctgttgtagcagtccagtgagggacagggttgaatcagttcagcaggcctatatcaggatctgctgtgggccaggccttgttctgggtaccagagacacagagaggttgaggacaggctctatcctcattgaattcatagtccatcaagcagggctgtgactggtcacatgtgggctactggtggcactgcacatttggagagaagatgatgtgcttggtttaggaggtgctgagggtgatggcttgggtaacatcctggcagagacacccaggtggctggaatgtgggtctggggctcaggaatgacgtccgagttgagctgatgagggtgctgtctgccctcaagggtacagggagcacatggagatcagagccctcacacgctgtcctctgctctgcctatgccaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaa

SEQ ID NO: 1549 - DNA, 70691 bp, Homo sapiens
tgaattctctattgacataatgccattttaattcagttctgagcacgtagagcattcctctctttaaaatctgaaatccatttcagtacataaatccatggaatgtcatcccatcaaaaaagtaacaactctaggtgagcggcttagtggtggtagaagcccacagctgaaacgctggaaacactgatgcaattcatttgggaatttatttttttctaaagcggaacaaaacctaattatgaataagaaacatttaaatggcaactcttaacctatagtgcaaacaccagattccacaaaactgaattcctttgtcagtaatccaatatttagcagtagctgctgcttttgtggttgttggttagttaaaattaagtaatgattccagtttagaagataaagtttcagtgtgaattttagtagaagtcataaaaatacctgagacatattagaaaataagattttccctcctatttaaaaaaaactctgcagacttttatttgaagcccatcttttgaaaatcactaacatttcataatcatttcctagtgttttgtttcactttctcgatgaataatatttccccatttaagtttctcaaggcattgattgctggaaaatttcccacgtgccctctaaacgtcccccgtggacatgagtaaattaaacttcgtgcatgtcagctacacgttcatcgtctcctttctcagctgaggccatgagtggacccatcagtggctccaaagtcgtagaagtactaacatgttaagaaaaatacatttttaagggtcaaaacaaagttacacagaagcaaatatcagggaaggacttcaaaaggcctcctcagcattgagtgtccgtgtcttcctgagattcttcagtttatcaatggcagaagttactaaaatctctccatgaattttgttgtctcttgttcgcacgtttacagcattatctatcttttccttttctccaaccactgcagaaaagaaaggtaaagaaatgtattttaaatcagcaatttaccaaacattaagtcagcagtcccatgacatgtttttatcaagtttttcttcactaatattaaatatcatctaatgagcatttggttcatcctctgatagttaagtttcttgagggaagcaatgacttctgatcccatctctctattgtccacctgagagaacagctcttgtggtcctggggtgcagatgagaggggggagctcttacagactcacactgactgcacctggcactagggcgcaaatgagagcggggagctcttacaggctcacagtgaccccacctggcactagggcgcaaatgagagcggggagctcttacaggctcacactgaccccacctggcactagggtgcaaatgagagcggggagctcttacaggctcacactgactccacctggcactagggcgcaaatgagagcggggagctcttacaggctcacactgaccccacctggcactagggtgcaaatgagaggggggagctcttacaggctcacagtgactccacctggcactagggcgcagatgagaggggggagctcttacaggctcacactgaccccacctggcactagggtgcaaatgagaggggggagctcttacaggctcacagtgactccacctggcactagggcgcaaatgagagcggggagctcttacaggctcacagtgactccacctggcactagggcgcaaatgagagcggggagctcttacaggctcacactgaccccacctggcactagggcgcaaatgagagcggggagctcttacagactcacagtgactccacctggcactagggcgcaaatgagagcggggagctcttacaggctcacagtgactccacctggcactagggcgcaaatgagagcggggagctcttacagactcacagtgactccacctggcactagggtgcaaatgagagcggggagctcttacaggctcacactgaccccacctggcactagggtgcagatgagagtggggagctcttacaggctcacactgaccccacctggcactagggtgcagatgagagcggggagctcttacaggctcacgctgactccacctggcatacctgatgagccaaggagtggacaccagacccatgcgagccagccagaactttctggaatgtgggtaaaaagtttgttctctctagtgacccatattgtgagatgatgcaggaatctacagccatgcttcttgccacacagaaggaagaaaccggtctgcagataagtggaataaggtagatattcaagagaagcataaagaaccagagcaagacaggaacgagaaatggggagaaatactcctggtgagggttgagctcctgattgctcttctagtggtttggctatttaattctacctttcatgtcatgggatactccaagacccttccaacaaatgctgtctttgtctaaaccaagttgagatttctgccaccataagaagcctgactgaaacagcacaatacctactctggtgtcaaacattatcattgaaacactgtcaatagaacaatgctatgcatatttatttcgccttctacagactctcaacttacaagaaatagcaatactgtgcctgcagttatatcagtgttagtttctcttaattttggaatcatttttaaagcctaaattttagattctgcatctaattagtcatatgctaaaaggacattttacttttcatctaaatcttttcctttagatcattttaaatttgggatcttttctttctgttagtttaatcccaaagtttcctaataagccagaaaagtgagggaaaatattacaggcctgtgaggctgaaatataaagtatataattctactgatgggatcattttcagagttgttttcgttgtttgcttgcaatatgaactattgctagtaaaactatcccaggggattcaggtgaaactttacaactcttcttccagcaaacaacaaagagtacctaggaacagctaagctaggaatgctatggactcttccttttgtgtaagtattaaatagacaaatcatgataatcaagtagttgaaccatatttcttatttggtcttttggaattgaagtgggaaaaaaaagcatttggaaaaatatatacaaacttaaattacccaaaataaaattatactgagccagctgtgcatttcgtattttcttatttagtgtacaactgtgatccaagtcaacgtcagccataaatccttcttcaaaaaattcactggatacctagaagaaaatgaaacacctttactgttacattatggtacctagcctccaagaagaccccgttgttccccactcttggtattcacacctttgtatagttccctgctcactataccagagcgggtctgcgtgaccataaagaagtgcggaagtgtcggcgcatcgtttctgagactagtttataaaaggctgcagctcccatctctctcagatcacttgctctgggggaaaccagccaccatgcagtgaggacattcaggcaagcaagcacccaggtgatgaggagctgcatccaccaactgtgagcgagccccgagctccgcagccctggctgacagcctgactgcagccccaggagacgctctgcgccagaatccaccagctgagctgctcccagaccctgactcgtaggaactgtgagatcatcaatgtttgttgtttaaagctgctaagttttggggtcacttgtgacacagcaacagataatattcttccctaatagagctgtgtagaaatgaataattatgatatgttttaaaatactaatttctcaaaaaacattaagaatgaaatagttctgagacagctgcagagacatgattcgtgtgttactcccacctgctgaaaacacggtttaagctaatgtgtcagttctgcaatattttaaagcatgaaggacactccaaatcgatgacctacacagaatacatgcaagattattatgtactttaaacacctctgattttacctgaagtgcatatttttcacaagttggccccacagggatgaccatcacctgacgaggagatagccagaaaggcctgaaaaatatatataaaatatgtattttcaaagtgtaataatggctacttattacatgattttcaaataaccaaagattcttttaaagacttcacaagagggcagtttcagtagcgcagcatggaagaaaactaaattatattaaagtttgaaggcagcaaagtaaatgaaaggagaattttggaattttgatagcacaagtgcaggtagaatgagctggcagacagcccaaagggctgagcatgcacttactgtctgccccagcaattgcactcctggcatttgtcccagagaaatgaaagcgcaggttcacacacaatactgctcactaacgtccatagcagctttatttataatagccccaaacaggaaacacacaccccaaatgtcctttagcgggtgaatggccaaactgtggtgcatccacactgtggaacgtggaacaccatcagcaaaaaaaaaaaaaaaaaaaaggaaccaactaatttatctcgaaacaaaacaacatggatggctcttaagggaattccactgagtgaaaaaaaaaaagcctacttcaaaagtttgtgtactctgtaaatccatttatgtaatattctttatatgacaaaatgatggagctagagaacaagttcatggctgtcagataggaggacagggtgggatggtttgagtgtggggaaaaaagggcagcaggagggagccttacaagtgatggactgtcctgtgccttgactggtggccttacaccatctgtccgtgtgacacagctaaatacacgttcacacaaatgagtgcatgtgaggctggtgaaatcggaacaaggttggtggacagtctcaatgtctagttcttggctgtgatattgtatctagttttgcaagatgttaccattgaggaaaactgggtaaagagtgtgctggacttctctgtataacttcttttttattttttttgagatggaatcttgctcacccaggctagagtgcagtggcgtgatctcggctcactgcaacctctgcctcccgagttcaagtgattctcctagctcagcctcctgagtagctgggattacagccattgccaccacacccagctaatttttgtattttcagtagagacggggtttcaccatgttggccagactggtcttgaactcctgacctcaggtgatccacccacctcggcctcccaaaggttgggattacaggcgtgagccaccacatccggcctctatataacttcttagaacaacatgcgaacctacaattatttcaaaatataatttttctagaataaaaaagatggcagggtaggtataaacagtgtccgctgtgggacatgtttgccctttccctgtcatagtgagtatttagtctgaaggtgaaaggacatgcaaggaggactatttcagatagcattttataaatgtgcatatttatatatttattctcaaattacaaacacaaaacaatacatgataaatggtagaacacagaaatacagggtatataatggcaactacatatttccttttgagctctgtccttatcccatccccagccctactcctctcaaggacccacactttagccatctttacttttggctcctggggagatttccccacaaggctgactgctgtctgaagtctggatgtatgaagtgcagggagtatacttccgtctctgcgacaaaggaaggcatgctcagtgcactggccccaaccacctcctgtctccctctccatctcctatttcactagttctctctcttttctttaaaccactttcactgcaaccattctaatgcaaaacaccatcatctcttacctatggtaaactatttaaaaccaactggaaagaaatataaacatgttaactcatactcaggcggcatacatattcatacccatacttttggcttaactgtaacttcaacagcttagaaactccatgatacctaagtatatttctctatgatcacaaaatatcaggaatatacacagactctctagctacccaggtcttttggaagacactttgtttgggaaactttccaccttatgtttcctgctcaaaaatttgcttccccagtctcgctggacatgaatggtagtatgcatgggtgtgatctaggttctgctaatgtataaacatggcactctgacttaagacagagtggagaaggaggcaccacatggaatccattatggcaaggaaaggtgatgcagagacatggagcttttggaggaactggttgcagtgaccctagcagtatcatccggtgcccagtgtccacagtgggagctgcagggactgtgcccggcaatagtagcagtgggggcagtagtttctgaagagagagctaaactgcatgagcagatgcttagccaatttctaaaaatggaatgggaggtagaaatttcacaggtggttgctggtttgcagcatttccacatactaggatacatcatcacaagatgttgtctgccagctggtgctataactgctagtaaagccacttgcttctgaatgcatggtgatagtagtgaatcccttaatgtcagtgcaatgctttacttatttgctataaaatctctttcatagtcagaagcactgttgtgttcctggcagcacctaagtacatatttggtgccactggcagaagcatggcagcaaagaagagcaaagcaaaatccacagtgagtctctcttcagtgagaatgaggcattgctccttacatgatgaaagggatccaacgtaatcaacctgctacaagaccactggctattaccccaggttatggtaccatcccgggggatcacaattaatcactgactgatggcaacctgaattctcagaagagatgtagccagatggaacttagtgaggcaaagtccatgtctttgagcccatgcctatccaccagtggccactttgcccatgagccattgagcaacaactaggggaaaaagcagctgattttaacagaatgggtcctcttgtattggaatactgaaaaattcctcaacagcgggggccttttggtggcaataccacctctgttggcccattctgagtgatcatccacatttctgcttcccaaatctatgtaatttgtttttcaatctaattagttctaaatctttgactctgtggccaaagcagtaactagagcctgtgcatccatgtaactccttatctccggccattcttccttccgggcaaaaaggaccacaggatgcaccactcaaaaaggaccacaagatgcaccactcaaaaaagaccacaagatgcaccactcaaaattctgcactttaggacacttcccttccccactgtcatcctaaatgggctgtgctgctgagccatcctctttgagtttgtgccatttatgaatcaggtttacatgttttcctcctcagtggctgtagggaaccccaaaggcaaacaatatgggttgaaggaaggatggctggagggcaagaggtggtacctaggagtgtgggtcacatgttttcaggacagcaactagatctctgaagggcttgaaacaggtaaaaagataactttaattctaccgagtcccccaaaaggtaaatggtacagttttatgccactctcccttagtttttattttctgatctggcaaatcgaataagaattctttatttgctgtttggacaattgctaattacaaggcaggaaaggccctttcttttgttactacttttttcttttacacatgattttttaagaatagaaatatttttaaaaaggaaaaatgagtaaattaataaaaattaaaaagaataatagacatatagtttttcttttccatatcacttaccattttccgccatagttttctgaaagaatggctatcattctttccactgatcccaaaatggctcgatgaatgatcacaggtctcttcttatcatccccatccttactaaaaaatgaaaattatacatttaagtcttttcctaagattcaataactatcttctagccttatatttaattttgagaatagatttagattagtgatatcagatctctccattaaccttatttgttctgtgactgtcttgttttctcattgctttctttgctaatcttttttcttttattttaaaaactttttattagagcgcactgaaacatatacaaaagtagagagaagagtataatgaacttccacataccctctctcagcttcacaaaatgtcaactcacagccaatctcatctgatccaaatgcacccccattcttgccactatctcccacattataatcttcatttttaaaatgttcctgatatgtgttcttgaagtccactggtcaaattccctgaaaccctcatgaggtgtatcttacatttaattattccctcttccccttaggaaaaaaaaatgaaaaaagcaaatgatgacttaattgtaatgaagtaagccacttcaagatctctgcacaagcacaagcttctcagaaagataaatttcacattattgcaacaaatgtgacatgcgacacttacaaagttcttttgataaatttttatctaaaaattataccagctagctactactacaataaatgaaacaaatttaacaaataaataataaaataaaacaaacaaaaacagagaaacccattcattaaacctacttcaaatgagttgtaactggatatcatcactgccaaccatttctgctaagagccattatagaataactgcaggcaaaactctctgtctggaccctacaggaagctttggggtaggggtgagcggcttgagtccattcctatgcaggtatatgaagaaattcatcccaaaaattgaaaccagtatgaaatattcctgaatatcccatcatgttgattttgtgtagggaagaaagagaagcaaactgatcctttcacagagcctgggtatccaaaatttctgtcccatcatttctttgaatcatgtctagacttaagaagagcaaatagtgacataaactatgattacacatctgtgctatcagataaacattggaatgaatgccaaattcccccaaaataaccccagtggatttgcttacaattatattagattaatagataaatttgaagagaataacttcacaatgttgattcttctcattccaaagtgtggtacgaatcttcatttaaataactcttttttgtggtcttggagaaaaacttatagcgtatgcttataaataacatctatagtcatgtgttgcctaatgacattttggtcaacaatggactgcagatatgatggtggtcccacgagattataaagaagctgaaaaaaatttttttttaaattatactttaagttctagggtacatgtgcacaatgtgcaggtttgttacatatgtatacatgagccacgctggtgtcctgcacccaaggaagctgaaaaattcctatcatctagtgatctgtgttacaagtacctagagcattcagtacagtaacattctgcacaggtttggagctagcagcaataggctatcccatacagcttaagtgtgtagtggcctatgccatctaggtttgtgtaagtacactccgtgatgttcacacaacaatgatattgcctaacgacacatttctccaaacatatccctgtcatgactacatttatggggatgcatgactatatttatatttattaagtttattcatattttctattttgtggttgctgttgcttctgaaatgttttttccattgcatttcctagcagattattgctaacattatgaaggcaaattgatttttgcatttttaccttccattattattagtgcccatttctccatttgattctgttggatttctctatattttaacatctactaataataattttatctcttgctttcatgtatttgtaatcccagaataattttgagtaacaatacaaatagtagtcatattcgtcttcttcccaactgtgttgagatgctattgctgttttctgataaaagctctttatcgtgataaggaaatttctgttcatttcacaggaatgaatgttaacttttatctgatgcctttctgcatgctgaatgtaatgaatgacaacagcacactctcatccacccctgcttttttagggaaaaacccttactcaatcatggtgatgaccttgatgcttctctctctcctctcatacataagcctgagcaaatcacatcagttcttcctccaaaatacacttccagtacccctactttgttcatctctatgccacctggctccaactgtcatcatttcttacctggtctgcaatccactgcttccacctttgcttgcctactcgccatttgccacacaacacctatgatggctggctgggctgatttgtttctcctccacgtcctccttaaatgagtagtttcacttgcattctgatggccctaagcaattttgttgtaggactgatcctgaaggtttgactttctctctaatagttctgacccttgctcctccaaaacggagagattagacttttcggagtcctactaactccactgtaccaatcaggcaaaaagttagaggtcaactcccagaagcttttccgttttggcacacggtatgacctatgggacttggccactgggtggcgaacacatggaacagatgtgaatatcactataaaggcttcgataactgaactgacaccgaaccgcagcccacaaaagtgggctggaaatttccacctgaacctaaccaggcagattcactgccaaaacaagacaaccgccttaggatttaaacaagacacagcatctcataacataatattcaagacattcaggatataatcctaaattacttagcatatgaatcattaggaaaattttcaatttgtgagaagaaaagacaaacaacagtccagcagcaagaaaacacaaatgatggaattaccaaaggctagaaatagccattataactgtaccccaggaagcagggtaaacacacctggagtgactggaaagaccaaagtctcaggaagaaacacaaaacacgaacaacagagattgtagaactgaaaactacaatcacagaaagttttaaaaagtcattcgatggattcagtagcaacagagatggtaaagagttggtgaatttgaagataagtaaatagaatgtatccaatctgagagatatacaaagaaagactgaaggaagcataaacagcctcagaaaactggaaaaataccaaaaggtctaatattcaggtcacctgcgtcccagaaggagcggaggtatagtaccaaagaaatatggaaaaacaatacaacgtttgcaaaccaataacttacagattcaggaagttcaaaccgccacaacatagacttgaataagtccacagacagacacatcacaatcgtgtgacacataaaggaaaagtgactgcaattactgcatatttctcatcagaaaccataaaagccagcagcatgtgtaacaatattttttgtttttactttgcaagaaaataaattatataacttaaaaaataaaacccccaaactaagcagttcatcaaaatatttcagcctacagcctacagaaactgctaccatttaaaattgtacagcgttatcatctcagcgtgtagtggcacacgtgcaaatagcatagaccacatgaggacagattacaacttaggaactcaaatttgttcaacactctaaacaacatacagtgtagatgacaggaaagctctcatgtaatgtttattttacaaacatgaccttggaagaattaataagatggcatctcagttatttacataaaaatagaaaaatcagcttgagtttaagacggcaaatctttctataaaactagccaatctttcacccagattgaagttttaaaatttgctctttgaaagggctaatgacatcttactgcaaataatgtaaaatattttttaactactcaggtcatattttgtattaaatttaatacaaagtaaaagtaagaaagctaagtttttactttgggaagcgttaacatttatgcacaagatgagaacaagacttgaaaaaacaagttgatagaactcgggagcccctccaataaatgcaaacattggaagacttcagaattcatttcgagatcctcactgaatcattggagcagtaatgttctaatatttacctcactgtaagcatcaaaattgttctgtattttcccttcataaattttatttcatgtctacttactctggaaatgagatgcaacaaaggttaacacaaaaatggatgtctctgtttttaaattagaagatgagtgttctaggtcaggatcggtggctcacgcctgtaatctcagcactttgggaggctgaggtgggcggaggtaaggagttcgagaccagcctggccaacatggtgaaaccctgtctccactaaaaatacaaagtttagccaggcatggtggtgcatgcctatagtcccagttactcaggaggctgaggcagaagaattgcttgaacccaggaggcggaggtttcagtgagccaagattgtcccactgcactccagcctgggcaacagagcaagactcatctcaaaaaaaaaaaaaaaaaaaaaaagatgagtgttcaaagtttgcattaacctcagaagcgtcctcttgctatactactaagttaatatatatttttaaacaatatttttaaaatattaaaactaaataactatcaacccagaattgtacaagcaaagaaggttattttctttgaaagtacaacaaaataaagacattctcagatgaaagaaaataaggcaattcatcttcaaccgacctgctttaaataaactgtttattctcttatatcttcagatatatgagaaatgatactagagggaaccctggaacatcaggaatgaaacaagatcaacagaaatggtaaatatttggtaaatataatataatgttctcctcctaagctctttaaaacatgtactatgattgaaaacaaaaataatattgcttatgaggttgttaatgtatatggcatgtagtgtgtagtatgccttccaaaatgaatttttaaataacaagacttgaaagtcaaaattgtgccttgatccatgggctgcagaatggatgttgtgttaataggcatgagaaaacattaatctccttgtacgtctccatcagagctcttggatgaccaggtgcattgtcaatgagcagtaatcttttgaaatgaatctttttttttttcctgagcagtaggtctcaacagtgggcttaaaatattcagtaaatcatgctgtaaacagacgtgctgtcatctaggctttgttgttgcatttctagaacacaggcagagtaaatttagcattattcgtaagggttctaagattttctgaatggtaaatgagcactggcttcaacttaaagtcaccagctgcattagctcctaataagagggtgagcctctcttttgaagttttgaagccagtcattgacttttcctttctagctatgaaagtcctagagggcatcttcttctaatagaaggctgcttcatatatattgaaaatctgttgtttagtgttgtcatcttcatcattgatcttagctagatcttctggataacttgctgaagcttgtacgtcagcacttgttgctttaccttgcacttttatattatggagatggcttttttttttgagatggagtttcactcttgttgtccaggctggagtgcagtggcgtggtcttggctccctgcaacttctgccttctggattcacatgattctcctgcctcagcctcccaagtagctgggattacaggcacccaccaccacgcccagctaatttttttatttttatttttgtatttttagtagagacggggtttcaccaaccatatggagttggccaggctggtcttgaactcctgacctcaggtgatccacctgcctctgcctcccaaagtgctgggattacaggcatgagccactgcacctggccctggagatggttcttttaacttcatgaaccaacctcttgctagtttcaaactttgcttctgcagcttcttcacctctctcagtcttcacagaattgaaaagttagggctttgctctggattagtctttggcttcagggaaactttctccacatcagcaagaaggctgtttcacttccttatcatttgtgttcactggagtagcacttttaatgtccttcaagagcttttcctttgcattcacaacttgggtaactggtgcaagaggccgagcttttggcctatctgggctttcaacagtccttcctcaccaagcttaatcatttctagcttttgatctaaggtgagagacttatgactcttctttaaacatgaatatttacaggctgttgtagggttattaattagcctaatttcaatgttattgtgtctcagggaatagggaaggctgaggagagggagagagattagggaggggccggtggagtggtcacaacagacgacatttatcggtaaagttcatcgttttaaatgggtatagttcatggtgccccctaaaattataagagtaatatcaaatatcactaatcaccataacagatagaataataatgaaaaagcttgaaatactgcaagaattacctaagtgtgacacaaagacatgaagtaagcccatgctgttggaaaaatggcactgacagacttgcttgacacagggctgccacaaaccttcagtttataaaaaatgcaacgtctgcgaagtgctatacagtgtgaagcatgataaaacaagctgtgcctgtatatatatataccgtcatgcactgcgtaacagtgttctggccaacaacagagcacatacatgacagtggtccagtaagattataatggagctaaaaatcttcccattattcaggtgtttgtggtgaggctggtgtaaataaatctaccatgctgccagctgtataaaaggacagtgcatacaattatgtactgtacatcatacttgataatgataataaacaactgttactggtttatgtatttactacactatacttttaattgttatttaaggtgtattctttcacttactttaaaaaaaaaagttagctgtaaaacagcctggggctggtctttcaggaggtattccagaagaaggcactattatcatgggtgatgacagctccatgcgtgtactgcccctggaaccttccactgggacaagatatggaggtggaagacagtgatatcgataaccttggccttgtgtaggcctaggctactaggctgatgaatgtgtttgtgtcttagtttttaacaaaaaaacttaaaaagtaaaaatttttgaagtttttaatagaaaaatgtttatagaataaagagataaagaaaatatttttgtacaactataatgtatttgtgttttaaggtaagtgctataataaaagattcaaaagttttaaaatgtcaaaaatgtataaagtaaaaaagttacagtaagctaagcttaattaactattgaagaaaaaaattatttaaatttagtgtagcctaaatgtacagtgtttataatgtctacagtagtatacactaatgtcctcggccttcacatatacttacaacttactgactcgcctggagcagcttccggttatgcaagctccattcatggtaactgtcctaaacaactgtaccattttttatcttttatacctaattttactgtaccttttctatgttgagatatgttttgatacacaaataccttaccactgtgttacagttgcctacagtattcagtagagtaacatgctttacaggtctgtagcctagaagcaatagtctagaccatattagcctaggtatgtagtaggctctaccacccaggtttgcgtaagcacactcggtgatgttcacacagtgaacaaagggataatcagtggtcccatagaacagaatttataatctagaaacagacccacatatatatgtccaactaatttctgacaaagatccaaaggcaagtcgatggtgaaatagtggcctgttcttacatcatctgatgtgtgaataatgagacacttagatgcaaacaatgaatcttgacccaaatgtcacatcttacacaaacaatgaactcacatcagatcttagaactagaaaacttttaatataaaacatagaagaaaatcttcatggcctgtacttaggcagagcttatagatatgatgccaaagcatgatccataaaagaaaaaaatggagaaattaaactttattgtatttaataactcaggatgaatgggaaagtaaagatattacaaaaaatgaaaaagcaagctacagaccagggtaaaatatgtgcaaatcatatattcctccaagggctagtatctagaatatataaagaattctcaaaactcaacagtaaggaaacaaatcactcaattaaaaatgagcaaaaagactttggcagacttttaaccaaagaggataaatgaatagcaagtaagcacatgaaaagatgttaacatcattagccactaaaaaacatgtaaaatcaaaagataatgaaatactactacacacctattagaactacttaacaaacaaaacctgacaatatcaagtactggcaaggatgtggaacatctggaactctttacacattgcaggtgagaatgcaaaatggtgcagctgctctggaaaacagtttggcagtttctacaaagttaaatatttaattatcatatgacccattcccagttatttaacctaaagaaaacttctattcacacaaaaacctatacactaatatctacagcagttctattcataatcaccaagaactggaagcaacccaaacacccttcaatgagagattggatccacaatggcacactagtcagtgacagaaaggaacaaactatcaatacttgcagaatcatggatgaatctccacagcactgtgctacgtgaaagaagccagtctcagaaggctcgatactgcatggctccgtttacatgacattctggaaagggcaagactatggtgatggggagctcattaacggcagccaggggttaggagtaggaggagtgtgtgactacaaaggagcagcacaagagaacaacagaatcataaccatcaagctgtacacacaacacacacacacacacacagagttaattttactgtattatttttaaagaagttgttggtttacagtgataaaattgccttttttcccctgctttttcaagaaaacatctcatccttaagacacagacccaatgccagcattttgtgaagtcttccccctgtaactcagggagagtcagcagcctggatcatattttcatggaactttgttcatatctctactctcatgtttacttatcttcctcccgctactagaccagaaaattcaagttgattcgcaactggattatgatcaggtaaacaaatatatattgcgtgtatagcacatatactagacattcactaatgtttatttttgcattgctaatactcaaatgacaaaaaattagaatattagtactataatatttatcacattcaatcactcacctaacatatgtgagattaaatctaataggcagttggaagtccagctgaattgtagcacattgatggtatctgccaatagcatccttgatttttatgtcaatctacaaattaaataatgtttgctcagaaaagagtatttatttttcttttacattttgctgttttgaagcatgtggtcgactcactttagggccataaaatgctccatctcctgggttcattttccacggttctccaaagtccatcaagctgttctgcagttgctttttcaaaagaagaaaaaagatacaattatacactgtatcttttttttttacatacagctcacaaaagttactataactcttcattacagtctatgttagttcaacatatatttattgagcatcttttacattcaataaactattgagcagggactacacagagatgattaaggtggcacctgctctcaaagaaacataaacatttcaactggggagaaaagatcatttataaattgttccagtgaattccaggtaagcattagggaggggtcgcttttgaccctcctcccaacacaggccccctgtgccctacacatcaaccagcttctgcctcctggtgacgggcctccacacatgaaaaagcagaaaagccttgatcacactccctcttccactctgagtctgggtgggtaagaaggccaagagggcaggccttactacttcctttttgcctttccttcacctctgcacgtgtctgggagggtcacttataatttataggggtgtggaggcatgaggctccacttttgtcttcagcctaagccaccacatgccttcaacttagcttgtagtgaagatgttccacattgaaggtgaggatgcaagtgtattaatgaaaaatttcccagagtcttccagtattcccgtgaatccagcttccctgggaagcacgtgggcattcctgagtccttggccaaaagtactgccaaaacacgagccaaactcccatcatcacctccaacatacgggtgcccatgagggggcagacttgggagtgacgcgcctcatggggaaatcagagccgtggcagagtcttagggccgaagctgccatcatcaagaaagctgactcctgggaaagctgactcctggagtcctggcagcctttcccaggacctcagtcaggatctgatcttgagagagacggagatttttttcctgggatcctgggagtgtcccgcataggcctgatcttacagaagcagcttcttttctacttaggaccagagaaagccaccccacggagacacttccggggcctggaggctgcgctcccctgttccactctgtttctcaaaggagaaggaacacaggtacatgtttccaggacaaatgaggccctcctacagcagataccaagtgatggaaagaattctggggactgcaagaagctaaaaagccaaggaaaggccaagttttggagaagaggataaagcaggggtcactgctgctcctcgggccttggaggacacaggacaggagggcacagtaggagctgccagagccgagagagcatcggatacatgaagatgtgtctctttcaaaccatttcagacacttctgaagacaaaatatttcaatgctcacctcagtgatttccaggccagggttagttattggagagaaatatctcaaaagtggaagcaggtccatccagtcacacccctgggtgacctcaggcttggctgctaaactatttacccccattaattaagaaaggagcaaaaatgctgggacttccagcctattctccccatgccaggtctatacctggtccatccccttttcagctccccacaccccaccaagtttcaaatgaatggagtaatgacaacgataccaacacctgacatctactgggcacttacacgtgcctggcactatgcctaacactccatgtaaattccttcatttaagttcaccataccctcaggaagtgggtgtcattgctacatcaccaccaccaccatcaccaccatcgttatcatcatcaccatttcatgctggatcctgatgcttatagatcttctataatttactcatggagataaagtactttcagactttaaagtctggagcaaatggctccagagctgagctctgtgtcctcatttcctcttcctgcttccacatggctgttaggtaaactgagtctgcatccttcccagggtagataggctatctcatttggccctctttgtccatgcagtggatgtggaagaagagcttaggatgggcacgggtcagtggggaggagaaggccctccttagagctcaaggctaaactgcttctgtgcagcctctgctcggcttctgcacctattaatcacgtaaaaataattgttatactattaatccagggcttctctgattcttatttctcatattggtgtgttaagctcccaggagtacagtagtcccccttctctgtggtttcatttttctcagtttcagttacccgcagtcgactgcagtctgaaaatattaaatggaaaattccagaaataaacaactcataagttttaaattgggcactgctctgagcagcaggataaagcactctcctactctgccctacctgggatgtgaaccgtcctttcgtccagagtctccatgctgggtgcactgcccacctgctagtcacttgggagctgccatgtttatcaaatcaactatgcagtatcacagtgcttatgttcagtcacccttattttcctgaaccatggcctcaaagcacaagagttgtgttactagcaatctggatatgccagagtgaagccacaaaatgcttcctttaagtgaaaaggtgaaagttatccatttaacaaggaaaaaagactcctatgctgaagttgctaagagctatggttaaaaaaaaatcttctatccattgggtaagttgtgaattagtgaagaaggaacaagaaattcatgctagtttttgctgttgcacctcacactgcgaaagttccagccacagtgcatgaacagtgcttagttaagaaaagaaagggcattaaatcccagcactttgggaggccgaggcaggaggatcaggaggtcaggagatcgagaccatcctggctaacacggtgaagccctgtctctgctaaaaatacaaaaaattggccgggtgtggtggcgggggcctatagtcccagctactcgggacgctgaggaggagaatggcgtgaacccgggaggtggagcttgcagtgagctgagatcgcgccactgcactccaacctgagcaacagagcaagactccgtctcaaaaaaaaaaagaaaaaaagaaaaaaagaaagggcattaaatttgtgggttgaaggcatgaacagatacgtgtccttaacctgattgccatcaatttggtaccatccagggttttgggcatccacttggggtcttattcccatggataagtggggactattatattccaagaagaggagaactaacaggcagagcagggtgtctggccatgacaccatcctcatttttaataaaagtgaacacaggaaacacactatatcctttgtgtttattaagaaaaaaaagcaatgtgatgatctccttatcttggttttgcaaagcttagatgtaacatctttgggcttgagtgtcttcagacagacacagggcagggcacgacaggacgtgactacgaaggggactatgcacatctacatctagaccatgcagccctgggactctacagtcggactaagatgactcaacaggcaatgctttaaaataaaccacacaaaccgagagttacagcaatcagaggatttctttaaaatcctgggccagctattagtgaccagcactgcaggactataaataaaagccagatatgaactttaagtgtgaagcaaatgtaaggtattattatcaccgtcacaaagataatgggataaccacattctacaacctatatatctatctcataatttccaggttcaaaatttctattacaaattattgcatcctcctgtgaagactgcagcctctcaggtgtcttccatacgactaaaatgaagaggaagcacaaggtgtgtctcttaccttctcagcctcattccacatctcaatctctcctaggaagttttccggccttgttgacaggtttaattgaaaggagaagccaaatgttgagtaaacagattgcaaaaactgcaaacacccctttatttcttcttcaatctgaaatcaaagcaaatgaaacattcaaatagaacatcaaattcatttatgttttaaaaaatacaattcttcatgtcagacagaaataaagcatgtttttaatggagtacagttgatgatcctgttttggttgcttatccaatcctgagctgaaccttcgtttgagtgctaggcacgtgcagggaatggagaaggagtaggcgagggaaccgtactgtgaaaaggcagcgccgcgcacaggagagcggcacggaggggctgcccagaggaagtgagactgagctgcagcaggggacaagcaaacgctctgcatggagcggaagctcaggagctctgtgagcagaggacacactgagttgaaggctccgtggacagaggagcagactaagtcggggggctgcatacgatgggctgaagggcagaggggcagtgtggtaggtgggcaggggccagagaaaattaagtgctttcaaagccaggcgaatgtatggattttttaggctgagaacaacggggaggcaatgaagggtttttgttttgttttgttttgtttaagcaggggactaacatgagtcaatgtgttctttcacagtatgtggaatgaactggcaagattagaagagagccccatcaggaagctggctgagtcaattaggagcaagatgacagtggcttaaaccagagagaggcagctgaaatgcagggaatttgatggatttgagacatcaagtctttcattcattaactgcaatggctagttttttgttttgttttgttttttgagacagtcttgctctgtcacccaggctggaatgcagtggtgtggtcttggctcactgcaacctctgcctctcgggttcaagcggttctcatgcctcaggctcccgagtagctggaactacaggtgctcgccaccatgctcggctaatttttgtatttttttttttttagtagagaaggggtttcgccatgttggccaggctggtctcgaactcctggcctcaagtgacccacctgcctcagcctcccaaagtgctgggattataggcatgagccactacacccttttttttttttttttaagttcctgggtgcacgtgcaggatgtgtagtttgttacataggtatatgtgtgccatggtggtttgctccacctatgaacccgtcacctaagtatttaagcccagaatgcattagctatttatcctgatgctctccctccctcctcttccctccgacaggccccagtgtgtgttgttcccctccctgtgtccatctgttctcattgttcagttcccacttataagtgagaacatatggagtttggttttctattcctgtgttagtttgctgaggataatggcttgtgatggctacttttaagtgttaactcgactgagctaaaagatgccagacagctggccacccttacaacatttatttctgggaatgcctgtgagtgcgtttctcgaagagatgagcatctgaatcagtggaattggtaaacaacttccaccctcaccaatgtgggtgggcctcatccaatctgttgagggcaggaatagaactcaaaggcagaggaaaggcaaattctctctctttttgagttgggacatttattttctcctgttctcagacactggagctcctggttctcaggcccaccaactctgggacttacaccagctccctcctttgctcaccccactgaggcttttggccttagactgggagttataccatcagctttcctagttctccagcttttttttttttttgagacggagttttgctcttgttgcccaggctgcagtgcaatggcacagtctcagctcaccacaacctccacctcccgggttcaagcaattctcctgtctcagcctcctgagtagctgggattacaggcacatgccaccacgcctggctaattttgtatttttagtagagacagggtttctccatgttagtcagtctagtctcgaactcccaacctcaggtgatccacccacctcagcctcccaaagtgctgggattacaggcacgtgccaccaagcctggctaattttgtatttttagtagagacagggtttctccatgttagtcagtctggtctcgaactcccaacctcaggtgatccacccacctcagcctcccaaagtgctgggactacaggtgtgtgctaccatgcctggcctttctccagcttttaattggcatatcatgggacttctttttttttgggggtcattttttttttttttttgagatggagtatcactgtcacccaggctggagtgcagtggcatgatctcggctcactgcaacctctgcctcccaagttcaagcgattctcttgcctcagcatcctgatagctgggattacaggtgtgtgccaccacacccagctaatttatgtatttttagtagagatggggtttcaccatgttggtcaggctggtcttgaactcctgacctcatgatctgcctgcctcagcctcccaaagtgctggaattacaggcatgagccacctcacccagcctgggtcatattttttaatctactatgtcaatctcttttaattggtttatttagaccatttacacttaatatgttagggctttacactgcctttttgtttccttcttgttctctcttgttattcatttctgttttatttttcctgtcttcctatggattactttaacatttttctggaattcaattccaatttatctataggttctcttagtgtatccctgtctatagcttttttttttattggtttctctaggtattatataacttatcagtccagatattgtcactttaccagctcaggtgaagtacaaaaacttttattccctataccttaccccatttatagtataattttcttaaacatttcttctacatacatttagaacatcagaaagaacatgtgatttttacttcaatgatcaaacataatttagaaaacgcaaaaggagaaggaaaatatattgtatttacctgtttttattttcacaatctttttcttcctaaagttccctgattcctcttttcatcatttcctttctgtttagaaaacttcctacagccattcttttggtgggtccaatgtcttgatttcccctcaattgctgaagggtattttctttagacatagaattctgggttgaaaattcctttttcttttttcagcactttaaaagtattgtgccacttccttctggcctccaggatttttgttttttgttttttaatgagaaattgctatcattcaaattgtttttctctttaaaggtaatgcataatttctctctcattgctttcaagcctttcctttgtctttagttttcagtttactatgatatatcttggtgtaggtttcttggagtttatcctgaacagctttcttgaatctgtagatgtcttttgccaaatttggcaagttgtcagctattatttctttgagtactttttcactcccaccttcagtctcctctccttccaaaattatgatgatatgaatgttagatatcttgttatatcccactgttctcaggctctgttcttttctctttcagtctgttttctctatgtttttcagattgtgtaatttctgttcttgtcattatgtctgtcttcaccattctgctcatgaatctattcactgaatattatatttctcagttcaaaatttccatttggttcttctttatatcttctatttctttcctgagattttctgtttcttcgctgactttgtaatttttgtttgtttcaagtgtgttagtaattgctcattagttagtaattgcatttttatggtggttgctttaaaatctctggcagataattgtaacatctttgttatttcagtgttaccgttcatagattgtctttttaaattcaagttgagatttttcttgttcttagcatgatgagtgattttcaatttcttaaacctggacattttcggttttatagtaagcctctggatcttaaatgttgttttagctgacttccactgacactcttccagcagagggaggacagtactggacagttactggcaagtgggaaaagcagtccaagctccttttagaaaggaagtaaggggagaggagctcctcgttacttctgggttgcacaggtgttctagcccccctccatggcctttactgcacacagaaagcatggcctcatgaccaattggcagtgagaaagtcttatctttccactagacgtcttctgacactactcaagcaggactggaagaggcacctcattacttccaggggagggcaaaagtccaggctccccacatagtcttcactgacactgctgggttgggggagggggatgggatcttgttaatgcaggagtaaaattcccagcttcctaataagccttctcttacccattccaacaggtattgaggtacttatttagagcctgctgagagttaaaatataagcttctcaatcagccttagctggcatataaagggccacagttttttctgtggtgtctggttgaaatagagtagatattgtctaaaacttttctatctttctaggctgcccctttcctagtcctttggctacagcaagcagacttctgttggcctgttttatcgatgcctgttggcatctgttggttgccaagtctggaatatatgtggcaaaacaaaacaaaacaaaaacacctaaggaactcactaccatgttgtttcttaggtcctgatgtccatagccagtgtgccctttttctcaacacctttcagagtctcgtgtttgttttatatgtaatatccaaggtttttacttgttcttagagggaaggaaagggaaagcacctgcttcatcttccccaaagcaggtcttttttgctcattgtttaactgggttgtctgttttcttattgaggtttgaatatttgttaagtattctggattcaagtcctttatttgatatatgcctcacaaatattttctcccagtctgtaacctgtctttcctgtctatgatcagtattttttgaagagcagaagttttaaattttgaggaatccaatttatcaacttttttcttttatggattgccctttggtgtcatatctgagaaatcatcacctatcacctaattacaaagattttccccaatttttattctagaagttttgtatttttatgtttgacatttaggcctgtgattcatcttaattttttcatatggtatgaggtatgaatcctcatacctcatgttttgcatatggatacacaatcattccagcatcatttgttgaacatattacctttcctccattttattgccttcgaatcttaattaaaaatcagttgtccatatatttgtgtctatttctagactctgttttgctgatttatctatctagaccagcatgattactgtagtttctcataattcttgaaaccaagcatagtgactcttccaaatttgtttttatctttcaaagttcttttggctattctaggttcttgtgctttctatacgaattttagaatcagcatgtcaactcttacagggaaaaaaggtctgcttgggtattgactgggattgtactgactttatagatcaacttggggataactgatattttaataatatttagtcttccaaaccacgaacaaggtatatttcatttatttaggccttctttaaatttatctcagcaatgttttaaagttttcactgtataggttgtgtatgtatgtattactcagcttgggctgccagaacaaaaatccataggctgtgtggcttaaataagaatcatttattcttcacagttctgcaggctgggaaatccaagatcaatgtgccagctgattcagttccctggtgagggctttcttcctagtttgccaacggctgacttctcactgtgtcctcacacggcagagagaatcagaaagcctctggcatctccttaaaagggcactaatcgtatcatgagggttccatcttcataatctcatctacacctaattacttcccaaaagccccatttccaaacaccatcacattgggggttaggacttcaacatataaattttgggagtcacaattcagtccatagcaacatatttgtcagtcttatcccaaagtactatcatatgttttgagatgctattacaaattgtttcttatttgcaatttccaagggtttattattatgaaatgcatatacaattcatttttgtatgttgatattccatactacaatttttctaaattcaccttacttctaatagctttctgtagattccatctgatctctacatagatgatcatgtcatttacaagagttttaattctttccaatctaggtgttttttatttctctttcttaacttactgcatcagaaagaacctgcagtacaatgatcagagaagtaatgagataatccttacctaatatctgattttaagagtaaagcattcagactctcactattaagtatgaggttagctgtaggtttttcatagaggccttttatcaggttaagaaagttcccttccattcctagttttgagagtttttatgagatatggatgtagaattttgccaaatacttttccctgcatctactgagaagataatatgctttttgtctttttgtttgttttcttttttttagtttgtgaatgtggggaattacaatgattcattttctaatgttaaactaccttttcattcctgggattcagtccatttgattaagatgtcctttttaaaaaattactagatttgacttagtaaaatgttgtttaaattttttgattttatgttcatgagagatgttcagtagttttcttttaatttctttgtcttatttttctatcacagcaatattagcttcattagcttcatgaggtggtgaagatttcctcctcttcaattttctggaagagtatctctagattggtattattccttctttaatgtttggtagaattcaccagtaaaaccatcttggcctggagttttctgtgtaggaaggtttttaactatcaattcaatttctgtagtagacacagggctattcagatgatctacttcttcttgagtaaagtttaatagttttgtctttcaaagatttatccatttcatctaagctgtcaaatgtatgagcataaagttattcataaaactgccttatctttttaacagctacagaatctgtagtgatgacatctgtctcattcctgacatttttatttgtcttttttccctcatcagtctgactaaaggtttatcaattttattgatcttctcagagaaccagcttttgttttatttttactctttattttctatttcagtgatttctgctctgctctttcttattttctttcttttgcttccattacattgggtgtaatttgttcttctttttctatcttaagtaaaagctaagtcattgatttttcttttctaatgcaggtattcagtgctataaacatccctctaccacttaaatcgcatcctacaaattttgatgtgtttttatttcatttgttatataaaattgtctaattttcctttggattttgtgttatctatttttaattctattgtggtcagttaggattagggttaaacattagggttaattaaacattttattttaattgcatccctttcaactcactgagacttgttttatggtccagaatatggtctattttagtaaatattctacgtgcaatttcaaagaacaaatactctgagctttttgtagttcataagcgtgatgactgggtgtacacacatgtgtaagatgtacctccctcacacctcggtacaacattggcatattacccaccccacatgaagcacattggatacaacactggcacattacccatccaacatgaaaccaaagaatgtatattctgctgttgttatataaacatcaattaggtcaaattgtttgacagtgaaactttgcatggcaattttaacttgaattaacacaaaaacttgaaaaagtaaattttaagttctaggcgatactgaaaaacaaaacatccagaattccaccaaatcccttaaaatactccacttaatggaatttaggttaataaaatcactgaaggaatatatttcatgtcaagagatgattaatctattgacctaatttagagaatcacagcaggttagagctgaatgaatctcagagactagaccaaacgtctatgtttcagtaactctgaaagaatacaagatgtgtgcggggcatcacactcaatttgtgaccacactgcttcactctgtgttattgtttacctgctccactgtgcaaaaaatgtgagcatcgtcctgctggaagcgcctcactctggtcaagccgctgagagtccccgacagttcatttctatgcagaactccaaaatcagcaaatctaataggcatttccctccaagatcgtggacgatgggcaaacattagactagaaaagatgtggtaacacacagcttttacacagcacagaaatattaaataattatctaaatataaagaaattacaattaagcctcaagattcataaactccttattctagttcttagatcaccaggttaaaaaaaaaattcttccacaaattagtgaaccttgcatttacatcactgcagcactctgagaaagatgcttgtctattatctcttcccagaaatgctgttccctccccttatccacacagtgaatcaccatttactgtttatgattcatttcaaaggctacttcttaaatgaagccctcctagacatttcccagacagggctaggcagtttctcctcacgttcctggaacacctcaaacatgccatcattatggcactggtctttttataacagattgtctacatgcatggccctgcccactctgctcatgagttccatgagggaatggtttgtgtcttaatcacctctgcacttctagctccaagcacaaaaagcactcaactatgttctctgttgaatgaaagacttctctcctgcagaaagcactcctagcttccatatcccattgcctctaagccaccgtggtcttgctttcttattctgaggtgtaaaaagacaaacttaaattctctactttcattataaagtacgaggctataattttaaaggatgcctttgagaagatgagttaagaaattgttaacacaagtgttttacaatgcaaaacactagcatagcttctaccttctgtttagaaagagaggatacagaatgtttacataccggtgttcctaaaattaaagttatatatattttttacatgacatcatcataaagttaaatttcttctcatcttcacttaaaagggcaaagagctttcttcagtgttcagttaccggttttaataattatcttctaggtaaatttacttgaaactatgtatgttgataatacaaaaactacaattgttgggattgttttttgtggacaattatgcctattcagtttcagttgtacaatatgtttgtcttacaaggttgaatttgcataccaactttatgataattagtctttcatagaatcaaagacagcattgattgtaaaatgtatcttcattttatgtgctacaaagaaagaaaataacctattaattaaattatgatataatgctaagatgccaccaactataagatgcatttcaacttcagaaatgttgaaatgtggaagaaaaatggtatcttggaatcagtgaaatccagaaacccattgattatgacctcattgatcttgttataatccacccaaacagtatgaaagaactaaatattctgcaaatatgaacatgtgaagtgcattactataagaaagacaaatattataaaacttataaaattgacacataacattatcctttaatcagcacaaaaaaatgcaatggttaccagctaacatcccatacctgccaaagatcaaatatattttcaaaagtaaatccattctccggaatgaaacaacttagtaaaaattagtaatcaccactcttcagattaaagggactctttcattccacaaagcattaaaagataattgtgacgaagcgtgctatgtgctctcatgaaaaggtctgcttcgcttttaatactcaccagtgccctggacaattcatgggtttgagggcaaaagtgtccttttcaatctcaaaggtaaacatgttctcgctgtaatgctgccagtggcctgaggcttcccagagtttactgttgtacatattgggagagagcacctccgtgaagtcccgtttgtgatattcctccttcaagatacatgcattcaacattaaaatctgctagggcagatcacaattccatgcaaagtaacactatgagcaaatattttcaaattgggctcatgtcctatattaattcatgattaatgtaccctcagttttaggtgtggtggtttctggatcttggaagaaagatttacatatgcttagtataatttctattgagtatatttattttatagcatataacagtatatagtatataatgttttagttctttgaaaagtagtaattgaaatacaatatatatagaaactcactgtaactactccaaagtccttctaaacaggttttttcctattaagaggcagaaaaaatttataatttaataagcctgaatgccatgttgcatgttataattttgatttatttagttttaaacagaaataagaattttagtgtataacgatttaagtagttgaaattattaagtcatgagctggcctctctccctccctacctattaacagcttccctaattgaattactggagacaggagaagagagtttttttccaagcaaagttttaactttatttaaactttctttaaaaacaaaacaattaggtgatctttgttgggtaaatattttatgtgcactttccaaaaatgcatattctgctgttgttttacaaatgtcaattaggtcaaattgttttgacagtaatttgatagggaccctttgcatgacagttttaatttggatgaacacaaaaagctgaataagtaagaattctgagaatccttagattctcaacatttgtaaaccacttaatggacatctggcccaaatctagaatgccatgtatactttgagcacatttgaaaaactgttttcacagctaaaaaaacataaaacataacattttaagattactaacaatggttttatacaactgaaaggaatgttgtctgttattcttcagcagggcatcctggcagtccacggtagacagcttaggtctcggccattcagtgagctgctttacctatcctttgtttttactaaattagaaaaccttaacaggtagggtgtggtggctcacgcctgtaatcccagcactttgggaggccaaggtaagtgcatcacctgaggtcaggagtttgagaccagcctggctaacatgatgaaaccccatctccactaaaaatacaaaaattagccaggcgtggtggcacacacctgtaatcccagctactcaggaggctgaagcaggagaatcgcttgaacccaggaggcagaggttgcagtgagccaaggtcacgccattgcactccagcctgggcaacaaagctagactccatctcaaaaaaagaaagaaaatgtttaacaaaatgatgtcattaagaatggcagtgattattggctatttcagatggttccatatattcagattaaacaaggtcccagaaattaagggtgagtgtgtgggtgtgtgtgtggcagggtgtgcgtgttcgcttttactaaaaactacttttaaagtctagctcaggagatactgctcaatgcatttttaattcactctgaatgcaaccatgttaggaatgtatgtcttcttgagatgtttagaaatgattttaaactatccctgcaatggactgaatgtgtctcccccaaaattgtgatattgataccttaaccccaaggtgatggtattaggaagtagggcctctgacaagtgattaggtcataagggtagagccctcatgaatgagattagtgtccttataaaaggattcgcagagagctctctggtcctctttctgccatctgaggttacaagaagtcagcagtctgcaacctggaagagggccctcaccagaacccaaccatgctgggaccctaatcttagacttactgcctctagaactgtgagaaatacccttatgttgtttataagctacccagtctagggtactttgttatagcagcacaaactaatgaatataatccctatgagatgaagtgtcagcaactattatatttttacataaatatataggagatatctatatatattatgctgctgtatctctccatattgtaatatacatattgttttgtctctcacacacacatataaataacagagagataaagcaaactggcaaaatattaccaactaatgaatccaaatgaaggaaatatggatgttcattgcattgcattttagtttttctctagatttgaacttttcaagagaaaaagttggggagtaaaatatgtctcatgccatgccattaatttctttctctaatgctgggaaagagtaaactctcagtgactgagcagttcacagctcagtccagtctcctgaagaaatccagataacttatctggaacattaaaaatcatatttcatcctggaaataccagtttaggttattgaaggagctgagtctctacccatacctagtgatctggccacttaaaaacatctaaatagcttctaagaatcagtgtcataaatttgttttcaagtaatttctcattgtaaaaaataaggcaattccacataaacagctcctttccaaaaccccattaaaataagagtaaagaaagtttttataagagcataaatctaccaggacaaagaaaataggagagaagatgaatgctataataagttagaatctgcaaagtaggtgatcaagtgttaattgcctcagaagacctaggaaagccaaaactaaattggcagtgggagaaacccagaagcaagctactttaactgggtatagatttctaggcttcgcattactaaggcattgttcctgtcttctgtttttcagtgtttccactgaaaatttcaatgccattcagatacccagtcctatgtctgtggcttttttctctctggaaacattcaggatattttctttatccttggagctttggaatctttcgataacatgttttggtgcccaaagtatgttttcaccaaaaactgagacatgcttgggagttgagattgtccattgcccattatgggctccctttactatagaactgatagacagaaaaggacttactacccttgatcccaattacttggggaaagacttactacccttgatcgcaattactgggagaagtcgtattgcttacaatggagtaaggaggactgtgtctggaattcagtggggagcctttgatatcaacacatctagcaacaaccatcagtgggagccctgaaaccccacaaagagcattactaaaaccttggatcctaaggacagactgaggccatccactattattggtttaactgtattctccaaataagatattttgaagtcctaactcctagtacttcagaatgtgtccttatttggaagtagggtctttatagaggtaatcaaattaaaatgagatcattagggtagatcctaatactatatggctggtctctttataaaaaggagaaatctggacacagagacagatgcacacaaggggaagacaatgtgaagacacgcagggagaacatcacgtgaagacagaggatgggaatgacgcttcaacaagccaaggaacactaaagatgactggcaaccaacagtagctaggagaaggcaaggaaggattcccccatgggttttagagggaacacagcctcgtcaacaccttgatttcacacttctggcctccaaaactgggagataataaatttctgttgttttaagtcacctagtttatggtattttgttataataccctaggaaactaatgcacccaccaaataaaacaatgcccatctggggtgccaccaggataaggcgaatgtggaatgagtgatgggaaaagaaggctctgatgtatcagcttggccctagcgtccatctacagaggctgaaacagttacatttagttatgacttttccttgcattcttacatgaagggcactcatggtggccaatggcacgattcagatttaggtgaaactgaaatgacatcaccacatgatgacacatcggctgatcggagtttgtgggaggaaaccaatgtcctcagtgtcctccaagcaaaaggcaagaatgtgctgagaggcacagggggtgagccaggctggttattttccatttgccactgcctgtctcgcctcatcttggcccattttccttccttctctgccctgcactgtgttccccaaagctgacttctgtgggctccgcacaaggcttacttgctgtgattattatttttttattttataaaatatatacttttaaacacaatagtataatacaacatgcttaaattatgtttcatgtggaaaaaaataaggtgtataaagaaaacctgaacattttctctcattccaccctttactgccctgagataatgctaatggcctgctgttcctgtatttcaaccctctcctccatgactgtgcaaacacaaaacacacatacaggattttgttgttttttgcttttacctataaaaagaaaggatacactatacatttactctgtcacttccagttttcaatggtgaggtatactgaacccccttcaagttagtatgcatagatgtatttttgtactaactgcatagtgctttattgtgtggacatgtcacaaagtatttaatccttctactattgagaaacattagacttttcatttttgaatactacaaactattctgcagtaaagtttttttctatgtgattttaattgtatattttagattcctttctaagaatattgctaggagtgtgcatttttttcacattaatatttgttaccagattagtagcaatttaaactttctctctaagtatatgataactgtttcctcacatttccttcagcaatgaaaattatttaatgggtatcaatctttttttttgaaatggagtctcgctctgtcacacaggctggagtgaagtggcgtgatctcagctcactgcaagcttcgtctcctgggttcacaccattctcctgcctcagcctcccgagtagctgggactacaggcgcccaccaccacgcctggctaatttttttgcatttttagtagagatggggtttcaccgtattagccaggatggtcttgatctcctgacctcatgatccacccgcctcagcctcccaaagtgctgggattacaggcatgagccactgcgcccggccaatgggtatcagtcttagaactattacctcagtatttatatatatatatatatatttttgaaacagagtgttgctctcttgcccaggctggagtgcagtggcacaatcttggctcactgcagcctctacctcctgggttcaagcaattctcctgcctcagcctcccaagtagctgagatcacaaatgtgcaccactacgcctggctaatttttgtatttttagtagacacagggtttcaccatgttggccaggctggtctcgaactcctggcttcaagcgatccacccctctcagcctcccaaagtgctgggattacaagagtgagtcactatgcccagccttttaaattttcttcaataaattttatttcacatatttgagattcacaacatgatgttataggacacaaatagtaaaagagttaccttttttgtgtgtgtgacaagagcagttaaaatctaattacttaacaaaactccctgataaatataattttgttaactttagtcctcatgttctgtattagatctctggccttgttgatcctagatatctattttgtatcctttgatctatatccccccatttcttccccccaacccctgaccatggtaagcactgtttaattctctgtgtatgtacctgagctctctcctttttttagattcatcagctcccctggttctcaggcctctgcactcaggcgagaattacatctccaactttcttggaccctcagatcatgggatttcttggcctccataatcacacaagccaattcctcataataaatctcttcttttctatgtatcttgttggttctgtttctgtggagaatcctgacatgccaatatactttccatatggtttctgattgggtctgaccaatgggaagttccaaaggattcacagggtagtggaagagagaggtctggatatttctttccctggttctccctgctgtgggtttactcaggttctggctgtgttccacagttacagcttctgttgtgtggcctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccatggctccaagctctctgtgggttctggtattactactccatctcctcacttctctcctccatggctccaagctctctgtgggttctagtattactactccatctcctcacttctgcaggcctagtgatggaggggaagggattcttgctattggtaatccctgggcgctctatcatcccttgttagttaccttagccaggcccatatctccataaatacttccttcactagactctcttcagttaaacccttggagtgcatctttcaggactctccctgcagaagagctgaatgttttgaggcctgccatgttcacaaagacaagcttggtctagaaattcactccatctaaggttgtgtgaagaggaagcaaaaattccccaagtgggttattaatataacaacaagagaagccactcccctccccactccagggtttcaagacatgcatcaacaagtcaggcagattccaggaaatgcaaaaggtgtgactgagatgagctttacaaaagcaaccctcatgcacagctggtgggaatgcaaaacagtagtcattttggaaaatagtttggcattttcttataaacttaaatttaccatatctattctcacactgctaataaagacaaacccaagactgggtaatttatgaaggaaagaggtttaatggactcacagttcagcatggctggtgggggggcctcacaatcacggtggaaggcaaaggagaagcaaaggcacatcttaaatggcagcaggcaagggactttgtgcgggggaactcccttttataaaatcatcagatctcaagagacttattcaccaccacaagaacagtatgggggaaaccacccccacgattcaattatctccgcctggccccacccctgacccttggggattactacaattcaaggtgagatttgggtgtggacacagccaaaccatatcaccatatgaccctgaaatcacactcctaggtatttactctagtaaaatgaaaacctatgttcatacaaaaaactgtacatgaatgacaatagcagttttcataactgccaaaagctgaaaacaacccaaatgcccctcaactgcaggatggatctgaagcagtggtatgttcatatgatggaatactgcccagggacaaaagcagaggcccgctggggacactcaactcggatgcatctccagggtgttatgctgggtgaaagcggtcagtctctaaaggttttataaaagtatgattccatttatatgccaatattttaggggtagagaaaaaatcagccgttccctgaggtcagggctggggaggatttgattttaaaagggtagcatgagggagttttgaggggtgacggaactgttctgtatcttgattgctgaggtgataacacagttctgcatgttatcaaaaaggcgtacattttactgcatgacaattaaaaaagttaatttaaaaaaaggtaagaaaagtacagaatcagctgacagatattttccagaatgcagggaaaaaaaaattcaaggagactaacaaaaagatctatttattcactatcagttgtccacacagtcagtaactaatatacaaacaaaagttcacttgcctttacttaaacctaagtggaagtcattttacctgagtcaaaaactcagaaatcctgaaatttccctcagtgggagcagtgtgcacacccagcccatcctggcctcctacatcccttccacagaaatgcagcagttccagttctgaggaaaaggatgcttcctggtagaatgcggccatatattccatcgtgctcagcaccatgtatccccagcactctggctactactgactggtctaggactcagcaccaaggcaaaggctactgatattggaccagaccatggcccctgaggcagcccagctgtgactgagagtctgtcccacaagcacaccctctactggctggtgactaacagaaccaactggaacctcagggaggaccttgaggcacatggaagagggcagagaggaaaaaagacacaggcagatagactgaaaaatatcaagacccaacagtattcttttctccagcaacgtactttaaatatagaaacagaggcagaaaataaaaggataggaaaagatatatcatgcaaacactaatgtaagaaagctagcttgcctatgtcaacaccaaaggagacttttaaaaagatagttttattacaaaaggtcaaatagcctatgaacccatttatatgtgacacctagaaatagtcaatttcatagcgacagaaactagagtggtggttaccagaggctgggggaggcaggcatggaaattagtgtttagtgggtacagagattaagtgtaggatgatgacaaagtcctggcgagtttcggatttgcaacgtggaaagagttctggagatggaccatgacagttgcataataacatgaatgtacttagtgagaatgaattgcatacttaaaaatagttaaaatggtaaatttttatattatgtgtattttaccacaaaatggcttgaggtaaaatttacacgccataaaattcaccaattttaagtgtacaattcagtgactgttgacaaatgtatacagtcatgcgacttctgccacagtcaagatatagaacatttccaccctccaggaagttccctcctgaccccctggagtcaatcccctctccccacccactggactcctgatcatctttctgtcactatagttttggcatttctgaaatgtcatataatggaatggtgccttatgcattctctgacttatctggcttagtacgatgctttcgaggttcctccttcatgtgtatatcagtatctcactgcttgtaaatgctgagttgtattccacagcatggactttccacattatgtttatcttttcacaagctgaatctggggttgtttctggttctgtgctattataagtaacgcttctatgaacatccaaatacaagtctcagtgtagatgcgggcatatgtttttatttatcttgggataattagaagtgggggctggcgtggtggctcacgtctgtaattccaacactttgggaggctgaggcgggcaaatcacctgaggttgggagtttgagaccagcctgaccaacatggagaaaccccatctgtactaaaaatacaaaaatattagctgggtgtggtggtgcatgcctataatcccagctacttgggaggctgaggcaggagaatcacttgaacctgggaggcagaggttgtggtgagctgagatcatgccattgcactccagcctgggcgacaagggcaaaactccatcttaggaaaaaaataaaataaaaaaataaaaggccgggcgcggtggtggctcatgcctataatcccagcactttgggaggccgaggtgggtggatcacgaggtcaggagattgagaccatcctggctaacacggtctctgctaaaaatacaaaaaaattagccaggcatggtggtggcaggcgcctgtagtcccagctacttgggaggctgaggcaggagaatgcatgagtccaggaggcggagcttgcagtgagctgagatcgcgtcacggcactccagcctgggcaacagagcgagactttgtctcaaaaaaaaaaaaaaaaaaaaaaaaaaaaaagaagtggggcacgtttatctttacaggaaatgccaaactgctacaaagtagttctaccattttacgttcctaccagcagtaagtgttatacttgcttcatattcttgccaatgcctgatgtttttagtctttctatgatgggaaggggacattcttcaatcaataaccctggcatgagactctacctgaatacagtcatgtaagggacccaatgcgagaaccacccacaggagcctaaaatttggaactatgaaagacagtaatgatgaaatggcagttttaaactattaagttctgggatactttgctatgttgcaatagccatccagaacagaattttgcactggatgtaggtactgctataactgagaaataaaaataaaatcctaagctccccaactgactgaacagacaccctcttggccaaaggaccccagagaaaccttaaaaactgagttactggcagtgacaagaggttggacatgcctaattatacccactctgtcactaacaaccattaggctttctttcctaagagttaatcagaaacaagcccttttgaaagacttgttccaccactgatttacacaactgagcagcatttcttcctgttaaaagaccactcaccatgcactggttctggttggtttataaaggctgcacatgggatgcctccgtgtcctccatttgaccttttggttatacagcctaatttaaatgcattgtctccaccccaaagtgaacaagggatgcatgtaacatgcatgtttgcttactatgtatataaatgtcccccctttgtgaatattcatagctcttcttataacctgttaaatatttatacttggccaatctcatcagcataaattcctgtcttacttttccctcccttgaaatgcctgcttctggtttctgccagaagctatgaagcttcctagcctgcaagatttcaggctgcaacccctcagaagaaatgaagctctcctttacaattttatgaacctcatgattcttcagttgacataacaataacctaaaacatgtagctttggggccaggtggtgggcagaagctagaagggattcttattacgaggtgccagaaacagatggtgggtaacactgtcaccagaagtaacatggaaaacagaaagggtacccaaagaactcatggacttagctggggagacgtccaggcagaatgtagaaaatgacagccgatttttggctccctatggtaaaatacaagaaaagaggtataaaccaaacgtgaaactaattaactttttgagccaagtttagaggaaatataaagccaccaggacctgctgggttcaaaaatgaaaccttcttatccttagactgtaccaaaaaagactcacgaggcttcaggacacggatcaaattcagattataatcatcaaagcacagccttacggtaaagatcttaagggcggggctgtaagacactgtgaaaacctcagaatgatctactgtaagtgcacctagtaaggcttctgaaagtcttaggagtgtgctttgtagaccctttccattaaacacgaaggctctgaagactctgcagtgtactattgtctcacagtagcctcccaggcaaagaaggatcggtgtcagaaagatgtggatgtggcttttatctaaccgtgttgatgataaatttatagaaaaggactcgcaaagtttttaaaggaattgtactagcttagattgaaaggcagcacaaaatgaaataagggctttggattcccccagccttctacaggaaggaatcaggttgagaacaaagctaccccaggccgggcgcggtgactcacgcctgtaatcccagcactttgggaggctgaggcaggcggatcacgaagtcaggagatctagaccatcctggctaacacagggagaccctgtctctactaaaaatacaaaaagcctggcatggtggcaggcgcctgtggtcccagctgctcgggaggctgaggcaggagaatggcgtgagcctgggaggcaggaggttgcagtgagctgagatcacgccactgcactccaacctgggcgacacagcgagactctgtctcaaagaaaaataaaaaataaaaaaatacataaataatttttttttttttaaaaaagaaagctaccctaaggcacatatgggccatttcttatggaagagaaaggatgactcagagggcagaatcacagccaggcagagcaaaactggatcttaatcaaagtgtatcttttgaccctggggcagtgatgaccggtagataccagaatttctacagatggtgactaccatgtgcctcctactctaccccactcctttttgagtaagactatctattgcattattcctcaagcaccattttacaatgtgagggagatgagaggatgaggtggctgatagataacttgagtttttagttcacaggtcttaaactgtagaggaaatgtacttgataatctgttcccaacaaactgcacccgaggagcctcatctgcagctaggcctgattcagaagatgtcctggatttttgagccaatgtagtaattagatgagccttggaattatttgttaagaatagaacactttggaagagtagaatggacttccctacagtcctttggggctgaaaagacataaacccaccagcctgtcaagtggaaacccaagggggtcatgacctagaaacaggaatcaaaagttgaatcttattaaagtggaagccggccctaacccagtgcaatctctgatcgaattcaatgatcagtccttaatagtggcagagggtgaatgctccagtgggagatatcatctagagcctctacacctaaattacatgtaatacttggcatctaacaaaatattacttgatatgggaagtgacacaaccataataacaaaaaaccaacagaaaaaacagctgagttctccaaaaggtttttttcatggtaaggccaattccttcagacaaaggtatccagaaatgcaaagttctcagtgtcgcctgtgtctgtcaaatattcccattccaagcctcagggacccttcccaaccagtgcccttaccttagaataagagatcactgggtttgtgcatttaagtgcctttacagtttggtgaccctcacaatcaggccctgctcctgttcatcagccacatctgtcttgcatctataaaaaataagagatccccttaatgccactgtaaaggctttctgttcattctccatctattgtactcccaacttgagagtacaaggtgccaggggccatgctgattttccagagaagacagcacatccaaatcagcagctgtgatggtcatcaccacctgcctaaatgtaaatctctgataatcttcagtgattcttcaagtctcttccactgccctctgatctcctaccattgcctcgcattggccagtccctactggaagatgtgtaccccaggtgatagaatacagacatgtcagcctccaggggcacagcacaagaagaaaaagacggagaacaagactggagaagcaaacagagaataaccagtgcaggccacatgccatggattgtcttctcagaaagttactgaagaaagtgatccccaaatgagaattaaagataagcaacgaagagatatacagggaccaggaaaagagactcagcataggaagagacatgaggggagtggccaagatgatgatgaaaagaagtcctaagccatcagtttgcaagaatcttagtagcaagttaattctggagtaggaccaaatttgaaaaaaaaaattactgagcaattacctgaatcattgcagaatatgttgcaaggagatttgtagtttttgagagaaattggagcatgaattagtggtaggcacataaaaaaactaagtaaatgaaaaatttaggtaatgattataggaaagacaaaacagtgcaagcatggaaatgtaatcccagtagtccacccggatcacctgtgaacactatctacacagtccttatcatgtaaatactaaagactttcccacctatgaacttgtaatacaagtaggtattttgcactgttggttttttcctctttcctctggaactgccaaatcacctgggagtcatgctataggcaaagggaagcatcagtggcccatggagcacatttggagaagcaatgcttcatggcttaacactctgtaccagagacgacactttctcctttcttctttttcacagggagtgccacacttagtctaatgcttacctttatattctacatggtttagaaacttatatggacaaaaagtgaattttatgaaatccaggaatgtattcaggggaaacagaaattatctccatgttattattagaaggtacaatctagtacctcactttttttttttttttctttgagatggagtcttgctctgtcaccaggctggagcgcagtggcacaatcctggctcactgcaaactctgcctcccgggttcaagcaattctcctgccagcctcccaagtagctgggattacaggtgtgcaccaccacactcggctaatttttgtatttttagtagagacagggtttcaccatgttggccaggctggtctcgaactcctgacctcaggtgatctgcccaccttggcctcccaaagtgctgggattataggtgtgagccaccgtgtctggccagtatctcacttttaacctcaaaattcttattaatgttaccaaagtaaagttaatggaaacgcttgaccactttattatgagagaaaatagtaaaaatgtaaactggaattgaataagaataaaacattttaaagttaacttactcgtatgaaatctgtaagcgtattataaatgaaggctcctctgggaaggaaaaaacagcttccaggactcaaatcgtggaaaaagaaaagttcttgttcctagattgaaacaaaaattgcatttcaaatgtcatctgctattgcttaatatttactgcacacacatataatactcagttatttccatcttctctagtaatagacattccaaggccattcaacacttatacctaaatgcatgcaacagcatatgtaaaatttccaatcatatttatgcctaattagctttgaacttagcttttacttcaccttctgctattctctgcgaattttcttacttggcacacttggagtacggcactcatggggagacaacacggtagaaagaccaaaaaagttcattgcaggaggtgggctttaggtgatgatgatcatcatggctgctgcctactgagagcctatcctgtaccaggcaccgtcacccagtttctgtcttcacagccaccctgcaaggctacccagcaaggaagacaaggacacggagcttgcccatcatctaacacaactagtgagtacaaggactgggcataaagctcaggccgagctgctttccagtctgagcttttccttctacacgctgctctgtctcccagatacaaaggatgctataaagtgcacagaatgtaaaaaacaactctttttttttttgagactgagtctcactctgtcgcccaggctggagtgcagtggagcgatctcagctcactgcaacctccgcctgccgggcccaagtgattctcctgcctcagcttccagagtagctgggactacaagcgcgtgctgccacgcctggctaatttttttgtatttctagtagaggtggggtttcaccaaaaacaactttattttttatcatgacaaaaataagagaagggtacaattttcaaaaattaataaaagatacaggaaggaaagaggttagaagacatctggggtattaaaatgaaagcactgagcagcggactgtgagtgccagcaaaataggagagaagaagaagaaatcttatttttaaagcaacttagttttgtgagacagaaacattcctatgttggcttatgattacatctccagtgattaagatgtggggcataccttcccgatcttcctgtgatctcggttctttgcttcctcttggaacttttcccagtctctcatcatcttgttatcaggaaaggatattccatagatcctctgcaatgtttccatttccggattgccctcccaatatgttgaggaattctaaatatcaaagaggattttggtaaatatatcatacattcagttgtaagtaaaactgctcttaaatacaaatgcaattttccactatcatatcaacaaagcagccctgcatggtggctcatgcctataatcccagcactttgggaggccaaggtggttagatcatttgagctcaggagtttgagactcgcctggacaacgtggcaaaaccccatctgtacagaaaatacaaaaactagccaggcacgatggcacatgcctgtaatcccagctacttgggagactggggcaggaggactgtttgagcccaggaggtcgaggctgcagtgagcagtgtttgtgccactgcactccaacctgggtgacaatgcaagaccttgtctcaaaatcaaacaaacaaacaaacaaaatcaacaaagcttaaagaagactatttgtagtgctgggaacaatcttaaaatggattctaactaaaccttcccagcctaaattataccattaaccagcaaattatgtagagtctgctatggattctaggaatgacagtgagagcacacagaaaggagggaaggctaagcagcaatcataatcaccaaggatggggcagaacagacagtaggtatggggaagtaaaggtcggtcttgctgacctacagtcaatgattaagaacagtgccattagccagccccattttacctgtaagaaaatcaaagccaagaaaggctgggactgccaagtcagtcccatgcctcctaatcccagagcgatgttttctccattacaacatcatatcccctcctgctgttttctttatgccgcaatacattactttcacatgcagacaaatattcttgcttacatcagggctattcaagaaaaccatagtatatagaacaatattttaaaatagtgtatgaaaaaggccaggcgcagtggctcatgcctataatcccagcacttcgggaggctgaggcaggcggatcacctgaggttaggagttcgagaccagcctgaccaatgtggtaaaaccccatctcgactaaaaatagaaaaattagccgggtggggtggtgcaggcctgtaatcacagctcctcaggaggctggggcaggagaatcgcttgaacccaggaggcggagattgcagtgagccaagatcacaccactgcactccagcctggacaacagagcaagactctgtctcagaaaaataaaaaataaaataaaatatcgtatgaaaaagaaatgttataacacttacaataaggtaaaatgataaacaaaagccacctatagtgttctaattatcaaaattctaaatgattttattagttttcatcaaataagaatgaaatattttaaaatatcatgatgttcagactacaaaagatatgattgaataagatatgattaaaatcctttaatagctagtgcaccttaagtttactgtattaaaaaaaaatcaatccttaccttaaaaattttgatggttttaatttttccagtgtgtcttacatgtggacctttgcaaaggtcaattaatggaccgcacctataatgaaatatttaggacatgctcaggcacagttacagtgttctggactattcattataagccataatatcctatgttttaggtagagcttcacttatttatatgtagcaatgccatttttaatttagggtgaaggagagaggtgattcatctagcctcagagtccactctgccctctagattcaaaaaccacagaacatcttctgaaagaaactaggcaattctctgattaaaaacttaaaaattacaatgaatacaaaaagggactggcttacagagtggcaaacacgaaaatgtcatctctctcaatggtcagtctttgtgtattgttctctagggagagagcttgtaaacaacactcagatgaagggaaggaatgccaaattagcatgaaaggcttcaatactctaatctttacatagaaagtcacagggccgggtgtggtggctcacacctgtaatcccagcactttgggaggccgaggcgggtggatcacgaggtcaggcattcgagaccagcctcgccaacatagtgaaaccctgtctctaataaaaaatataaaaaattagctgggcgtggtggtgggcgcctgtaatcccagctacttgggaggctgaggcaggagaatcacttgaacctgggaggcagaggttgcggtgaaccgaggtcgcgccatcgcactccagcccgggcaacagtgcaagactccatctcaaaaaattaaaaaaaaaaaaaaaaagaaagccataaaagaaaagctttatttttttttcaaaaattaaatacaagccattcaaattgaaaaactacaaaaagtgtcaatgttgacgtaagtaaggttctcaaacccaagagctcaagcattagaagccagaaatttaaaacttggcctgttttctacattttcatttatttttaagctttaagaaatgcaccgtgcatagctttgcacaaaggggatatgattttacttacagtacaattaaaccagagaaccataagtccttgactgtcgaaagtaagtaccatgagggagaatatctgtggttataattaaataaataccaggtcttctaaggcggtactgtgatagtcctagcagcacccagatggccggaacacacggaaaggggaacagcaatgacatataaggcgtatacacacgaataaagaaaaaggtgctcaggaacctgaggttaaatgaacagagctaagtgattctggtattaacttcacttgtctcctcttacatttgatcctgcctttgtttcccagtattttcttttggtctcatcatgagtatcctgctaatgcatgaagactgtacacttggactctggacaatggggcagactcttctacacttgcactctggacagtaagtatgaggcagagaatcactgccgaggagatggcttgtaatggcccccactgccacattaataagaacgtggaaggacagaatagaaactcctttcccaacagtatcactcacatggagaaaaatcctgttatagctaacacccaggaaacaaaatatgggtctcagtactgtcctgattactaaaaaggggaaaataatcatttctctttagtgaaaacattttgaagattgtaactacggtagattatcaactacacaacttgaaaaatcgatctccaaccagaaaacaaactcggcctctactgctaacaccttcaagtttaccactgagcagcgtttaccatgtgtggacacaaacctgtacacggtggtagttgcagtgttaactttctcattcagaatgcggcatttaaatttattgtactacgaagaaaaacatatttacacattattacacacaatgttgaaatgaagaaaacaactctacttttcttcaagaaacattgaaaggtcatctactgatgttctaggtgctgagacacgagggatacaaagagctcacagccttgagcgacaccgtgcagcatggaggccacaagccacgtggctactgggcatttcaaatgccattaatttgtggttgttgttgttgtttttgagacagagtctcactccctcacccaggctagggtgcagtgccaccatcttggctcactgcaacgtccgtctccctggttcaagcgattctgcctcagcctcccgtgtagctggaattacaggcatgtaccaccatgcctgtattgtatttttgtatttttactatgtgctaatttttgtatttttagtagagacagggtttcactatgttggccaggctggtctcaaactcctgacctctagtgatccgcctgccttggcctcccaaagtactgggattacaggtgtgagccaccacacctggcctcaaatgccactaatttgaaagaagatgtgcagtgagtataaaacacactggactttggaagtataatgttgcaaaaagaagaagaaaatcattcgttaatcattctttatactggctaccattgaaattatactttttatatattgggttaaaaatttgttaaaattaattgcaacttttacttttaaaatgtagctgccataaaattataggttacacatgtagctcagactagtggattccattatgtttctattggacagtactgttctagaagatctaattttaacattaatcaataaaattctgacaaggacacagctatattattaatttgtataaaaacaaaagcaaagtttatcgtaatgatgatatatttataaaactaagggtttttttccttttcctttcttttctgcttccatcactactatcggggtatacaaggcactttatattaaataactacttaaagaagctagttgttgggagaaaaacccgtatctgcatgatttaactgtttcgtatctatatattcacaacaaatcattttccttaacaaagattaattgtgtttagttcttaaaagtagctgcaaaaaaggcaacccacagaattaaatatttgcaaatcacatatctgttaagaaatggatatccagaatatatcaagaactcttataactcaaatacaaaaaaacctaattaaaaaatgggcaaaagagctcaacagacatttctccaaagacatttcttcaagaaaatacacaaatggccaataagcacattaagatgctcaccattagtacgtcatcagagaaatgcaagtcaaaacaaaaccccaatgagataccacttcacaaccattaggatgtccatgattaaaaaaaaaacaaaacaagtgttggcaaggatgtggaaaaactgaaccccctgtgcatcactggtgggactgtaaaatggtgtagccactgcaccaaacggtatggcgagttctcgaaaacttaaaaacagaattgccataggatccagaaattccccttctaagtatattcccaaaagaagtaaagcagagactcaaacagaactttacacacccatgttcacagcagcgctgttcacaatagtagccaaaaggcagaagcaacccaagtgtttacaggtggatgaatggatcaacaaaatgtggtctatccgtacaatggaatattatccaaccttataaaggaaggacattctgacacacattaaaatattaaaatatggatgaatcttgaggactttttgctgagtgaaacaagccagtcacaaaaggataaatattgtcatgattccactgatatgaagtgcctggaggaaccaaattcagagacggagagtagaatggtggtggccaggggctgggggcagggcgggaatggggagctaatgtttaatgggtatagagtttctgactggcaagataaaaagctttggagattggtgatggtttgacaacattgtcaatgtacttaatgccacagaactgtatacttaggattaaatggtaaattttatatgttatatattttactgcacaaaaaagaatactgcaattttttaccaaaaccaactctatttttttattcaagcccacaaaactgataatactgtgttttcaaagtacatgtttttggttgggcgtggtggctcacgcctgtaatcccagcactttaggaggctgaggggggtagatcacttgaggtcaggaattcaagaccagcctggccaacatggcaaaactttgtctctactaaaaggatagaaaaattagtcaggcacggtggcacatgcctgtagtcccagctgagggactgagacacgagaattgcttgaatccaggaggcggaggttgcagtgagccaagatagtagtgagccaagatagtgccactgcactctagcctgggaggcaaagagagactctgtctgaaaaaaaaaaaaaaaaaaaaaaaaaaaacccaaaaaataaaaaacaaaatgtatgttttctccaatatgtatgttttaaaacataaaatcaggaatatatttaagtacgttggtcaaaaaaatataaagagaaagttactgttttacacaggttactctaggttaaaatctgaaacaaaagttaacagaaaactcccacagaaaagagaaaaaggcagcattttatatgggattataaatattgttgaatttaggtgacagatattcacaatactcagaattaatcagatttataaacacacatgtgaaaattattcacctggccctttacctacctatgtctcccctcaaatgttcaggaaatagatggggagggaaatgtcacagcaagtaactggtaacaacctcacagtagcttaacaggattggaataatttggtgagcaacaggtaattatttgggggaaggtggggaagctagtctatattgatttttaatattcctagtaagaggtttaggagtttccccaagttaccttaaacatttccaggaggatttccttgctgacttctagtctttcaaaaggttgcttttcttttatgatggctttacatatattctccagggctgacaattctgtgctggacactgctctaaaaagaagagcagagaaccgacatccatcttccagacattatgcattccctctttcctttgtcctggagcctcagcagccataaatttgaatctgctgtcttattgttccaggacttcagaaagtcaaacgttcatacagtcactactcttgtgtctcagtgagggagactgggcatcaacagttgccaagacctgcctcatttctcctctgctgcaaggggagaaggaagccctgctaggagacacccaggtggactgtgagctcctctgaggcctgttcttttgtgtggtcttccttacccttcacatgctttagttttgctcaagagccagatgcagtgctcatcacgtccctgccctcactggctatggaaccaaggctgggagacatctgtatggactgcagagtcgcggtgctcccagcagcactcagcctccgctatgcatggactaacttcctttcagtcaccccctggtcagtgctcactccctcctgccacactagcttccttgccactcctcaaacaagccacacatatccccacaccaggacagtcccacagaggcctggaaccttctccctgcagatgtcataagtatccccatcctcagggcttgctccctccctccactccggtcggcttcaatgccacctgctccttcctgcccacctgcctgtcatggcacacacctcctacacctggctgatgttcctatagtcatcaccacccggcagcagatggctgcttgtgcatttgctgtcttcccccaaacactgttagctccatgaggacagactggttccttcactgctgaatcaccagcacccagcacagagcacacagcaggcagcaaaaacatcttgttgaacgaatactggagccatgttaacaagagatgaacgggatgtgatactgtgatacagtaagaaacacaaatttggtcttcatccagatttctggcacagggtttttaaaatcctgaaatctctggagtgatacgagtgtcttttgtgtgctgatgagatgactggtggctaggtcccctaggtagcttcagagcaggaactggtcaccacaaagaccaaggcatgattaaagggttgggactttcagcacccccacctgcctccttaggggaaaggagaggggctagagattgggttatcaccaaaggtcaatgatttaatcaattgtgcctctataatgaaacctccattaaaatccctaaacaacaagattcacagagcttccaggttgttgaacacatccaggtgcttggggcatggcgcccagagacacatggcatctctgtggtccctcccacatacctcaccataagcatctttcatcaggctgttcatctctatcctttgtaacatccattataatacactggtaaggtaagtaaagtgccttcttgagttctgtgagccagtctagcaaattattgaacccaaggatggggtcatgggaactcccgatttgtagcctgtaggtcaaaagtatggaaggcccagacttccagctggcatctgaattggggccagtcttgtgggactgagcccttgacctggggaatctgcattaactcagggtagatagtgtcagaattgagttcaatcattagacacctcattggtgtccagagagttggagcactggccattgatttgggaaaaaacccacacctttgagataagaattgttgtaggtaaacacagtttcatgcttgtgagtaatagtggttcagattggacaagtctgtaagtagtagctacacagcattgggtgctcggttggggaggtcattaagcagcgtgcaggagaaggtaaagacaaaatgcaccatagtcatccaggccagagatgccatggggctaacttaaggcagaaacaagagaaggagaggggggtgggagaactatttaggagataaaattggcagaactggactaaacaactggatggtggcgtggtggtgaagaggagggaggaagtagaaggatcagaggttttggttgtggcagttggaggtaccctaggagctatgaggaattcagggcaggaggtggacggggctggctgtttgctaacgattcaagcataggcctatggaatgtgaagcatctgtgacacatccctgtccggcactcaactatgtgagatgtttggctgaggttaatgaggtccttgattatcacggagcgaattaaactagcctctctctaggaattaagctttcaattctggtcttaattaataccatgctctagcaagtccaagattagataaatagcatatcatattcttctggggacaaaaaagaaaacaatcttagaagtatctcttgaatctaaactagatttgactaaaaataattttcagttaaatgccttagaccatttctaaactaaaaataattttcaaaattggtcaaccaatctataatcatcttatgcaatacagttgacccttgaacaacaaaggttagaactgcatgggtccacctatatgtggattttcttctgcctctgccacccggagacagcaagaccaacccttccacttcctcatcagcctactcaacgtgaagatgaagagctttataatgatccacttccactaaatgaatggtaaatacattttctcttccttatgattttcttaacatctcttttctctagcttatttcaagaatacagtatatgatacacctaagatacaaactatgtgatactcaactgtttatgttttcattaaggcgtctagctaacaacaggctattagttaagtttaggaggaatcacaagttgaactcggattttcaactgcatgggcgtcggtgcccctaaccccacattatgtaagggccagcagtatacagttactaggctagtatgtaaccattacagaacaatacaattgaaacacatgcattcacaagccagtattcagtgtgttacctgtcttcaatgaacatgtcataataaaatccattttcaatgggcggaccgtagcacaggtggcctccatagtaaagctccatggcctccccaagaatgtgagcactggagtgccagtacacctgcatggcatggacaaagaggccattagctaccaaaagtatgtcatggaaaattagtagtaaaatgatgtaaaccagtagaaaattttaaggagatacatggcaagaccaagggcagcaacatcaacttgaaaggaaaatcttcgatgcccacttagaagagaatgctttctgagccctccctgacattccaccggagtcacttgctcagtgccagtgtgaagctgctctgctgagtggcagctagagctcggccacaaccccatttcctctgtgcatgtcagccacgagagatgaacacctctcagaacagccagcagagcagctgtgtgcaaacctgattgaagcccagagtaggaggaaggccgaggagtgccagatgctagctgtcttctttttctccaggggcaccctctctgagctggacacagagcactgaagtgttcctgacaccactacagttaacgagatcctgcatctccagagcagtcttcgtgtgttgaatagcatgtgactgtggaagtttgaaagatgtctcaggaagaaaaaagtgttgccagggaacgtctgctggctgcctgggacgcctgagaagtgtatatatgggctcattagccacagtccagagcccggttgtcagtcctccaagttcaaaaagttgatactgttttgagttcccaaggaattcattttagtttatggataaactgaaattaaccaaagtcaccaaataaatataggtaccaaaggagtaagataatcaactcatctttcagcactttctttctttttattaaatagaaagcaagttacaattaaaaagctgtttgataaaatgaatcagggcagaaggagtcagatgatggagcactatgtgcaatcccagcccacagcaataggctgggatatgatttgcagacagacccagagggtcagtccttagggcacagcactgctcctttggatgctgctaggatggcaggctgactgctagcatcagcccaaatctcccatgtggtgcactgtccacacctacacatttgttgagccaaacactgtgctgggtatacaatagtgaaagaaacagacatagtcacagcccccacacaggtacagcctattggcgaagacacaggcaataaacaaacctggacgtgcataattctaagatgagaagggtgtttaaaaggagatgaacagggctctgtaatatagaaaaatggtgagtgtcctgcattcatggggactcgggaaggcctgtgtgactaacacgtaggggatgtgacaaagcatagcttgagaaaggttagagaggtaaggaagggccagagaccatgcaggccttggggaggagcttgcattttactccaaatgcaatgggatgcattaaagggttttaagcaaaatgattaaatttacatttacacacatcatttgatagctcgatgggaatgaatttcaggggacaaaacagcaagtaggcagtttcttgggtggttctataacaaggtgagtgcggattctcaggcagtggcaatggacagattctagatatttttaggaagtaaaatctactgggcttacccctcactggagatggagttgagggacggggaggaatcacacaaaacctccaaggttctggaatgagctattgggtatgtggtggagtaatgcactgacttaggcaaacaggaagaaataagttttggggttaaaatcgaaaatttcatggtgaatgtactgaagattcttgtacaatatctacatgcagatatcacgtagacagtagtgcataaaaactgaggcatggctagctatggctggagagttgtgaattcagtctacagtactgaactttctgaaaatcacttttaaatatggttttattaatagtgtactgtttacatatttaatggttatactttgcatattttaaacagaaattataatatggttcttatagtttaaagaaatttagcataagccttgcaattattgtaacctaagctaatcataacttaggtttcatgaagataatggacagcttgaagggcgactgcaacgttcaggcgacaacgtatatcagaaatcatatatcacatgcatatgtgaaaaatgtggtatttattttatagaaaattatattaagtatttaaaggatatctgagtcttgtaatttcttccaattctcctatacatattaaattataaagtagacccatttttaatggcctactaacaattcatttcaaacacacattgatttaataaccaaagcattctaacttaaggaaatgattattgtaagaaatgataaggctgggcacagtggctcacacctgtaatcctagcactatgggaggctgagggaggcatactgctcgagcccaggagtttgagaacagcctgggcaacatagcaaaaccctgtctctacaaaaaatatgaaaaattatctgagtgtggtggtgtgcacctgtagtcccaggtagctgggaggctgaggtgggaggatcacctgagccaggggaggttgaggctgcagtgagccgtgattgcgccactgcactccagtctgggtgacagagtaagactccatctcaaaaaaaaaaaaaaaaaaaaaaaaaagaaattataaatatgggctactttaaaaactgacatgtatttgtatacattcatgccacaaatatttattaaacatcaataatcaaattttaaatcttagaaacccccaaaaaactcaacattcgtgacttcaatatgtggcctcttatataatgtagtttacaacataactacccaaagtttggctgtctggtttttaaatactcacagcttgagcttcctcattatcaaatgtaagcagctctagagaagagtccccttccaatgggcggtccaggtcccacagttcaccattgactttggctattaccgtgctttcagccagttcctgactaagaagacaaaagccacttgggagttaactttatcactgttacaatgattccttaaaatattaaaagaatttctagggttttttttttttgaagtgtataaaaagtacaaacataaactaataggacagatatttcttgttttgcaatatttattttatgtagaaaagtaatatacattcactgtttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcgcggctaattttttgtatttttagtagagacggggtttcaccgttttagccgggatggtctcgatctcctgacctcgtgatccgcccgcctcggcctcccaaagtgctgggattacaggcgtgagccaccgcgcccagccacattcactgtttaaaaaaaacttggaaaactgagaaagcccacaagataaaataaaaatcacacataaatatcataaatcactacttataacattttggtacatttctatccagtggtttttctacctccatccaccccacgcacacatatgtgctgtctttaaaagcagctgccgacataattgtatagcttgcattttctgtcatgcctcagattgccttccaaagcagtctggaagtattgtatttattaatgaagcctccactgctgcacactgaggtcgcctaagtcttgctatcatagagtatatcacacagacatctgtacacaggcatcttgcgacttctgtgactgttttctgggaatacatccacagaattggaattactagatcaaaggggatgtaccgttgacagatttctgatgtcaattgaacgcatcacttccacgtaccccgatttttaaaatctttatcaatgtgacattgaaaattgttgttttgatttaattattagttttggttcatgcttacaagctatttttacttttatgaactatccgcttcctttgcctattttctttttttttttgagacagtctcactttgttgccaggctggagtgcagtggtgcaatcttggctcaccgcaacccctgccttctgggttcaagcgattctcctgcctcggcctcccgagtagctgggaatacaggcgcaggccaccacactcagctaacttttgtatttttagtagagatggggtttcaccatattggccaggatggtcttctagtgaggtgttgatctctttctttctgtttttttgggtatcttttaaataacatttattgtttgaaaattgttgacaaaattacaagttaagaaaggaaacctggaaagcacagaaacacacacacaaaatcacctataattctaccaccaagaaattaccattgatgttttgtttatatctttccatattaatatataggaataaaaaatatttaatagtatcataattatgtgattttataacctacttcttaaacttcacaataaatcacagcatcttccctaacaggagacagatttccaaaacgtgatatttaatagtcacagaggaaccaatatttgctaggcattttaattattttttatgggtactttgggggacgagtagcaacaaaaaacaatgctgcaatgaacattcttgaacatatatcttactcaattattttctcaggaaaaattctggaagtacaactgctaggtcaagggaaatgcattttcagtgatttctgtcagaatatattgcaaaattttcctactagcagagttacaagagtatcttgtctctgagttctcataatgttaggtactattaaattgtatcaactctacaatgtaatttttttttttttttttttgagacagggtctcactctgtcacccaggctggagtgcaaaggtgcaatgtcggctcactgcaacctctaccttccgggttcaagtgattctcctgactcaacctcccaagtagctgggattacaggcacatgccaccatgtccggctactttttgtatttgtagtagagacagggtttcaccctgttggccaggctggtctcaaactcctgaccccaagtgatctgcccaccttcacctcccaaagtgctggcattacagatgtgagccaccgtgcccagcctacaatgtaatcttttaatttacatttctgtgattaacttgagcagcagtactgcattgaggttgggggcacacaggtaagaggccaacctgagtttaaatactggacaatttactcagcttctttaggcctcagttttcttatctacaaaatagggattataggaccttcctcattcatctatactcaggattacataatgtgtacatatgataacaagaacttaataaatgttagatgttattaatcaagtagaactttcttttcatttttactggctgtcatagatggctagtgtttcgcaaaccgattctgcccttcttctccagaaggagttttccagccttccttgcagctacatgtggccatgtggccaggtttggagccaatggatagaaggagaagtcatgtgtaacacttctgtgtctcatcattaaaacagtggagggcacttctccaacctctctccaccttctgtagatgggaacccatgtgctattctttctggaccatgtagacaacggcaacattgtaccagacaaatcagcaacaagatgggagaaatctgggtccccaaaagaccgtatggagacatgtcacccagtcaacctggccacccacgtctagactgctatatgaaaaacagactttgaccatattcaagcgacttgagttttttgtgatgtctttgttgtagcagcttagtatatatcttaagtaatacagaaataaggacctggaagtaaaaatccaaaacaagtggcactggcttaacagactggcagtgagtaacaaggaaacagattctaacatatggagagccaataacctttgtgatagtatatcaaaatatttgataaaacttgcaggcaaaccatgtgtcacagtgcttgtagcacacaagaaagcaggtataaaaggggagagtagggctgggcgtggtggcttacatctgtaatcccaacattttgggaggctgctgtgggcagaccacctgaggttggaagttcgagaccagcctgactaacatggagaaacgccatccttactaaaaatacaaaattagctgggtgtggtggcgcatgcctgtaatctcaactactcgggaggctgaggcaggagaatcgcttgaaaccggagggcggaggttgtggtgagccaagatcgagaaaaggggcggggtggaggtggggggacagtgttggtataccctgggtaactcttgttgctttcagcaagaagctacaagaatgagttatctcagatgaaaacaatctagtttgccagcagaggtggaagggatagggaggctccctctgcccgtgtcctgtaattcaactgactaaaagttcagaaacgtggagctatgcaagatgggaaagacaatcttctttcccaaaccgcaggagggacaggcattgatagcccttctcaaaggccacacataaatccagacaatagaggccagtggaactgcaaggattagagagcaagagtgcctccctcccacaagcctctgcttcatatgatctcagtccattaaacaaggagacaggagtgagccgaataaaaaagccatgcaacaacagggtgagaagtctctatctagaagattctttaagtgagattactttcatgtggaacggattagctgcaaacagaccagagcctactatggctaactgatcatggtaattgtattgccaaacaaatcataagctcagctcacaaatatctgtgactatgtgatccttaagggaaccctcaggccccaaatgtgcaccacagaactgagctgtggaaactgcacagatcccaagaggacaaactcgtgcacttcagatgtgacaagtgagggtaatggacaactccgaacttcccaaagtgcaaaatcagggcccatggaggatcatgggataagacagctgcttccagagaacaaaggatgaacaggtgggctgacacaagcactaactgctgccaggctgtggggcctcaaggtggcttcaagcagaatctgatgacttctctataccactccctgctatatttctcctccttcttttttccaagcacacactttgtgattgtcttctgtgtactgtatgcacgtgtggtgtgagcagacttgtctatcagtttatttgttgctagaatacaagtggtcagcctgatggggggtgttctgtacatcactcagaaatcccaggctttgagctatggaacataagagttgtctcacttggggagtgagtgtgtcagatgttgaaagaagagtacccacagatatctggatgtcagaggggcagactgtggcagactctctgttgttccataaaccattcctctcttccatggtatgaatgctttagctggacatgtggctgggcggccaagggagctatattccaattctctcttacagctaggcatagccatgtgactaaatgtgagctaagaggatgtaagtggaaactgaagccagccactatggggtcttggcctcaaagcatcattgctctgcagcttctcttcctcctgactgcaggcaggcccatgcaaggacccagcttccaccgctagacacaaagaaaccctacctaggagacagcagatcaacaagatgggaggaagctgggtccataaataactgcatggaccagagatgtccactaggcttgactggtcacttctagacggttagcttgcattagaagcccctggagagctcataaaaacactgatggctgatcaattcagggggtttgaggtgggatccccaaatttgcttttctaacaagtttccaggtgatgcccatgctgctggtctggggactacactttgagaaatactgacccaacacatttaacatgcaacctgactctccatgagaaaacaaacttattcttgcctcaaaacctgttttctcctagcacatcattcctcctggaaaacatgaaaacaggctgggagagcatttaacaatataataggatgaatcagaaatacaatcttagccatagttttcaaagaaaatctgagaatttcagttgttgaaacagtttgctttttaaatgatgaacatttatttacatggcattaatacaattgtatagaagctatataattgtatttatacaatagcttctatacaattgtatttaatgctaagaattaacatgagtcaaaacaatataagttcactaatgtatctaatttctagaaaagtcaaagcacttttccaagactgataatagctctaaaacatttatcttcaatctatacttaaaagacctgtaaaaactcatggaaattacttgattgacgaataaagtcagtgtaaaatggcctatcaagaattacagatttttttctctcctatatatttttattagaacaggaaatgattgtgttctgatattcaactacttatttacatggcccttggagaagccagaggaaaaaaattaaatacatttaatttattcaactgaataaaaaaaaaattagctgatatggtttggctgtgtgcccatccaaacctcatcttgaactctagttcccataatccccacgttttgtggaagggacccagtgggaggtaactgaatcacaggggctgttacctccatgctgttctttgatagtgagtgcattctcatgagatctgatggttttataaggggttttccccccactttgctctgcacttctccttgccgctgccatgtgaagaaggacatgcttgcttccccttctgccacgactgtaagtttcctgaagcctccccagccctgcggaactgtgagtcaattaaatcttcttcctttataaataacccagtctcagacatgtccttttagtatcgtgagaatggagtaatatattagcggtccctaagaaaacattttcaccaggcttcagtataattacttaagattgaatatcttttccacactgcggtttacctaatttcagcagccacttggtaaggcgttgttttccagacttccccttgcactgtttgcccatcagccactcttactgtgatgatgttgcttgtatcccccttttttccataaatggcaagtaagagctgatggtctttcttcagtatttcaaaaagcttcaatctttcttttatgaaaattggttgatgcttcacctggaaattattagaacataatgagattaatatatacagcctactgttttccagctgctcagctctgaatcaggctcacccccttactgccttctcagttctacagatggtcccaagcttaccatggtttgaattacgattttgttgttgttgttgttttttggtttgttgttgttgttgctgttgttttgagatggagtcttgctttgtcgcccaggctggagtgcaggggcacgaaatcagctcactgcagcctctgtctcctaggttcaagcgattttcctgcctcggccacccgagtagctgggattacaggcacgcaccaccctgccagactaatttttgtatttgtagtagagatggggtttcgccatgttggccaggctggtctcgaactcctgacctcaaatgatttacctgccttggcctcccaaaatgctgggattacaggcgtgagtcaccgtatccagccgcaatttttcaactttagtgatgtgaaagtcatatgcattcagtagaaactgtactttgagtatccatacaaccattgtgtttttcactcagtacagtattcaataaattacatgagatattcaacacttcataataaaataggctttatgttagaggattttgcccaactgtaagctaatctaagtgttctgagcacttttaatgtaggctaggctaaactacgatgatcactagcttacgtgtattaaatacatttttaactcacattggttttattgggacataacccaactgtaagactaagagcatgtgtacttcccacctccaaaaggctcctctctgcctatctaacttctccttagctctaaaggtccacctcaaagcctgcctcctctacctattttacccgctggcatctcccttttttttttttttttcctttgagacagccccacgcccagcccccatgacacctcccttttctactgtttacagaacgtgtacagagtcacacattacagcacttacttgtataccatcgtactctgttctctagttgtttgtcctgagtctgcctgaattcctcaaccagactaacttctttgggcctaggtattccttcttcactcctaccaaatgttgatgctagataaatacttactgattgttttaatgctttatatacaaaagcaaagtagctagtttctcgaatacaaaaaaaaaaaaaagaccgggggcggtggctcacgcctgtaatcccagcactttgggaagccaaggtgggcggatcatgaggtcaggagatcgagatcctcctggctaacacggtgaaaccccatctctactaaaaaaaaaaaaaaaaaaaaaaaaaaattagccgggcttggtggcatgcacctgtagtcccagctactcaggaggctgaggcaggagaatcgcttgaacctgggaggtggaggctgcagtaaccgagatcatgccattgcactctagcctgggcaacaagagcaaacctccgccttcaaaaaacaaaaaaaaaccaaccaaacaaaaaaaaccaactctagtactctagtagcacaacttaaatagattaaatacacgtgtttattaaacatgggcagctcatttctcaagacatctcatatttaaggcttgaaaagttttaaatacactaatgtgacccaaataataatttaatcagtaatttttattggaaatcctaggtaattaactatatacacatatttaaaattacaggtagtattttatattgtttccacagcaacaacttacctcgctgtcagcctcgctttccttcattttcttctttttcatgtccttgtcttggctttgactaggaggaggctgaaagataaattataaatgactcacatcaatggcaagaaaaagcaacacattttaagaagagagtcatgccagcaggctgcaagtgccccgtgtttagaggctcatagctgggctctcctgaccaccagctacagctctcagtgggcaagtcattctccagggttcagtccttcctgtcacactgttgctaagcacatttaatatattgtgctcttgaaaaccttttgtcctgaactttaaacaaataatgtggctggaaaatgtgtggttgctgcccgccacatcaaatgcactatttcctgaagatgttgctagttcaccgcagctgtccttcctaaaggactgcagaacatctcagcctgagaagcttcaggactcagaaagtatgatgttaaaagaagataatttatcctttctacaaatcataaaatactgtattaaataaaaatgttaaatatacagctatcctctcaagatgaaccaccaaaacaagagcacaaaaagcgaaaacttctcgtccaaaaaaaacccaacaacaaaaaagaaccagagggaatgagagtttacatacgcagctgttagtctttctgaccaaggaaagaatgagttttaaacactccagcattttttcaaacaaatgaaaacactatttctgctactgaaaaagatgcgtggcaggctctttaatggacgaattgagaaatcaacagcatttggttaagtctggcgactgctggaaatccggcggctccccaggccacacgggaccaccgagcagggcagggcgggccagccgcagggcactgggagggcactcccccggggcgcccccgcacctgcccccgcagttgaaaacctttcggtgcgcaccgtctcggcccgccccgcccgcgtcctctccagtgtccccaccgcccggttacctgtgcgccggcctcctgcgccgcctctagctccgcgctctccagcgtggcctggcggctccgctcctcggcgaggcacagccgcaggctgcacaggcggtggcgcaggtcgcagttctcggcccggagctgcgccacctcccgcgtgaggcacggcccctccgcctggcagctgtagggcgcgttcagctgctcgtccctcaggcgctcgacctccgaccacagccagcggatgtcctcctcctgccgctccaggcgcgacgccacggcctccgccgccagggcctcggccgccatcgcggcctccctcaggcaccgacgccgagcggggtgcccgcgactgcggcgaggg

SEQ ID NO: 1550 - DNA, 10546 bp, Homo sapiens
tatttcttaacttgcaattttattaatttttcagtactcttaccttttatatactactaagaaaatttaaaccataactagacataaacattctgcagtttaattcaaattttcatatatacagaccagactacatatgtattacactgcaaaacttacacatgactgaagctgagcctaataacttcaattagccaacaacagaaacactcccacttcctgcagtcacagcaattagctaacaataaaaacactcccacttcctgcagtcacagctgaaagacttttcaaggcagactacatttgggctggagatacaagtgatgtagtttgacttgggcaatacaaaacaaaagtcataggaattaaatggattttcaatcactgtataattcattctcctggcttaagtacgttttaattttttcacagaaaaaaatatatttcaggcaaataaaaacaaattccagattagcatagttcagcgtttcatttatcttacctttatcaaggcaaacaaagtacagatgctgtacattaaaaacatagaaatatatcactcacaccacatcaactcctacggacaaaagggctttttctaagccctgctcctttctgaagcacacaccacagctaaatgtacaaagagccatctgctggtccaacatagccaactccaatgagcaggacgtctatcagcgtccatattcccaggccaccgaagctgaagagcttgccgaggccttcccgccactggcccaggtagaaacggtctgctccaaacccaccgagggtgatgctgcgatggcaaacagacaggattccatgagaccacctccaccccagctgtggccagtcacggtttaatcaccacattatgtcagatttgagaaagggcttcccctgatcgtagcccttaactggaacacaagtgactatttcacaaactgacaccaccaaataattacgggcaggaagacagtttaaatgtcaaaagtaaacatacaatttttagctgtactaaaaaaccaatgttttctttttttaaagttatcaatctcattgctttttagtcaaaataaagcaaagacccagtctaacaggaagtgcactaacacggggtcagggctggagtcaggaggagctcaccaccacctggacgacctggatcaagtcatccatgttttcagtctattttttcattcatctctaaaatcttaatgttaggaataaatccttaaaagatttaaggatcttttaaattctaagatctaataatactgaaactatattatggaaaatttctaaacacctaacaataaaaagtaaagagaacagtacccatgactcagctccaataatcaacacttggccagctgtgtttcatcaaaaccctcctctttcccctccagagtaccctgaagcaaaccttgggcatcatctcattacagtgatgattttaaaagaaaccatgttgccgggcgcggtggctcacgcctgtcatcccagcactctgggaggctgaggcaggcggatcacaaggtcaggagatccagaccatcctggctaacacggtgaaaccctgtctctattaaaaatacaaaaaattagccaggcgtggtggcgggcgcctgtagtcccagctgctcgggaggctgaggcaggagaatggcgtgaacctgggaggtggagcttgcagtaagccgagattgagccactgcactccagcctgggtgacagagagagactccgttaaaaaaaaaaaaaaaaaaaaaaagcaaaaaaaaaaaaaaaccatgttgagtgctgagaagttttaattgttgaaagtatgttacagtatagtactgtaagaggttaacaatgtagggaaaccaggttaggggtatataagaactctactatctttgcaacttttctgtaaattaaaattattccaagtttcaaacatttatttatttttttaaaaagccagttgttaatttgaaccattgtcagcaatggttactaatctttttttttgagacagaatctcactctgtcactgaggctggagtgcagtggtgcaatgccagctcactgcagcctcctcctcctgggctcaagtgatcttcccattgcagcctaccacgcagctggaaccacagacatgaaccacgatggcaggcttttgtatttttggtagagatggggtttcaccatgttggccaggctggtcttgaactcctgacctcaagcaatccgccagcctcggcctcccaaagcgctgggattacaggtgtgagccatcgcgcccgccctatcttatttttgttagtctcattttctatcctggcaccctcttttacttttcagttacacttttcctgccaggcaagatccttctttcctcagctcaaattctaatgcagtggttctcagcaaggggcaattttgtcccctaggggacacctggcaacatctggagacacactgtcacagctgcaagggatggggggtttgctactgacaagtagtaggtagaggccagtgatgctgctcaacaccctgctatgcacagcacagccccaagacaaaaactcattcagcccagaacgtcagcagtgatgaggctgagaaatcctgccctatggctgcaatgctgcaggcctcagggtctcaggcacgaactcaaaacttcaagtgtaggcagcgtaaccttttcactaatcagttaaccagggtcttacctgcccttccctttggtgggaagaactgctataatttcttaaagtactgttgagaagtttaacaaacagcacatttctatgtaagaaatataagcctataattatctgctgctgatgaaattataggtaatttttaatgtttttgtcattttcatttttccagttttcagtgttcatcatgtattactttttataatagttacttaaaattaaagatatacatcataaaactgcctattttggatagtccacagcattttactgattcgtggtacattcagaatggtaaacgtaatgtgcaggcatcttgggagaaaagctaacatgcctgccagtcaactccacggaggtactggtctgatcatctaaactcttccagctgtttgctagagtctaacacacgtggtaggatctgagtgaagaatgaaggggactgagctcaatgtctgaagattccaccaatcccaaagaaatgcaaacggccttttacacttacgagtaacaaggcttaccttagagccagagccgtagaccacttatagcctccagtccaattgcaatatagcattttgggaaaagtacggttaccttaaaaaaaaaaaagaaagaaaaatacagggtataaaaaatactctcagaaagacttaattgtaacaaatgggctcaaaatttaaaatgtgaaaagtcaactctctttacggtaatacatgttgaagtgaagagtacaaagcgcttaccatctatctacatagatgtaatatttaaatcagctaagttaggattacaacgtgaggaacatgaaatgctcacccacatatcaagacctacggggaagttacgagtatataagacagtgtagtcttgaggcataaaaatcacccaataggaaaagaagagaaagtcaagaaccagaaatatacaaacacttcatgtatgagtgttatgacagaggtcacacacggatcaacagggaagagttgagacaactggccatccatgtggggggacaattaaagtagaatctacctcacaccatctaccaggaccaattccaggtggattctaaacctaaatgtgaaatgttatacttacaactttcaaaagaaaatgtagcaaattgtctttattaacctggggtagaaaaagatttcttaaaaccaccacaaaaaaggactaactctaataacttccagtaattatatttttaaagttctgttcatgaaaatatacaataatgcaaaaaaaaaaaaaatcaaaatctgggagagggtttcagggacagcacaggtaatatccaaaatataaaagaagtctagacaactttaagaccaaatttaagaataaccactcttggagagaatatggctcatcaggaacagttacatagcgcgggtgggaatgccagtcaatacagccatttaaagaatgacacacgctggaaagtacatgctgaagaagctcttgcacctgtgccattgggagacaggcaaagaaatttgaacagtcacaacagcggaaaacagcacttaaccaaatatattggagaataaactgtgatacaatcttacaatagattattacacagaagtaaaaaaaagaagagaagtcacgtggatgaatcctagagccacaatgtttaggaaataagcaagtcccagaagagcacacagcctgaaatcattttacacggttctaaaacatgcattattgaatattattttattacatatagacaataaaactacagaaaaaatttaaaaggaagtgaaataaaaaattcaaaagggtggttaccttggaagaggaggaaaggcaaccaggtgaaggcaagcactcaggcactcaggcggccgcaatggtattggtgctgctttcattgttattttgggtaaaggtcaattactgtgtattatgctttatacttcaaatgtttttcttattttatcaaatattacatttaaaaagaactgcaattttctggatgctttactttagtacgttgagtttattgatgatgcttggcacatctaaagagctgctgataaatgtttctaattaagtaacttgactcgcaaatttctggttaaagtcccttcaataaacttggagaaaaacattttgttgacaaatgtccttgaactctgacctacccaagcagtggacgtggtcccgcaccgtgcagttggcagggtagcgctgccgaggacaggacaccgtcatgcagctggtggagttggtacactcgtaatctgtttcaggaagctgccagcaaaatctgcaagtcatgttaatgatgaagttcttttgggatttgaagtcttgatcctatgtagcaaatgacacaaaactcatcaatcacaatggtgtagtctgttaagatgtcagtaagactacacagtcacatggcacaaaattccgtaaatgcttgtatttaggacctaggagtaagtgccagaaaaacagttaccaaaacaatatgtatgtaaaacaaatgcctatgatgtgacctcataatcataaaactacacacccaaacatatgtacttaagggaaaaaactagataaattcacatcaaaatagcaaaggttatttcagggtgatataattatttcataacttttgcttagctaaatttttcatagtaaacgtatacttttataatgcagaaaagaggaaaatttattttagaaagtcacaatcacggatggctggaaggaactgatgaatgcatttgttgaaggtcactgagcttcaagtgaggagtggaatccaggtccctgaactccagcctgatgcttctgtaatggttaacacaccgccttgcttccgagttgccaaccttccctaacatcccctaccttgcacagcctggcaactcagggttgttacagctgctcctaccaccagggcatgtggcatgtttaatccagaggcagcccaactcagaagcaccacatggtgtgtggaggctcagtgagtgttcactggtggccagagaatttttcatttcaattttaaaagccattattttgtattctgcttacaaaagtagaatgttctttgtatgttacatatttgaagattatagacaaaaacctataggtgttcagagctaaccacttttaatcttctttccgtttcttctacatgtatatttataaatttactaaaatggaattatactgaaagcactttgtagtctttttactctacctgacattacattgcagtgcatatttttcaaaatcatttttatgtggtcacacatctctggaagcatcatgtatatatatgtatacatatatatacacatacacacattatttttttttctttttttgagatggagtctcgctctgtcgcccaggctggaatgcggtggtgcaatctcggctcacttcaacctccgcctcccaggttcaagcgattctcctgcctcagcctcctgagtagctgggattagagacgcaccccaccacgcccagctaatttttgtatttttagtacagatggggtttcaccatgttggccaggctggtctcaacctctgacctcaggtgattcacctgcctcggcctgccaaagtgctgggattacaggtgtaggccaccacgcccggcccatgtttgttattttttttaacatttcacaaatttgcatgtcatttttgcagaagagccatcctaattctctctgtatggttccaactttggcatatgcgctgatgaagcaagtactattcattttcttatcaatgcaaaaaccactttttatggaaaacattcaaatatgggtaaggcatcacttgatttaggcaaacagttggatctgcaaaataatacgtttacatctgcctattttcagtgatgtgcttaaaacacactttttttaatggttttttaaaaagtaggtgacacatgtacatggaacacatgtcaagacacaacaggagagtgagaagtgagccggcctcgtctggcccagccgccgggagcccctgccctccccaggccaagtacgctctgtgcttccagagagagctgattctacacataggcacatttatgtcacctacatttaatgttccccaatactttcacttaattttggacatctatcagtacattacctctagagctgcctagttctttttaatggctacaaggtgtttattctattacacgtgtaccataaattaagcagttcttagacatttcacttcttttgaatcttttgctttaatgagcaatgcagctaaaaaataagcacacttatctgcatccatgtataatgatatctataacataaattcctacatgtacaactacgagctcaacgattgtgtgcatgtgtaagtttaacagatatggcaaatcgcctacaagaggttgatcaatttgattacctattaataagatatgagcatctgacccttatactctcacaaactcagagttaatcaaattaaaaaaaaattgccaatctaagggttaaaaatgtattaattaaatactatgagaaaacttatatgtttttcatgttatatatctatttgtatttcctttcctatgaaccatctgctcatgtcctaacactgtttttctacaagactgtcatcttttccgtgtgggttttaggaagtgtttatatattactgatattactgtattatttgtcacatattctagaaacgctttttcctagtttgccatgtcttttgcctttatgcttttttttttaggtcatgcagaaatctccaatttttaggagtcaaatgtatcaattctttattttatggcttctaaactttatttcatacttagaaaaatattctccattttgggattataacagcaactatctggtgttttctgtggtacttcagggtttcatttttcacattacatctttggactatctggaatttattctggataagacaggcgttccacttaattttgttctagagagctaccaggcattccggcatttactgaatccatcttctcaccacagataagcactggcccttcaaaagctcatctatggcagaaagacactgccaccccctctgtacactagctgtcactattgagaacacagaatccatctgaacgaattagacttgcttcagatatgctagtagactgagatcttctccagtcctacaaagcaacatttctgtcaagtgcatttccagcagacatcaactggcttgacagttatcattataactaaaacagtagtgagctgatatggaaaggtctattgggttttttaatttatttctgcttacatactcaaaagggaaatcataaaagaatataaaaattcttcagaatttcttcccaataatcaagtctgaattgttcttctaacttaaagtttacaatgaatttatttagaataagtaagctgcagtacttacaacacaggtaacagatggtttcactgcacagtcaaaagtgacaggcttcccataggtacaggagaaatttgttgtgcagtctatacagtctgcaggaagcctgctacacaaaccattgctcggacacttcatcacataaggtgggatttcagtactttctgtgagaggcaagagagaagcttattctcctataatactgattcgaataacagagaacaatcttctaaggttaagagacgtgatcattagcaagtagacactgcactggaagggaagaagcatgggactggagtcagagacacctgcaattaaagcagaattctgcccacggccagctgtgggacctggtgagcaccacacttgtaaaacattacttcattcctgcctcccacgtggccgtgaaaactaaaggtgctcatatacaaataatgtatagaaaattctgggtatacattaagggcttaaaaaaaagactatcattttgtaagttgaaaaaaaacttacagtagggttttgcaaaatcacagaggaagtctgtggcaaaactggaactagaacccaaatctctccatttccaatcccgtgttcttttcatctgaattcactaattcagaaatgaagccactgacatcctcagggcatcaactttaaaatgtcattatttcacactggtacttcgataagccacatttgctaatataatatttacagttttacgctaccaaagttcaaaacagttctctactttaataacatcttcagtaagctgcaacttatttccaaccaacctaatgagtgtgcaatgtatttttaccaactgaaaggatcaaaattgcaagtattcctgaaaagaagggctttcaaaagcctgcaagagttaagaactcttgtgctttctctaaaaagtaatctgagtttaaaattcaagtgcactgctgttttttacatccaaataagaatcagtaaaatatctctgccagtttcaattcactgaagtaatgtcactttaaagtgatgaaattatagtcagagcctccacctagcaaaacacactaatgcttgtttaaaactggtcctactttactcactgtattaaggaacaattctacaaaatactctttttgatcccgtgactatgtggctggaaggtggacacttagaatcacaaagcagaaatgactttaggtcgtcagaccaaccccaccgctttaaagatgaggaccaaggtccaaagaggataaataatttgttcaagatcccagtagcaaaaccagatctagatttcaagtctccatcagtcccgctgtaatccttccatttccacagtcctgagggagcctttaatattccaacatcaggaacagggttttagcagtagaggaaatttgctgaagggaaagaagcacggactgaaggttattttgatggatgaagtggaaaaataatagaaataaggtgacaaatgagcgtgggattggaaaaagagaggaggcagaaacgtcaaaaggtataaatacgaagactatctactgaaaatggctgtgtatctacccttaattcacataatctaaaatacaataaatattcaaaaatggaaagtgacttcgtatactaaagggaatttttataaaaacaaagagaaactactagagataactacatgtatttactagaatagaaaacgtctagtacctgctgccctgggaactactgtgaatgtgcgtgttgggcccggatcctttattgactgagccagcgcctgcgattgctctaaatttaaggatcgtacaattagagaaacacgttatcccgggacaagaaaaccttattttgtgtggttaacacggcgggtctacaccaggccaataagctgctcatgaaaacctcacggctggtcagccagaaaacacaaagcttagggacgaaacgtcaacagagtagacatcagttcaggtcagccggcaacgagggaccgaaggatgacatcgcgctccagttccgcctccccggcccagcccccaagcgctccatctccgtgccagggctccgcagccgcgatggcgggctcggtgtcgccggagcggaggggcggcctcgggccgggcggccagggcgccagactccagatgcagcgacaagcggcccggagcccggcactcggcctcctccccgcgtcagcgtccgcccgtgggcccggcctcctcgcagctcccggggccctgctgccactcagccccacccggcgctgaacccagcctttgactcaccaccgcccgacagaatgcagaactgcgagaggaagagcagcacgcgacacaaggcgcggaggcccctcagcgggagcacccctcccgccatcttgccagcgcctgcgcacttccgggccgg

SEQ ID NO: 1551 - DNA, 10546 bp, Homo sapiens; identical to SEQ ID NO: 1550

SEQ ID NO: 1552 - DNA, 27038 bp, Homo sapiens
ctgggacccacgacgacagaaggcgccgatggccgcgcctgctgagccctgcgcggggcagggggtgagtgccccccatcgcgccccactctccttttccaggcttggtttggctgcagatctctcgggctgcgatactggggagaggagagacccccaaattcctggacccgggaagcgaggagacttactccggccccctcactgcagcgggttggatttctttcaccaagccagccgccgagagcccagctctatttaaggggccaccagacctcccagctactagaggctttgacccttctttgcataaagctagtgggtcccccaagccctcctacccccggagagcccttacctctctggtttctttttccattgctcttagcaaaggactccagggagtggagttcatggagtgggggtgggggttgcaaactgccagcatttcgagggccagggagttgaagcaataaactggcaatgaactgagggctttctctgtgcctagccttgtgcccaaccttgtgccatgctgctatgaactttgctgctattcatccatttaatacaactcatagaggtagagtctcgttatcccccttttgcagggaaggaaactgagatacagagaggttaaagtttgcacagccagtgagttgtgaaaccaggaggagtaaaaagacagcggagagagaattgaagaggccacgtccactaaacttcaaatttcttctagggttagataggaccagcagacctgctgagatgaaaataacagatcaagctgggccggtggctcttgcctgtaatcccagtacctaggaggctgaggcaggaggattgcttgaggccaggagttcgagaccagcatagagagacccccatctctacaaaacataaaaaaaaaattagccaggcctggtgaggcggcttatgcctgtaatcccagcactctgggaggccgaggtgggaggattgcttgagcccaggaaattcgaagctttgttaagctttgattgtgccacttcagcctgggcaacagagtgagaccctgtctctaaaacataaattaattaataataaaaaataaaaataaatcatacatcaagaccaccagtcgaacgaggtttggggtcagataagcctgggtcagagtcagctttgccacttcccatttgtgtgtccctgggggaggcatttccccgattggtgcctcagtctgctggtttctgaaatggagacagtactgtctgcgtcctggagttgttataaggattaactgacagtccatgcctagcaatgattatggagcccaggtctcctagaccacatggcccagttccctgggttcaaatcccagcccttccactcctcagctgggtaaactcagcaaagttactcaacctctctggtcctcagcttcttcatctgcaaatcaatataattgcaactacctagggttaatgtcaggatgaaaggaattgagaattagtaggtattccaaagagtgcttggcacatttttgtgtaaatgttaaagatccaaaaagttgcctggccccccgggcaggtgagctggggacccctgccttgtaccatcctaagggtcctctttgtgttccctcaggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgttccccactcttcaaagccaagatggtagctgccatccctgggagcctggaaccaggcaatggtggggggaggcaggggacaggctggaacctggtgaagtcttaaagtagactcctcctatcggggtgtagaagggaatctgttaatcaaacagagcaatattagaaaggctacagaggtcaattcagtggaacacggttctcccaaacagattttgtaattccgaaaatccacgcatgcgcaaacatacgcatacactcccatgttcctggacagtttatagctaccataacctggcattttccaaaacataccatgtagactcttggatacacaaggtaattttagggccacattaggatgaaccttttaaaaagttatgcatttatttttatgttcccccactggctgtattataggacaatttttatatgtgatatgtatttaccttagtgtgttaaataaacactggcattccaagtgtgagcctttctgctcatccatcctcttctactccattcttgtaggcttccaaagaatgttcttcagagttcattcattcttctgccattgtattaatttttatattatcacccgccaccaacccaggggttggcaaacttaaagagccaagcggtacacagtatttgagactttgtgagccaggtaatcttccttccgaacactgaactctgccattccagaatgaacgcaatagtcataaccatagacaatagtcatgactgtgttacttttttgttttgttttgtttttgagatgcagttttgctcttgttacccaggctggagtgcaatggtgcgatctcggctcactgcaacctccgcctcctgggttcaagtgattctcctgcctcagcttcccgagtagctgggattacaggtgcccacccccacacctcgctatttttttgtatctttagtagaaacagggtttcgccatgttggccaggctggtctccaactcctgacctcaggtgatctgcctgccttggcctgccaaagtgctgggattacaggtgtgagccaccacccccggccgactgtgtttcaataaaactttatttgtagtcactgaaatttggatttcatgtaattttcacctgtcatgacatatgctttttgtttttctttgatgattgatagtttgccaacttctgctttaaactgaggttctttgagcagttcctccaacgtaacctagctctggccttccctctggtgtgcccacgttctctcattttcttcctttcttttattcaatagagaaaccaaaatatattagagagaccctagagacttactggcccaacagagagttgcttcttgatttcatagcaaggattgaaaaatgacttggagaaaggatagttttttacctggtgagtacatttcatttcctgctgtttctccatacccagagtcatctcatatgtgcacgattggagcacttcctgcattttggaaaacattcggttggctcaagcccttcctgtgcattatttatatgacagttacaggtcaggagtgatctgcaatgccctttacacattgttcacattggcacgtttctagctggtgaccctggtatactcagtatcagccaggatgctgcagaaccagctcccagttggacatggggccgcctaccagtttgctgtgacctctcttattgccccccaagcttatctaagcctgtatcctcaggtgcttggattcgccctcatagtcctgtgtacctccagcgtggctgtcgctctttggaaaatccaacagggaacgcctgaggccccagaattcctcattcatcctactgtgtggctcaccacgatggtaatgatgccctcagtctggagcccggcttcctcccagctgctgctttgcctgccacagtggagaacaaggggaagagaagaggctcccctcagcctcccaccctcccctaaggggcctccctgactttcccgtccagagcttcgcagtgttcctgattcacaccaagaggaaaaagggagtccagtcatctggagtgctgtttggttactggcttctctgctttgtcttgccagctaccaacgctgcccagcaggcctccggagcggtaagtcggggcgtgggccaccctgggaaaccaaaatggtggttcatgccttgggtcccttcctttctcctcctgtttccacatacaacttattctctatacagtgacacacacaagccagtcacttacactctagagacacaaaatccactcccgcacctgtcagtacccatcatcccatacatttcttatccacacaatttcctgtcttacacgcccacatcacacgtgccacttgctcacgatgcacacacttataggcactgattcatacatcgcacaagtacatgcatgcacgcacacacacacaacctgggcacagacacacctgtgtgcacacatacccctccgtgcacacctcccctcatgtcatggattcaccctccccatgttcctatgcacctatatttacacactcattctgcacaccactcgtatttctgttgtccaatctgggaagcagctttttttttttttttttttttttttttgagaggcttgctctgtcgcccagactggaatgaagtggcatgatctcagctcactgcaatttctgcctctcgggttcaagcacttctcctgcctctgcttcctgtgtagctgggattacaggtgtgtgccactacacctggcttattctaaatttctactaaaaatttttgtatttttagtagagacgaggtttcaccatgttggccaggctggtctcgagctcctgacctcaagtgatccacctgccttggcctcccaaagtgtcgggattacaggcgtgagctcttgtcattcggccggaagcagcgtttctctattaggagacatgatgggtcattttctctgtaaagagaaaaacatgtagcctagaccagcttccctcagcctcagctttagtaatgttgtggccagacaattctttgttgggtggacagggctgtcttgtttgctgcagggtgtgaaacagcatccctggcttctgcccataggtgccagtagcataccatccaattgcagtaacccaaaatgtctctagatattaccaagtgtccctgggggtgaggaggacaaagtcacccacctattgagaagcactggcctcgacagtgtgcttagccaaggcttctgggagagggagttagcttaacaccaatgaataggctgcagcaggtttcagatattttacttcattattttatttttgtggagacaacatcatgctttgttgcccaggctgatcttgaactcctgggctcgagcaattctctgacctcagcctcctaaaatgctgggattagaggcatgagccaccacgtctggactcacagatcatttcttcagtccagtggttactccatcctgctcctaaaggagaaggtagagaagcatcaccctgtccttaaggacagagtttttattttttgtttgttcattctgagacagagtcttgctctattgcccaggctggagtgcagtggcacgatcttggctcactacaacctccacctcccgggttcaatcgattcccatacctcagcctcccaagtagctgggattacaggcatgtgccaccatgcccagctaatttttgtatttttagtagagacaaggtttcaatatgttggccaggctcatctcaaatgcctgacctcaagtgactcacccacctcggcctcccaaagtgctgggattacaggcatgagccacagcgcctgaccaaggacagagtttttaaaagagtaacctttgtaactaaggggaaattccacaggttattcagtaatttctgaaatggtgggctcccgcagttgacataagtcagctttttgggacacagcatagaaacaataatactgggaccatatacactctggggttccaaccatgtgccaggcactgtggcaggcacttacacacgtctcctcactggattctcacaagagttcacagtgatgggttcttctttatttttttaaatagaaatagaaacaaagtctcattatgttcccaaggctggtctcaaactcctgggctcaagcgatctttccacctaagcctcccaaagtgctgggattacaggcttgagccaatgtgccccagccaatgatgaattccagccgtcccattttaaagatgagggagactaaggctaggagaagggaatgacggcctcagggccacaaagcttgggagtgcagagcccgagttcatctcaggcaaattcagaacaaactttctgagagaaacagtggggaaaacagtgggagtttagggaagatgggccatattgtcattggaatatccaattgtctgctatctgccaaaaaacaaacaaacaaacaaaaaccccaaaactagaagagtataaaatccagtagaggaatcgtgatttaaaactagggctctggtttaaagccataaaacctcagttcacactagcttaatgaaaagggaaagtcaagggggttcattagctcatgcatttattagctcatacccatgggatctcccaggcatgactgatccaggcctgggaccaggtaccatcaccagatctccacttctgcctcttggctctgccatgttagcttgattctccaatggagtggcaagaagagccaccaataccttcatacttacattctagcatgtagcaaagccagcagaatctcccgatggttccagctctcaagtacccagcattgggtgctatgtgcattcctaaccctgccatggtagccaaaagactcgaatgtattcattggccaggcctcattcacccacccagcctcggagtagggtcagttctacacaaatcacacgcctgaacacaagcaaaaaacttaggaagaaagaaaatcagtacatggaagagatctctgcactcccatgattattacagcactgttcacaataaacaagatttggaagcaacctaagtgtccatcaacagattaactgataaagaaaatgtggtatatatacacaatggagtactatgcagccataaaaaagaatgaggtactgtcattttcaacaacatggatgttaagcaaaataagccaggcagagaaagacaaactttacatattctcacttatttgtgaaagctaaaaattaaaacaatgtaactcatgaacatatagagtagatggaaggttactagaggctaggaaggaaagtgggtgggggaaatgggggtggttaatgggtacaaaaaaacagaaagaataatatctatttgatagcacaacagggtaactatagtcaataataatttgattgtacattttaaaatatctaaaagaggctggacacagtggctcacacctgtaattccagcactttgggaggccaaggcaggaggatcatctgaggtcaggagttcaagaccagcgtgggcaacatggtgaaaccctgtctctactaaaaatacaaaaaaagtagccaggcgtgctggcacacatctgtaatctcagatactcaggaggctaaggcaggagaatcacttgaatccaggagatggaggttgcagtgagccaaaatcaagccactgcactccagcctgggcaacagagtgagactccaactcaataataaactaaaaaataaaataactgaaagagtagaatggatcatttgtaacagaaaggataaatgattgcggggatggagacctctttaccttgatgtgattattatgcattgcatgcctgtatcaaaatatctcacgtcatctagaaatatatatagcaggccgggcgcagtggctcatgcctgtaatcccagcactttgggaggccaaggcaggcggatcacctgaggtcaggagttcaagaccagcctggcctacatggtaaaactccatctctactaaaaatacaaaaattagccaggggtcgtggcacatgcctgtaatcccagctactcaggaggctgaggcaggagaatcgcttgaacccaggaggcggagggtgcagtgagccaagatcatgccactgcacatcagcctgggtgacaaagcaagactccgtctcaaaaaaaaaaaaagtatacacacacacacacacacacctaaaattaaaaaataaaaaatgttttaaattaaaaaaagaaagaaaattagggtgtttctgaccagatgacagggcagaaggtgcaaaaatcattgtggtgtggcagcaggagcatcacaatttggaccagatcatctgcgtgtccttgaacaaggtgctgtcacttctctgagccttgttttccccatgagtcaaaggaagcaagtaaactccagctgatgagactgtgtatggcaagaatgccgcatgtgcccagggcagggtcagtgctcaataaaaccagctctcacctctgcaaaacagagaaccctggccaagggggagcagggttgaagattagggtagagggtggaatggagaaaggatttcttttgtggcacaaagaagaaggtaaattgtttcttcatctcattgtcccagcagctgtggccaatcatcacgtggctaaggacaaaacccagacacagccctggcccaccatttgtacagacagaatattataaattgggtatttgaaaattaggacctgctgggcgtggtggctcatgcgtgtaatcccaacactttgggaggccaaggcaggcagatcactttaggtcagcagtttgaggccagcctggccaacatggcaaaaccccatctctactaaaaatattttttaaaaacattagccaggcatggtggtgggcaccggtaatcccaactactaaggaggcagaagcaggagaatcacttgaacccaggaggcagaggttgcagggagccgagatcataccactgcacttcagcccgggcgaccaagtgagactttgtctttaaaaaaaaaaaagaaagaaaattagaaccgctaggaaagccagggctctggctttcaaatactcttgccctggtccccagagtgggcactgaccccagatcagaaaccttttctctcctctgagcaccctcctctgtctccattccttaccttctgctttccctcccacagggcttccagagcgaccctgtccgccacctgtccacctacctatgcctgtctctggtggtggcacagtttgtgctgtcctgcctggcggatcaaccccccttcttccctgaagacccccagcagtctgtaagtcaccaagttccaacctcattcctgttccactttgaggtctcagtctcccccaggtgaccaaaagtctttaatttttttattcatttagccattcagcaaaaagtgtatcgcatttctactcgatgccacagttggcagactttttctatatgggccaagagaaaatattttggactctgtgagccatacagtgatctcagtggcaactactcaactctgccattgaacgcaaaagcagaatatgtcaacaaattgcatggctgtgttgcaataacactatttgcagaaacaggcagtgggccagatttggtcatagtttgccaaaccccgctatgccctagcaagggcataaggatctatggtgaacaagcagatagagtttctgttctcacgtagctactggtcaagcaggggaaccagacactggtcacaaaattaaacaaatatgttgaaaattggatggtcacagtggctcatgcctgtaatcccaacactttgggaggccaaggcaggtggatcacttgaggtcgagagttcaaagccagcctggccaacatggtaaagcctcatctcttctaaaattacaaaaattagccaggcatggtggtgcacgcctgtaatcccagctactcgggaggctgaggcaggagaattgcttgaatccgggatgtggaggttgcagggagccgagactgtgcatttgcactccagcctgggcaacaagagcgaaattccaccaaaaaaaaaaaaaaagaaggaaaaagaaaattacccttggcgtaagtgctccatagaagaagctcatgagagattgagagatttacaataggtaacactgaagcagtctgtgaaatcaagaaacaattcttttgtggaagagactgatctgacatcatataaacagatgttcaaatggggccagatgcagtggatcatgcctgtaatctcaacactttgggagaccgaggaaggaggattgtttgtgcccaggtgttctagatcagactaggcaatgtagtgagaccccatctctacaaaaaggtttttaaaaatagccaagtgtggtggtgcatgcctgtagtcccactacagagtagctctgtggagactaaagcaggaggattgcttgaatccaagagataaaggctgcagtgagctatgattgcaccattgcactccagcctgggtgatagagcgagaccctgtattcaaaaaaaaaaaaaaaaaattgctcgaaggcttgagaatagttaaaactatcataggaatcttttttgtacctaccagagtaggaacaaaatttaaaaattgataagctgcgatggcaaaaacgtggtgaaatgggcaccttcacgccttattggtaaagagtacagactgttgtaatcttcctggagcacctgacaaaaatcgcacgacaggtctgtcttcacaacatttgccgagggatattgtcaaggatctaatttcttcgttatgcagtgtccttccttttgagaagcaaagcaaggttttggtttcagtataatcatagttgttcttctgagccactgttagttcttaccttgtggacattgtcaggcctgtggcccaacctctttttacgctgcctgctgggaagcaccaagctcactggtctacacccctggcaaggagacagggcacctcgatgtttactttcagtactaaatacaccgtcagggctgggtgtagtggctcacgcctgtaatcccagcactttgggaggccgagataggcagatcacttgaggttaggagtttgagaccagcctggccaacatggtgaaaccctgtctctactaaaaacacaaaaaattagctgtgtgtggtggcgcacacctgtcatcccagctctttggaaggctgaggcaggagaatcgcttgaacccaggaggcagaggtagtagtgagccaagatcacaccgctgtactctggcctgggcaacagagtgaaaccctgtctcgaaaaaaaaaaaaatacacagttcgtcctgtcttcctacccttgccacatacttcccttctccatttttgtctgttgcagaacccctgtccagagactggggcagccttcccctccaaagccacgttctggtgggtttctgggtaagtaaagtcgcacggaagggttggggtggtgcctcacccgcctgcatttgctgctctgattcccagccatggcccttcccctgtgcttacaaaggccagcaagtctttctccatcccagcctcagtgctttcttcttcgtgttcagtgtctaccatctgcatcctgttcccattcactcactggagtgagatcttgatttgaatcccggctctgcctgttagcaggccatgtcgcaaacctccggagtctcagttttccctctgtaaaatggggatgactcaacctgcatgagacggaaagtgcttagtgcttgcacacagcgggtgcttaatagtaatagaattgtctccaatacttgatttcagtcattccaccaacatttaataggcacctactatgtgctaagccccaggggtgaggagataaaggagcaagtgtctactttctagagggttccaggcagattgagaaaatagctgcttctccagggccagctcacaaggcatttgaggatgtgctccctcccaaccacacggcattcagacctcagtagcacctgacatgtggatttgaatcctggccctaccacttcctagctgtgttgctttggacaagttacttaacctctctgtgcctcagtctccactccttcaaaatgggattaataatagcacttagcttatagggttgtgaagcttaaataagataagatctgtaaagcacttagaacagggcctggcaaataatgagtgtaagtggtaattatttttttttcttttgagatggagttccactcttgttgcccaggctggagtacaatggcactatcttggctcactgcaacctccgcctcctgggttcaagtgattctcctgcctcagcctcccgagtagctgagattacaggcatgcaccactatgctcggctgattttgtatttttagtagagacagtgtttctccatgttggtcaggctgatctcaaactcccgacctcaggtgatctgcccgcctcggcctcccaaagtgctggggattacaggcgtgacccactgtgcctgggctattcattttctcttttttttttttttttttttttgagacagagtatcactcttgttgcccaggctgcagtgcaatggcacaatctcagctcactgcaacctccacctcccaggttcaagcaattctcctgcctcagcctcccgagtagctgggattacaggcgcctgccatcatgcccagctaatttttgtagttttttgtagagactgggtttcaccatgttggccaggctggtctgaaactcctgacctcaagtgatctaccaccctcgacctcccaaagtgctgggattacaggcataagccaccgcacccggcctaaatggctattaaataaatgaaaaatatcaggctttgaatgtgtggaactggtagaaagagcttagagattttctaaacagctctactggggggtccagcccctgcttcccaaacttaagcatttatggaccactcttgatgcttttttgtcctactggggcaaaaactaaattgagtcactttttttacttgaataaagtgtttttaaaaagaaactctctatcactgctaaaataggaaaaatctatagcatcacttgccatataggagaactccaataacaatttcagggaaaatcaagccacgttaataatttctatgtcagaacggttgcttccccaagttggctctgcattagaaaagggaacttggtggcctggcgcagtggctcacgcctataatcccaacaccttgggaggctgcagcaggtggatcacctgaggtcaggagttcgagaccagcctgaccaacatggtgaaaccccatctctactaaaaatataaaaattagccaggtgtggtggtgggagcctgcaatcccagtcactcaggaggctgaggcaggagaatcacttgaacccaggaggtggaggttgtggtgagccgagatcacaccagtgcactccagcctgggcaacagagtgagattccatctcaaaaaaataaaaagaataaaaataaaaaagaaaagggaacttggtaaggcttagagaagagtcagagatcagaaccaggcaagaccttctggctggtgtcatcagaaagattaaagagacctgaggccaggcacagtggctcacacccataatcccaacactttggaaggccaaccccgacagatcacttgaggccgggagttcgagaccagcctggccaacatggcaaaatcccatctctactataaacaacaaaattagccaggtgtggtagcttacgcctgtagtcctagcactttgggaggctgaggtgggaggattgcttgaggccagtaggtcgagaccagcctggccaacatggtgatacaccacctaaaaacacaaaaattagccaggtgtgatggtggcttgtaatttcaactactcagaaggctgaggcgtaagaatcacttgagccagggaggcggaggttgcagtgagcccagatcacgtcagtgcactccagcctacgcaacagagtgagactccgtctcaaaaaataataataataatttaaaaaaaaaagctgagggaggagttcaagcttcttctacaatgatagttttggtcaacggacttccgattcccagggaaatgtctgtttcccttgccaagggctatcccttggtttagccactgaatctctctgcacttctatttccttccccatctgtaaaatagatctataataatatactcacacatttatacaattataaactattaaattacaggctgggtgtggtggctcatgcctgtaatcccagcactttgggaggctgaggcaggtggatcacctgaggtcaggagttcgagaccagcctggccaacatggtgaaactccatctctacaaaaaatacaaaaattagccgggtatggtggtgggtgcctgtaatcccagctactcaggaggctgaggtaggagaatcgcttgaacctgggaggtggaggttgcagtgagccgagattgcaccactgcactccagcctgggagacagaacaagactccatctcaaacaaacaataataacctaccttatgggttcatgtaagaattaatgagacaatctttgtgaaacgagaaatgccctgcagacattaggtggggttagtgaattgctttctttttacccaggggccagtagaggtacagagaggtaaagtgacttacccagggtcacacagctacttgcctggccaggatcctgcaggggtgaatggcaggaaaagctttccctggtgcccctcttttgcagcctggtctggaggggatacaggaggccactgagaccaaaagacctctggtcgcttgggagagaaaactcctcagaagaacttgtttcccggcttgaaaaggagtggatgaggaaccgcagtgcagcccgggggtaagtgggtggaggtcaagaactcacctgatgctccttcagaaaagctcatcattggccgggtgcggtggctcacgcctgtaatcccggcattctgggaggccgaggcaggcggatcacaaggtcaggagttcaagaccaatctggccaacacagtgaaaccccatctctgctaaaaatgcaaaaattagctgggcatggtggtaggcacctataatcccagctactcaggaggctgaggcaggagaatcgtttgaacccaggaggcagaggttgcagtgagtggagatgtcaccattgcactccagcctgagtgacagggccagactccgtatcaaaaaaaaaaacaaacaaacaagacaaaaacaaaaacaaaaacaaaaaaaacctcatcatttgacccccagtccagcccccaacgctactctggctgcactgccgcctccccaccttgccttccagctgatcccactaagtagtatcaggctcaagatatggttcctcccagaacgcatcacaggttcctacaaacggggaacaaacaggttcctacaaatggggaaatggcagaatgacaggcagcaaacagaagaggtattttaaggccggggtggagggttgggaggggactcaacacacaagcagctgctcacttactatataacctgagcaattcctttcctgggcctcagttttctcatctgttcagtggggatgtcattagccccagctcatagcttatggggatgaaaaaaaaggatgatttatggaaaagaacttgcaaatgtcttgcaaatgggaagtgctcaagcactgttagtcatccagagggtgttaagatctttggagttatccactctgtccactcctgccctcagtggcatctctggaaacttctctgcagcccttagagcctgggatgcctcatttgagaaactctggtctagataaatgagcctgcataggattagataaaattgggttaaatgctgccctgccttcaaatagtgatgaccctggacacgttgcttaacctcaccggaccttggtgtttcaggagacagaacaaaaaaggaagttagctctgtgggaagttccctgcatactccgggattttgtggtagttgttgcagatggctgaatcccacacattaagagagacagaggagacagagactgatactataggctcacacagctaagaggatctagcctcaggtgttgctggatcaggggactcaaatgatgtcaggattctctcctttcatctcccatcccaactattgtctatgtgttggtctctccataaggcctatcccttcccatgcaagttcagcaaactccagcagaatgagagagcatctctctcctaacgtccatatagtaaatcccaaggaaggcctctaattggcccggctcaagtcatgtgcctttcaggggccaatcccatgcccagggggctggtgccatgactggtggtcccttcagagccacagaagtgggtaggggctgttcccacaaaggaagggcatgtgtttttccaaacagaataagtagtgtgagagaaccaaaacatcagttctctctcaccccaggcatggcttgctggacccccttcactgggttggttggttggtttgttttttgagacaagagtctcgctctgtcacccaggctagagtgcagtggtatgatctcggctcactgcaacctccacctcctgggttcaagcgattctcctgcctcagccttctgagtagctaggaccacaggcgtgggccaccacatctagctcatttttaaattttttagtagagacagggtctcaccatgttggccagggtgatcttgaactcctgacctcagggtatctgcctgccttggcctctcaaggtgctgggattacagatgtgagctactgcacttgactcaccctctacttttaaatgattttacggaagtggcagaattcagtccacaggggctctggaaggagcctctgccaactcctggcatccccagccaacatgaaaattacaggtcacccaacactagaactaaagggtagaaacattctccagaacagtttgagaatcctcccataaacagttgacagaaagaaaggggaaagatggggttatacaaagaccaggctccgtcagcttctgaaacaaccgactgcacccacagagaactttggttttctttctgaagtattttgcaaccactgggggaagggagagggcgtcctcctgagaggccacacaacagccacctgctggtcaagtcggcttcactaatttttgtattttttattagaggcggggtttctccatgttgctcaggctatcagactggccctgaactcctgacctcaggtgattcgcccacattggcctcccaaagtgctgggattacaggtgtgagccaccgtgcccgtcctccaccactcccttttgtatcccccaactcacaccttgcccatgccactcatgcataccccctgccttgccccaccatcatttgtgagatctgcactaaatggccttcagtccagagaccagacgtcagacagcaatctggacatcttccttgatgggaggtgcgacctgcaggagaggaaaacacttgctatggagcctgcaggctgaacacactgactctctggggcaaacagctcaaatagaactgagcaaaacctcagccagaaagaaaactttccagtcaactcttccccgaccccattttgcacatggaaacactaaggctcagaggagaggagacagagcaggcattggaaccacagtctcctggctccaaagccaagttctgtccacccagccaagctccttccttccttctataaatttttataacagcatgtgcggggggcactcttattaggccctttgcacacatcactcaatctgtttttcccattcatttgacaagtgtttattgagctcccactgtgtgcaggagctggactctatactagggacatcttggtggaaaacacaggcaaagtctacccacctggggttctaacgagacaaagagagggttggagccatgggcatagctgtgaaggcaatgaattaaatggcaggatcaaacaggaaagggtgggcagggatgctctctgtatggaaggggcatcttcttggctttgagatccaaatgccaaaatatttgtgagcagcaggccacacccactcagtaacagagctgaaccacaaccctccatagatgccaaaccaaacaccagatcagaccaataatgtgggacagagaccttggccttgaagggtctggccacctgagctcaccagaggttttttcttatgcttctttttttattattattttattatggtgaggttgggggtccttagtgcacaagaaaccctctacgaaccataaatcaagatctaggctcaaaaccctgctctgcccttgctgtgtgacctcgggcggctgtcgccatctctcagagcctcagcttccccttctgtaaaatggagaacctaataatgctcacctggcaaggggatccaggggagtcagtgagctccttcgtgtaaagagctgatcccagcacgtggccccgggtcacagatctgtaatggggattgaaattactgataagtggccaggcatggtggctcacacctgtaatcccagcactttgggaggccgaggcaggtggatcacctgaggtcaggagtttaagaccagcctggctaacgctgtgaaaccctgtctctaccaaaaatacaaaaattagccaggcatggtggtgtgtgcctataatcccagctacttgggaggctgaggcaggagaattgcttgaacccaggaggcagaggttgcggtgagccgagattgctacactgcactccagcctgggtgacaagagcgaaactccgtctcaaaaaaaaaaaaaaaaagaaaaagaaattactgataaacttataggttgtcagagccacaggggactcagcggaggaccacacccatcctctcacacacagagagaggagcagtgtccccgcccaggaccacacagcaaccggactgtcagcagctgcatcgccccagcctctcctttctggcccagggcttctgacctgcctcacaggcgccctcgggcctcccccatctcctccctccctccctcaccttagctcttctctgtggcccctggttatagccaaaggctggggatcttattagtttgaggcagcctgagcttctgtctgcactttcacccagagctagagcaccaggccccatgcccatcagccatgattctccaccagttcaaaaccacctaagggctggctgattgtgtgtgttggggacggggtgctgttcttcctccaggttgacaacacgataggttgaaaagtacatgagaggccaggtgtggtggctcacatctgtaatcccagcactttgggaggctgaggtgagcagatcacctcaggtcaggagttcaaaaccaacctggccaacatggcataaccccttctctactgaaaatacaaaaattagctgggtatggtggcacttgcctgtaatcccagctattcgagaggctgaggtgggacaatcacttgaactgggaggtggaggttgcagtgagccgagatcacaccactgcactccagcctgggcgacagagcaagactttgtctcaaaaaaaaaaaaaaaaaaaaaaagataaaagaaaagtgcatgggctctggaggcagagagctggaatcaaattccagttcttttacttctcagctgtgtgcccttgggcaagttcgcttctctgagccccagttttctcatctgtgaaatgggaacaacacctggcttctcagggggtcttaggatgactggggagtgcctggcacatagtaggtgctcaacaggtgtgctttcccatggccatctaagaggcctcagagtgccctcctgccctgccccccaactcccatgattgtctcttaagtgggtactcagggtgataaggaggaacaggtgagggagccaggctagatccacacccacccatctccactgttgggaaaacaaccctttaatgcctggccctgccgctggtggctgagagtataaaatgggacccagagctaatctctcccttcccctcaggcacaacaaggcaatagcatttaaaaggaaaggcggcagtggcatggaggctccagagactgagcccttcctacggcaagaagggagccagtggcgcccactgctgaaggccatctggcaggtgttccattctaccttcctcctggggaccctcagcctcgtcatcagtgatgtcttcaggttcactgtccccaagctgctcaggtgagtcccagacctcaagtgccctgctaaggtgggtggtctcttagtggcatccttccagggccagggggcttcagctctcctgcctctgcctatacatctggtgctcgggacactggatggtgggtgagaaggatactgaggaagggaaatggattaatgagaaagtgactgacccccagaagggcaaataagcaagctcttacctgactgcaccaattagtttttgctgtaaaatgccccaaaagtgagtggcttaaaatgacaaacattcttttatttagttcatggtaatgtgggtcagtaatgtgggctgggctcagctgggtggttcttcttttcttggctgggttttctcatgtgcctgcagttgtgtatctgagactgggatggctgtctctgctccatgtgggtccccatcctccaaaaggctagctcagacttgttcatgtgggtgcttgggagggttctaagaaataaaccaaaaaccacattttctcttgaggcctaggctcagagccagcatggctttacctccactgtactctgttggccaaagccggttttgtagccagcccagattcaagtggtgtctgctcagctgacataacaaagcatcacagactgagactgagtggcttgaacaacagaaatgtattttatcatgattctcgaagctggaagttcgagattagtatctgcaaggtggttccatctgaggcctctgtccttggcttgcagttggccacctcctccctgtgtccccatatggtctttcctctgtttgcgccccctggtgtctccttatgtgtctacatttcctcttcttaaaaggaccccagtcagattggattagggcccagcctaatgacctcattttaacttcattgcctctttaaaggccctatttccaaatacagtcacattcagaggtactgggggtcggggcttcaacatataaagtttgtgaggacacaatttagcctataacaagtgggaacaaaaactccacctcttgatcttgaggagctgcagtcagattgaaaaggagtatggacagtgggggaaataacggagaccattattgcaaaaaaaaccacactgactgatcctccacacctggactagtttgggccgactgatcctccacatctggactggtttgggcaaaggcaacacccttaggcacctcctctcaccagctgtaccttctccctccttcccctgcaagccttttcctggagtttattggtgatcccaagcctccagcctggaagggctacctcctcgccgtgctgatgttcctctcggcctgcctgcaaacgctgtttgagcagcagaacatgtacaggctcaaggtgctgtagatgaggctgcggtcggccatcactggcctggtgtacagaaaggtgagccctgggggacaagggcaggtcttcccagccaggaaaagcagtatcactgagcaggcagtaatgttatcagcagctgagaacgcattcagtccttgcttattagagtcactcaccatacattctcacttccttagttatttctctttattatatgtatttatttttttgagacagagtcttgctctgtcacccaggctggagtgcagtggtgcaatctcggctcattgcaacctccgcctcccaggttcaagtgattctcctgcctcagcctcctgagtaactgggactatagacacgtgtcaccacgcccagctaatttttatatttttggtagagacaaggttttgccatgttggtcaggctggtctcgaactcctagcctcagctccttagttattcctgtaaggtcttgtgtgatctgtccctagggtgtctctgacctcatcccgtcacctcctcccatgctcactctcctccagccacacaggtctcctttcagttcctcaaacactccaggcacccacccaccctggggcctttgcagttgttctcactgcctagacaccgtttccactccctctaatctaattttaatttttgagcctaattttaacttccactcattcccccttgaggataaaggattaaccttctgataaggtggcctgtcagctgtgttcccagacaatactgcttgaggtaaaaatgacccctaggctgggcacagtggtgcacgcctgtaattccagcaatttgggaggctgagacaggaggatcacttgaggtcaggagttcaagaccagcctggccaacatggcgaaaccccatctctactaaaaatacaaaaattagccaggcatggtggcgggtgcctgtaattccagctactcgggaagctgagacaggagaatcgcttgaacccgggaggtggaggttgcagtgaactgagatcatgccactgcagcgcagcctgggtaacagagcgagacctcatctcagaagaaaaaaaaaaaaaaaatcccaaattgcatctgggctggaagttctgtccattgactgtgaatacctggttggaggccatagctttagacttctctctgtgcagtggctcttgtcccttccggggactctggaagctaagtccctggactgctgccccaagagctattggctcctgtggggtatggagcatctgagccagggcaggtcccgtcccatgtaagtgtcattctctgatacctgagctgtcacctaggggaggaggggacagaggggacagctcctaggtggctgagagggcagctcttgatgctgtcctgccagagtgctgcgtcccaggctcctgttcccctgagcatgccagagctgggtgtgccctatcctgtcttgagagtccacatttccttgagcctaagaggaaggccgcctggtgagcaggcattgatcttcctattccccacccacccgccaggaggccttctttgatctcctgatgagatcagatccctcctctctaacctctgggcttttttttttttttttttttctgacagagtttcgctcttattgcccaggctggagtgcagtggcacagtcctggctcactacaacctccgccccctgggttcaagtgattctcctgtctcagcttcctgagtagctgggattacaggtgtgccccaccatgcctggctaatttcgtatttttagtagacagggtttcaccatgttggccaagctggtatcgaactcctgacctcaggtgatccacctgcctcagcctcccaaagtgctgggattacaggcatgagccaacgcacccggcctgggctgcttttttatgttactcatcataactgccattaaagcatgagttatagaaatatttttgttttgtcttatttttttgagacagagtctcactctgtcacccaggctgtagtgcagtggtgcaatcttggctcactgcaacctctgcctcctgggttcaagtgattgttctgcctcagcctcccaagtagctgggattacaggcgcccaccagcacgcccagttaatttttgtatttttactagagatggggttttgccatattggccaggctgatctcgaattcccggcctcaagcaatccacccgcctcagcctcccaaagtgctgggattacaggtgtgagccactgtgcccggccagttatataaatctttattatagagccttgttccccacctcaaactccagtcccgggagagcaagcctcatctctgttgttcacagctgtattttcagttcccagctcagtgtgagtcacacagtgggcactcttcaaagacttgctaagtggagaatttctatgtccagtcattcctggatcacttcttcactccctcacgcagtcacaaagggagggctgcatgtggaatttagcattcaacaggctggaagaggtccactgtgaccccagggttaaggcagatgtgaggctgccagagaaccaggttggtgtcacagaagcacgtgaaaggtctcacccttgtcatgccttcgtcaccctggattccattccttgtgtaggagcttacaaggcctgtgactttgggcaagttgctcaacttctctttgcctcggtttctttagccataggatggggttagtaaatgttcatttcattgattctagtctcacttttttttttcactctaatacttccaaaatcgagatgtctcttacatgtcttaatttaactggaagtggtattttccttggtgagagaataatagagagcaatttatccatagaattttttttaaagacagggtcttgctctgttgcccaggctagagtgcagtggcaccaacatggctcactgcagcctcaacctcctgtactcaattaatcctccctcctcagcctccccagtagctagctgggaccacaggcgcaccacaaccatgcctggctaattttttctttttttttccccccgaaatggattttgctcttgttgcccagactggaatgcaatggcttgatctgggctcactgcaacctctgcctcctgggtttaagtgattctctttcctcagcgtcccaagtagctgggattacaggcgcctgccaccatgcccggctaatttttgtatttttggtagagacagggtttcaccatgttggccaggctggtctccacctcctgaccttaggtgatctgtccacctcggcctcccaaagtgctgggattataggcgtgaggcaccgcacccggccccctggctaattttttaaagtattttgtagagcttgggtcttactatgtcgcccgggctggtttcgaactcctgggatcaagcaatcctcccacctcagcctccagagtggcgggattacaggcagaggccactgcacctggcctggcattagagggaatgaatatggtagtgcctgcttggtaccattcatggctgtgagcaccccgggaaaggataaggctgttcatttagcacagtgcctgcaacatggtgagcactgggcagatgaccaccgttatctgtgttaatctggtgttttctcctaaggcaggaggatctctgcagtctaggagttcgaggttgccgtgagccatgattgcactacagcactccagcctgggtgacagagtgagaccctgtctcagaaaaaataaaaataaacattaaaaaaaacctttccccggaaagcaaagataaccagaagcaggtttatgtcttgttctttcaggaattccaatcaaaaaaaaaattatcttttccaatagttgtagcaaaggtcccagaattctaattggttctggttggcccaatttgatgtttttgattggtcaggtctgggtcttttgcccacccctagcaccaggaataaatcaggcccatctgagccacctgccttgggagtaggggaagggatcctcctagggaaataggggtgttattattcagagagatcattaacctgtggacagataagaactccagatatcaacgacacttccttaccactctttttctaggcatccacagcatatctgaagaaatattcagaagttaactaatctcagatgatttcagcaggagtaaagaagagaaacagactcagaaatgccattacaacagttaattatgtcaaatttatcaccctgattgatcacgcagcattaacctcaagaacgccaagccaagtttttttgacaaatgtgagccaaggtttccgaaaaactagcagatatgactgtgacttacaaaatggaaaaagtaaacgagaaacacaatttgatatgatttaataaaagatttgtttccaccacttctcctgggaacctcagcacattttctttccactgacagttattatctctacctttattgaacaaagacacccggaacacagctgctgaggatcagtaaagaaaatcattcttttattaataagactgttattagcaggaaaaaaaaatccatgtttgggagtttgcactgaagttacaggccattttgaagaaatatggctgactagtgccaacattatttcaggcaatttcatgatcaaatgtcttattaggttgtttaaaatttttatagagattgtaaatcagaactattttctatttgccctaaatatttagatgctacagggaaagcagatcaaattaaagggtactgtgcacatttttttactgggaactcccagggatataaatcatttcgcctgcagcatggaattcttcagtacacatgcttgtggaaacattccacgctccgccagcacgctcattaaagtgatgatttgggttgcaacaacagtgccaagtacttcctgtgttcaactggggaccatgtggcaagacccaaagcttccccagagatcctatgggaataagttttttgagccaccatattccattatttcagcctaaaataacaccatgggacaagaatcagaagacagaggagcagacaaatgtgtgtagacatgctggaaggaatctttctttttagaaacagggtcaatatctattaaactttaagatgtgtatctcttgacctggcagtttctgtatttgagttttaacctactgatatacccatgcatgtgaataaagtatcttcctgcatgtaacaggatatttaatgtaaccttgattatagttgcaaatgctgggaaacgatccaaatgtctttcaatatggcactgattaaataaattatggcacagtctcacaatgaaaaacaaatgtagccattaaacagaatgaaatgggtctagctaaattgaaataggactacctctaagatatgttgttaaaaagaaaaaaaagaaagtgcagaggaacaagtatgataccattttgtattttttaacatatgcaagcgtgattgtgcccacacagaatacctttgaaaataaactcagtatttgcctcagtggataaaaacaagaaccagccttattttcactgttatatcttttggtgccactttttgaactttttaccatatgtgcatatgtaactttctaaataaattttgtaa

SEQ ID NO: 1553 - DNA, 159717 bp, Homo sapiens
ttaacaagtaaaaacctgcaaactctttattaaattctcccatttcatctgtacagaaaaaaatgcacattatgttcagaacatatctcagtaacatctcaaaattacacagcatgaacatgtaaaaacaagggaccaccacgattttatacatagaaaggaaacccatttacaaaagaggcttgttaattgtatttttttctttctttcaaaaacaaaacaaaacaaaaaaagtgaaaagcctaagatctcacacagcatttgctgtacagactgttttccggatggactggtttgggaacactgtgctgggggaagctgcccaggaagcgctcccgctgccggctttccggaggtctctgcccagtgcactgcagggggacctggagggcccatttctaccaccctagcatgtctgacagaaagccctgctgggctctggggtccagatgtcaactctacattggaggaggcaaaacacaatctagaggcactgtctgaactttcccctggcccagggagatttctccactgcacacagcacagtgtcctatacatgtgtcctggtggagcagagggagcgggagaggaccacgggtcaggatcctgtcaccaccagcctgagcagacagtcccatctttgtgatccaggtgacaaataatcagtccctggtccccacaatgacctcaccagatggctttggggagctcttcaccctaaagattcggtctggtttgctaatgacttatctattatctgaagtctgtggaggaaggaccaagaaggggtgcagttagagggatgagcaaccaaagaccaatgggagggaaggcaggcaagaacctcagacccggccccacgccctctaggaaccaaagtctagtggagaggaggcgagtggggaggaaggaagtgtccctcaaggcctgagagagacccacagcaccagatgctgcattttacaaaaccacttaggtgctgcccaaatggtgagaaataaaaggaagcattctggcctttcaggtttttcaaactcacaagatgttgaaatacaagtaaatataccaaaatgcacataattgaggccaaggtgggtggaccacatgtggtcaggagttcgaaaccagcgtggccaacatgatgaaatcctgtctctactaaaaataagaaaaaattatccaggcatggtggtgcatgcccgtaatcccaactacttgggaggctgaggcaggagaactgcttgaacctaggaggcagaagttgcagtgagccgagattgcgccactgcactccagcctgggcaacgagtgaaactgtgtctcaaaagaaaaaaaaaaaaaaggccaggccgggcgtggtggctcacgcctgtaatgcactttggaaggccgaagtgcactttggccgaagtgggccactttgcggccactttggaaggccgaagtgggcacatcatgaggtcaggagatggagaccatcctggacaacacggtgaaaccccgtctctactaaaaatacaaaaattagctgggtgtggtggtgcatgcctgtaatcccagctactccggaggctgaggcaggacaatcgcttgaaccagggagtcggaggattcggtaagctgagatagcgccacagcactccagcctggcaacggagtgagactccatctcagaaacaaaacaaaaaaccaaaaaagccattacggccaaaatttaggctgactgttctagggctggctgacttccaaggttcctggtccagcttccttcttcttagattaagttctgacttagagtgtgttctaaggaggcaggggaggaaatgggaagggaaggcctcttttcagtggcctctccccagatgactcactatagtaggaacttcggggcagaagtcacaccacaggcctggaggatgggaggataggagacacttccagaagccacactgacataagaacagaatcttctcttgggaaggccaagggaagtcagccacataattccctttccagtgtgccttgataaaacgtaaaacatgaatgaagacactctcaccattagattcttctgttagttgatctcaggaaacagaaacaaatgaaatctgacagtaactttctgtagcatcttcagggaaagctgtctcttcaccaggatgcatccccaccctggccagctgagtgactcactgttcccaagaagagtaaggacagcatgagacagccaaaggcctgcagtgtgttcaagtcaatacctgctcactcaacattagctcactggtcaccctagaattctcctagctttgaaggatgcactaacacagaactgcagctgggggtggtagcccggggaagatcgctttcccgggggtgatcccaagcctatggagtgcatggctcccctgccggtgcttcttgctaacgggcttgtctagggacaacagcaacagcaatggaagtccaacatgcacccaggtgaaggcctcacagagctccccatctgtgggagaagctccattgtgaacagttcgtcttgttcttaatagtttgcccagacagctcaccttcagtaccccagagcctccagcctggcagtccgggctccaggtacctctagagggctgtggcgcacactatgcataagtcacagggacactggcatgaactggtaagtccagatgacagtgacccagctgctataactgttagcaagtacctgaagccttagccttggcaaaaccccctaccctctacttctattactgttggtgggctacacatcaggagagtagacacaggccagagtccatcatccactcacatccacagaagggtcattgtttcttttcttgaccatttctcagccagttgactgacctataaggccaggaaccaggggtgccccaggccctgttttgttttgccaaatgagggacttaatgagtgcggccagttcagactttgctggccttggcacttagaaaaacttgctcggggccctgcctggggctctcaagagccagtcattggaaaatgctccaagtaagatgatgaaagacattcttgtaataagtaattgaagatactggcagagctaacttttctattctgaccatttataaagatgacaaatgttttggccaggcagggtggctcacacctgtaatcccagcactttgggaagctgaggcgggtggatcatgagatcaggagttcaagaccagcctggccaagatggtgaaaccccatctctactaaaaatacaaaaataagccaggcgtggtggcgggtgcctggaatcccagctactcaggaggctgaggcagagaattgcttgaacccaggaggtggaggttgcagggagctgagatcgcgccactgcactgcagcctgggcaacagagagatactctgtctcaaaaaaaaaaaaaaagacagatgtttcaagaaccaaattcctcatcaaacttccaaatctgcagacaacgaatgggattttctctcaattcagaaagaacagaaatatcaacacaattagaactataagggtgtttacgcatactgggaaggagactgcagagaggaaggataccccacccggtcaaacagtgaacatccatcctacctgcaaaccacaccaggcacgtccgtaggcacctccatgtacatgacattcctggctcttgatattaggcctcagcggcccccagcccccaggggaacctgcagagactctcgggccgctcactccggctggcagtggcgggaggcagtgtgtgctgctcgcaccctgcgtttccagttttaggagactgaagcatcccagacagctgttgacaatcaggaagaccctacaagcaggaccgaggggactaagcagcttagcagcttcccttggtgacttggcagggggacaatcagttggcttctggaacccactgcctccaggaagggcagcaaatagaaaaaaaagaaagaaaaccacagtattcaaatatatgtcagtcaggttagacaaggagtaacttggatcaactgatccacaaactgacacgccttgtactgaacacccttcagggaagacatgtgtcgctccggtcctgcagtgcacgtggactgtgcagagcagaggcaagagtggggggcgccgagggcaggccttggtctacatggacagttttaggcacgtgatttataatactttgtggacatctaacaggttaataaaatatatattacataaatgtctctcctactgtacacactgctctcttgtgcagccactgtgatctcatgccccaaactcaaccaaaggagtgccacgctgaaccatgatgcccggacccctccctctcacacccagacttgtcatctccacactggaggaatgaggcgggatggccaagaatattgcttctataaagcccatattctgcaaaggttgatgaatcgccaaaatacaacatttagccaatgcctactagagtgggtacacgcagcaaatggacagaaagaaaaaaaacagagcaaatcctccatcttttaatgtgataactttccacaccctctccacgtagaggcacaaaggagcttgtctgggaagtttgtctggagtgtgcagaaaggtcaggctggactgcctgtcacatcctgagaccacactaaacctttataagccattgtctctgacctgtattgtagcctgaaaaataaagcaaagtgagtcaaacctctggctcccacttcctgacccactgctccccacacccatcttcaaggacccctcccgccacagtcctgcctcctgatgaagcgcagagcttccagagtgactgtagcctcagcagggccggtccagacatggctgagtcctgtgctgccctggaggaggaaggttcctgggatcctgctgccccgggactcaggatccagcctctcagtgcagatggatggactgttcaacttcacaaacttccggtcccttcccctccccagctgcccttgtctaggaaggctcatgctttgcttcaatgaagcgaggagaccacagaaatacccatggctgtggggctgtgaccagcagtggctgattagggtggaaactggaaagcgtcactgtctcagcagaagaaagcaggaccccacacagcctggggaacggctgcccacccacgcctcggtgaagaccacggccctggcgaggccccaaggtgcttctgagagatgaacgagacacctcagtcatggcacactgggtggtgtgcttcccctccaagtcctgtctttgttttacacagtcatatgaaagacataaccccattgcccaaatcaagcctggaggagatgcgttactatatacatttttttctttaaaaaaatttttttttttggtggttttcttaaaaaagcctttgagttgcaggtcaggtgagttggttctggaagtaccggaagttctgttggtatgagagagacttgtctacaggcaggtaaacccaagtttgccaaacaaaggcagtaaccccagcgaccagctgctgctgctgcacggtgaggaggaggaggacaccatggacacgagtggaggctggatgggacaacgcagtggacatctgctaatgctctaacacggggttggtgtcacttctgagaagagcgaggtgagtggggatgctatacaagagggctgtacaaactgggcactggataggtagttcctttggtggtcaaggtggctctacctgtccttgagctctcgtgtcactcgcttggtgatccgtccacacatcaggccaatcaggaacaatatacagatgctcccactgatcacagagagaatgtagttcttagatggagacgtcattacttgcatggcaagatcagagaagccatctgctggggccacctagaatgacacaaggcaatgtgattctctgagagagcactgggctggtggcagtgctaggtctaacttatccctctcagttcctagtttaatttatgtcttttcttttggagagggagggcaggagataagaaaaatcaacacagagctacaactctttttcctgatcataaaactatacacacgtctactgcacaaaattagaaatacagaaagagacaaagtggtgcagtcacccacaattccatcacagtgatcaccactaacaccaggacactgaagatgtgtcgggccctggacgaagggctccccctgccctcactcatttagcactcacaccaagcctagcaagcagatttcaccactcccatactctggatggagaatcagtgcccaggggtgagtgtggttaaatgacttctataaggccatgggttcttctatcttttggtttatgctctttaaatgcgtttgctgcctttctttaaaaaacaaagataaaagttgacatcgttttacatattctatattttgtaaattctatttttttttttttttgagacaaagtcttactgttacccaggcattgtgcagtggcatgatgtcagctcaccacaacctctacctctcaggtttaagcgattctcctccctcacccacatgagtagctgggactacaggtgcacgccaccatgcacagctaatttttttggtatttttagtagagacggggtttcactgtgttgggcaggctggtcttgaactcctgacctcgtgatccgcccacctcggcctcccaaagtgctgggattacaggcatgagccactgcgcccggccttgtaaattctatattatttctaaattttatattttggcttttttttcattgagttggggtctcgcgctgttgcccaggttggtgtacagtggtgcgatcacagctcactacaacctcaaactcctgagctcaagggatcctcctacctcagcctcctgagtagctgagactacaagtgcaccaccatgcctggctaattaaaaaattttttttggccaggcatggtggctcacgcctgtaatcccagcactttgggaggctgagatggtggaccatgaagtcaggagttcaagaccagcctggccaacatggtgaaaccctgtctctactaaaaatacaaaagttagctgggcgtggtggcgctcgcctgcaatcccagctactggggaggctgaggcaggataattgcttgaacccgggaggcggaggttgcagtgtgccaagactgcactactggactccagcctgggcaacaggacgagaatccgtccccaaaaaaaaaaaaaaaaaaaaaaaaaaaaaaaaaatttttttttttgttagagatggggtctccctatgttgcccaagctggtctcgaactcctgggctcaagtgatcctcctgcctcggtctcccaaggtgctgggattataggtgtgagccactgcacccagcctgtattttgacttttttcattcaccattatatcataagcatttcccacatcaaaaacaatgtgcaggccgagaccagcctggacaacatagccaagaccttgtctccacaaaaaattataaaattagctgggtgtggtggcgtgcacctgtggtcccagctactcaaggaggatcacttgagcccaggagttcgaggctgcagtgagccatgttcacaccactgcaccgcaaacaagacttatattgacagaatatatttaaccgccctccacttgtggacatttataatttaacctcagctatctttcatcctcagttttccactgctttccctaacggaccttgatggtagcctgctatggcagaatcaggaccaaaagggtccccaggtgcacatgtccccattcttttgcatcccagcctggctgctgagatggtgtggcccagaggcatctgggctgtttctatgctcatatcacgtacacagaacagagtagggaggcgtgagatgaatgagatttgagctccaatagttgccaacacaaaacaagccgtgaattactctgagtcactctgaagcaataatacacagctcaaaggactggacacaatgaggcagaatgaagtaacgcagcatctcctgctgccgcttccctgagccaccggctttaaaggcaactttcttcccttggcagaagggtgaggagagtgttgactactgtgacagacaggagccctcccttgtaccttcctgctgtcgacctatgaagactttctctgattgttcctcttgacttgttacccttgacttggaagtaaaagggtgataaaattggccaggaaggaggggtggtcctgggattactctcttgatcttaggccactgcagatgtctatcccaatatgagtcaatacaaaagcatggctctaaaaaccagagggactctgggcaagtcgtgacctctgaagtcagtttccttcactgtaaagtgacgaaacagtcattatacttacctcacagggtttcaaagttcaaatcaggcaatacgtccaccaaagcgttatgtaaactacaaagcaatgtatgcacgagaagaactgttattcttctcactgaggctgaacctctgtaggaaaaattacccctagcccaagtctacctgggtatcatacacattcatgagtgtcctacagtctttcttcatccccttcttctccatgttccagaccagatgagtactggcctcaaatatgtatttttctcctaaagactgtaaaatgataaaagcaagcttcatcataggcgaggctggatttctttcttttgccatgggtgtgacatctcttttgtctttgggtgactcacttttcagcggtgaacagtgggcgaaatgagaaaggagggccctggcaaagccttgcagacagcccgatgcacagggagacggctccaggctcacgggcagccaaggaattctaaaagcacactgaccatgtttactgttttttagtagagacggggtttcaccgtgttggccaggttggtctcgatctcctgacctcgtgatctgcctgcctcggcctcccaaaacgctgagattacaggcgcgagccaccgcgcccggccctgaccacgttttcaaacgcacttattgctagtctcacaataaggacaagaccagtgcgatatctaaaagaggctggacagccacagcgaggagagtggcatggcctttgctcaaggatgacatgcaaattggtgaagtgttccatatttttttgtttttttaaaaaaggagattctcttggtcattacctttgctgcgtaactccacatctcaatccggtcattgaggcgctttttgcactcgggctgtaacctcacccgcttatcctccagtgcttccatgagacaggacatttctgtgggaggaaatgaataataagaagaacctgaaactgtacagaatagagaaatttctgtaaagatgaggaagagggtgcacaaccaccagagaattcagatctgcaggctcaacaaagttaaatacatactaggaaacttgatccaggatccaacaatggagagaaatgatatgtaacctccagggttggcgtccgaagcctctcttaaaacctccttatttttagagccaggtgtggtggcaaacacctgtaatcccagatacttgggaagctgaggcaggaggatcccttgagcccacgactttgagactacattatagtaagaccttgtttcaaaaaattaaaacgaaaacaggctgggcatagtggcttatgcctgtaatcccagcactttgggaggccgaggtgggtggatcacttgaagtcaggagtttgagactagcctggccaacatggcaaaaccctgtctgtacttaaaaaatacaaaaatgagccaggcatggtggtgggtgcctgtagtctcagttactcaggaggttaaggtgggaaaatcacttgaacccaggaggcggaggttgcagtgagctgagatcatgccaccacactccagcctgggtgacagagtgagactctgtctcaaaaaaataaataaaaatacaaacaaacaacttctattagttttattgggtatacgtggctcaaaaagaactctcacacttgccttggctccctcctcacacagaacctgtctactgagtccactgtcgtcaccggggaagtgtgtgaagctggcttctagtttcggcaccaggaaaaggaccatgatgatgactttaacttctgcttccctaataaatacctcaattctccctgttcatcaaatctttagctccagtcatgacaaggccagttcaaactcgcaggcttattcctaaattcatgatgccataaaggtctagttttggcatcacccaggtccccagggaatgttgtctatgactgggctacaactacagaccatacagaccacagtagctgcaactgatgtctaagagggagtctttgctcttcccaagagagttcagacaggatcaagagtgaacacagagacttacgacgcccgcggccaggggtgatggctgcgcagtggtgtttaatgtccagggcacaagcagtatgaagtaccgggtcaacaaagatgtctgctttgctttccttcagcatgtttagcacttcctggaaagggagggtcattgcagacagagcttttgaaggggaaatgcatcagatctgttgtctgtaaatacttcatatactaataaaaaaggggggaagttgagggctaacaacagagaccactttgggacaggttgcaaggtggtgatgatgtacagaatgcagaatttaattgagtaactaactacttttagggatacaaaactgtgtgttggaaaaaagcaggggactgtaagtgactgtaagatcagatttgtgtttttggcattcccgtatgtcatgtcgtatcattttaaaatacctaaacgttaatatttttattggtgtgatacaattactgtgttactttaagaaatatgaaaacgtgaaatcttaaaatcagagtaatatgctatattaaaattctcaatcgggactgggggtggtggcttatgcctgtaatcccagcactttgggaggccgaggtaggagtctgagacccgtgtgggtaacacagcaagacccccatctctatagaaaattatttaaaaaaaaattagctgggcataatcgtgtgccctgtggtcctagccacctgggaggttgaggtgggaggactgcttgagcccagtttgaggtccagtgagctatgactgcaccactgcactccatcctgggagacaaagtgtgaccctatctcaaagaaaaacaaaaacaaaaaaataccaattagataaaggcacatttgtttacaaaatgttctactttacctctgttgtcctcagaaagaaaaacagaaaggacagggcataacatctactacaagagcaattcttatttgtgtttacagatgtcctgaatgagaggaatatcaacatgatggaactgaaatcaactctgcagattctccatttatacataagggaactatgggaggtaaagataggccagaaatgtttccataaataaaagttagtatgctccagacaagactctagtccctataaaacaacagtaagagaaataaaaaccaaaaaccaaaggccaaataatattctaaaatcctccccaaagttatatgggatcatgtgatgataaaagaggcaaaggaaaatatacggatctagctttccacatttttaacagacgaaaaaatgtgcacacaatgttctcaattattcaataatgacatcagtgaaattcttttttaaaaggttaattttggctgggcgcggtggctcacacctgtaatcccagcactttggaaggccgaggcgggtggatcacgaggtcaggagatcaagaccattctggctaacacagtgaacccccgtctctactaaaaatacagaaaattagtcaggcgtggtggcgggcgcctatagtcccagctacttgggaggctgaggcaggagaatggcgtgaacccgggaggcagaggttgcagtgagatcacgccactgcgctccagcctgggcaacagagcgagactccgtctcaaagaaaagaaaagaatattcacattataggagatgagcagtcaaaatcaaatgaaagtttggtaagaaggaacagcaagaaaagagtgctgggcagaaggttgagatttttggttttattaccaaggtaggcagactacagcattaaaaggaagaagagaaaaaaaaaaaaagaaatgaagtgaggaaaagaaggtgacggtggttacctttttacacaattctgttttgatcttgagcaggttgaccttgaggcactcctccacctgacctgtctgctcttgggctgctgcttcttcagcacatagactggagatctgttcaggagacacaaaaaacaaagctaccccactgagcacagaaatgaactgacagtttcttcttttttttttttattttttgaaacagagccaagctctgtcacccaggctgcagtgcagtggtgcgatctcggctcactgcaacctctgcctcctaggttcaagtgattctcctgcctcagcctcttgagtagctgggactacaggcgcgtgctaccatgcctggctgatttttttttttttttttagacagagtcttgctcttgttgcccaggctgaagtacaatggcacgatctcggctcaccgcaacctctgcctctcatgttcaagtgattctcctgcctcagcctcctgagtagctggaattacaggtatgtaccaccatgcccagctaattttgtacttttagtagagacagagtttctccatgttagtcaggctggtctcgaacttctgatctcaggtgattgcccaccttggcttcccaaagggctgggattacagggcatgagccaccgcaactggcctgatttttgtatttctagtagagatggggtttcgccatgttggccaggctggtcttgaactcctgacctcaggtgatcctcctaccttggcctcccaaagtgctgggattataggcatgagccaccacacccggcctgaactgacagtttcaaaagcagatgagtccggtgattccaatcagctctggacaccgcaggatctgtgccccctcttcactggcctactgctgttttacaagccaggggcagtagcactgctatcaccagaacccttggtctctaaacatgtcagtttgatgatcgtcccacacctgtgccagggctcatcacaaacagtttcctgggggtttcgtgcccctcctcctatattggatgccaggcttcattcttcacaaggactggcacacagagtggaaaatcaataaatgtcatatctttacactgtaaacactgagacttgagtcagatctcaggacttgtcaaaaagaaggctgctacttgattccacaggagcaaggttatatataaccaaatcaaatacgaaaagcaaacgcttgacattcacataggttcagggtcaaaccagactctcaacttgaaagtgtgcacacgcgcgtacccgcacacacacgcacacatacacaggagttgagaaacacagcccacagcaaagacaaaaatattaagtttctttggacagttttatgagtgagcttttttgtaacagcttttgttatgagctcctgaaattaacatatgttgaacacgctctccacaaggccttttctagctaagaagtccaataatctccaaagatgggcacttccttacggccattatagaattactttttttttttttttttgagatggaacctcgctctgtcgcccaggctggagtgcagcggtgcaatctcggctcactgcaagctctgcctcctgggttcatgccattctcctgccttagcctcccgggtagctgggactacaggtatacgccaccgggccgggctaatgttttttttttttagtagagctgggatttcactgtgttagccaggatggtctcaatctcctgacctcatgatctgcccgcctcagcctccctaagtgatgggattacaggggtgaaccacctcgcccgggcttttttttttttttttttttttgagacagagtcttcctctgtcgcccaggctggggtgcagtggcatgatctcagctcactgcaacctccgcctcccgggttcaagtgattctcctgcctcagcctcctgagtagctgagattactggtgcacgccaccacgcctggctaattttttgtatttttagtagagacagatttctccatgttagccaggctggtcttgaactcctgacctcagatgatccaccctccttggcctcccaaagtgttgggattacaggcgtgagccaccgtgcccagctgaaagcacttttatctttctggcaggtcttgggtttaccatccagaataagaagaagggaagaacaaatttacagagagctataatgaaagaacacccttgttcaacagagaaatatggaacaacgctttagagtgtcaggactaatgccaagttgaattcagtgttacaaagaacaggaatgcagaccatggagagcctagaagatggccttcaattcaccagatcattcacggctgaagggagagaaagtaaacaacttttctccagtggaaacttctctgagcagctctgtgcgtaaccagttttgcacgcaaatcccacctcgtctgagcagtgcagctggagctgaggatccaggcggtagtccagggcggactcctggataatgattcggatctggtcttcacagtctgaagacaggcgctgcatgtgacaaagggaggatacatgggctgatcagaaaacgaagcttttctacaaaagcaggacatgaaaaaaaaaacaaacaacaacaaccacaagaacaagaaaaaaacaaaaagaacaagaaaaaacaaaatgcctgcttttgatctggccccttagccccccaggttcgggaagatatgaaaaaggtcttgggaaaacgggagcaagctagggatttcaaaagagaaaattcccagggacagaggctccataaatacacctttgtggagagcccaggccagtttacctggtcagcatatctcagcttcaggcaagagatgacttgtccttctaattctgaatcatccttggccttagtcaggataccgtgacagaatttaggaatgtcagctttacaggcttttcttaacatggggtttaagcggtaatctagagtagaaagcagtgagcatgtgacaaaacattccacctgattcacacatttttagatatccaccttcctaaagggagcatattatgtcaatgatcatgactacaaccatggatttatctattcaataaacatttactgagctctcactacactgtttttaatcagcaatatgacttgttaacgagtacttctggaggtcctcaggaatctttctactctgcggggttttgtgcagactccaatactctaaggagtcctcagaaaaatcaaggggacatcagcaaccttccccataacagacacttttgagaacactgaaaaagaaatacaatatccaactcactgtgaccattaacttacgaggtcttccaactcagaggtgaaatgtttctgttccgaatcagattacccgtacattctcctggcacactcatgaagttttattgaatttctagatttttctttccaaggactgccggcctgattccttctgaacgttcttttagggcagttttctggttcttgtggcctcctctctcccctgactctccctccatttttctggatgctcctcaaaggaggaaggccctgcttacactcagactcctcccttaaaattcccaggcaacaaagccctgggagtttgagcaggtcactctacagccactgaattccttttcagatactccacggggccaggagagccaagccaagatcttacctgtgttctgggtgatctggcgcttggttatcatctgtttgcatttgggatccatcaattcactgtttttattttgcttcaagcactgcaacatggttttagaatctgcttccggacagaacctctgcaaagaaacagtttgataaaaacagctatctaaacatggcgattaactccatctgcgaccacttttttttttctggagacggagtctcaccgtgtcacccaggctggagtgcagtggcgcaattcggcttactgcaacctccgcctcccgagttcaagcgattctcctgcttcagcctcccaagtcagcctcctgagtagcggggattacaggcgtgcgtcaccacgcccagctcatttttgtgttttttttgttgttgttgttgttgttttagcagagatgaggtttcaccatgttggccaggctggtcttgaactcctggtatcaggtgatccacccacctgggcttcccaaagtgctgggattacaggcatgagccaccacgcctggccactttttttttttttaaggctagtcaagtgaagcaacaggaatgtagaagaacaaataaatctgtaagtagctgtgatcaattagttgtaaacagcaccgcacttggaccagcctgtggtcacccttaacatctatccaaaagctgatgaaagcagcagcctgaaggcatcacgtggtacaagaggagcaggtaggcctgaaagagcaccccaccccaacttcccctttctttcttattctctactatttctcacatttctttctactgcctcactggttcttacacaggattggttccctatctagagggtgatgttaagtttaatggcatctgaggaacttattgtttaagcatgaatgtaacactgtaccaggtggctgtacagccctcaagccctacctacccaactctagtggggaaacctaggaattctccactaaccaatgtgaacaaggatgtgggctaaggacccacttggttcatcttaattacagggctataatcctaccaagcagtaaagggtagggtcctgtacacttactgctgtcctttaagtcagggatcagctgtggactagtaataaactccctatccgttctgctaatccgcaagtcttcaagtgtcacagtgtctgataaactctggttgagacacttgagcactgagcctctcttcctagttctgtttctagttctctaaagagtgtgattataacctgctgacatcttgttatggagacatggattgttcactgacttttagaaaattttccaaagctctctcacatcagagcctgacatttccatttttacatatgactcaatttcatcaggccagttaaaaagacttacattctaactttcaaaattctctctagaatttatttgatagtgtaaaaagtagcattttactttaaaggaaagctgaaataaaggagctagaacctttagtttaagtttaaaaaaaattttttttttcttttttgagacagagtcttactctgtcgctcaggctggagtgcagtggcatgaccttggctcactgcagcctgcgcctcccaggagcgattctcttgcctcagcctcctgaatagctgggactacaggcatgtgccaccacacccggctaatttttgtatttttagtagagacggggtttcaccatgttggccaggctggtctcgaactcctgacctcaggtgatcctcccgccttggcctctgaaagtgctgggattacaggcgtgagccaccgtgccctgccgaaccttgagtttaatgtatgtgtggcgagatcagggaactgacatctaggtactcaggtcagccctgctgcagggaatacctgctggaggagggaatgaagcaaaacaacctgtaaaacagaaaaatcttctgaatgtgccagatggatgatcaggacattagatggtgactttcttagtacagctactattaatcgtcctcaaaaccaatcatttatttattgcacatccatttacttgtgcctcaggtcaaagtgaggtcagttatcccagctctgtggtttccaaacttgagcctgcatcagaaccccctagggaggcagctaaggcagacttcgtgctctactcccagagtttctgattcagcagatctggaggggggcccaggaacccgcaggctcccagggggtgctgctgctgctgctcgtctagggaccacactttgagaaagctgagcctgaggaagttgctgccattgtttgtgctttgttgttttgttgttcatccgtgctcggcctttggtgtcggcttctcacctttatcatctgcttgcagaccctcatgagggtgtagtctagctctgggtccatcatctctgtctcctgcagcttaaatactttttggtggcagcgggtgcttagctgcttcttgttttctttcagacattcgataatctatggcaaaagagttatagtcaagttgagagatgtcagagactgctcatccatgtgttctgattgaaacattcagctccactgtgcctcccatttctttatccatttctcattcccaggcaatcggaatcaggatttccttaccaaagataaggatttacaaccttacagctgacagcaaacccaactagacaaaaactcaggatgactggcaggctgtgctccagcctaatggaaaagaaacacacccacgatttctggtttcttctgccttccagagctgctccttgtccacattcattttggagataggctctctgcattttcccagagcaacagctccgactagacagtgggcacaaaccaggaggttcaattcaacccactatttaccacctgagaaagactactggatgctagatatgaatcagacccaattctcagcctgataaattcacagctacacagggcaaacttatgtaaacaagtaactatgattagaaaaagatgagttatcactcaaaatacaaaagcataaagtgtcatgaaatgaattttaaggtagtgaattaagtatatcctgaaatcttcccttccctaaaccttcagatatcatgaaaagaaagaaggaaagcagatgggaaggtgcagcagctggggctatcgcaggaagccatgagacttccgggaaatcgtcaaggcatggccaagaatcactaactagttgaggaacactaatatcataagaaagatgataaataaaatgaaccaaggagtcaaaaactgagggaaaggggtaatagagcaatcaaaacagaattttaaaatatacttaaaatcctcagaacaacacagaagacaacagtaaataagaatcaagaataggtagttatgaaaagaagcaatgagaaagctaggaaatgaaaaacaaaacttgattggtggtctcctggagcagaatggacaaagctgaagaataaattatatgctgggaaagagaactgaggagttacctaaaatgtagtacaaagaaatgaaaagtaccaaagaaaaagttaaagagacatggaagacggactcagatgctccaattgcctaacacgagttccagaaggaaggaaagggaaagcagtatgtgaaagagcaatgactgagaatgtcccagaactgaaggaacacatagattgtgagattgaaagagccaaccggaaacacacacaaaacaaaaaccatacctaaccacatcacactgaaactacagatcattacagacaaagagaagactctaaaacctatcagaaacagattaactacaaagcaatgagacttatattgacatcagactttgcatcagcaacagtctgatacaagaggacaatgaagtaattatctcaaaggctgaagccccatggcaatgcccttaactagaagaggtagccgagtagtaacgagaacatttttttaaaaatcatttgtttgtatgtacttcactcctgacaattctggatagggtcctgcttctgtctattaaaaaaaagtgtcctaggtgattctgatgtgacgtctagttaagaacttctgtgcaatgggaacacagtgaagtaacggttaattttggaggtgcagagcattgagaatgctacagaggaggaggcatctgaaggatcattaggagcttactaggcagacaaggtagggaaggatgaggtaacctgaaagagggaagaaaatgagttagagaggagtgcaggtgaagaacccaaggaaacgcagcctgatgtagtttaagaagggattaggttggaagggatgagatgggtcctgtctcaccagcaaaaaattcatgactaaaatgttaccttatgggcactagcttttgagaaaacattaaatattaccttcacattacttttacaattacaaaagaaaagcaaaaagttacctgagcgttgccatattgcacagcggaacagaagtttttgatgtcactcttgcaggcttcgtatagatctggctccaagcggatgtcctccgtctgcatgagggagccagcatggaaaggtgagcttggtttaggctggagatgtcatatgttctggagacttatttgttgactgcatcttgtctagtgaccctggcttctacatagcaaagtcgccttgcagcaagagaatcaggctttactttcaattctgtcaccaaatagctgcatggccttggaccttctttgcaaaacacaatgccaagtctaccctgaaacaccttatttagtccttcacaggactgctgagatgtgaaaatcactttggaaagtcaaaaccattatataaatgtagagttctacttttattattactttaatgaaagagctaggctcaaagttagggaaccaaatcttccagcttgaaatgtctttttttttttttttttttttttttttggagacagagtcttgctctgtcacccaggctggagtacagtggcaccatctcggctcactgcaaactccatctcccggttcaagtgattctcctgcctcagtctctcaagtagctgggattacaggtatgtgccaccacagctggctaaattttgtatttttagtagagatggggtgtcgccatgttggccaggctggtcttgaattacagacctcaagtgatttgaccgcatttgcctcccaaagtgctggaattacaggcatgagccacctcgctggcctaagtctcttttagtacaggcagggtttcatcacgttggccaggctggttttgaactcctgacctcaagcgatccacctgcctcggcctcccaaagtgctgggattacctgcatgagccacagcacccagcccctgaggacattactgatccagtgattggatcacatgcttagttagagcctgtcttacagctggacttccagttacatgtgggaagaaaggttttatcattcaaaatcaaaagaatgacacaggaagctaatggtcgtatgttaaaacttttgcacaggacttcaagtcttaaccatcacagtagtggataaaatgcctcccccttgccctagcctctccccagctttccaagccctggcccactgtggtttctgggagcagaggctgggaggcattaccatctccagctcctccacacggagctgcctgcggcacttcagggacaccctgtgctccttggcttcctgcagagtgtcattgcgcacggtcgtgctcaggcagatcaccacgtccaccctgcagacgaaagaagcttgaggctggctggggccacacaagggcagatggcctgagagctgggcttggggggggtcacaccattaagaattcaagatgccctttgggggaatgtctttcctgtaaggctcactgtattttttttcagggtgctaaaagctgcaatttgactgtgggtgtcatgaaaggcaggcagcagcatgaatgctgactacattcctgacagaaggggaagccacacagggcacatgtgtgcaacgacagttcaacatctgtgttaaaaacatgtgaccacagaggaatgctgctcttaactctaggactgtacttttgacctactgtgaaactcactcctgaaaggtagagaaacctgagcaaattgggaatttggtttgtatgagggcaagtgttctagaaatggtcctttcaaagagcaacatggaagaatttggacagtcacgctgaaaaagctcatcagtttcctcaaaaagacttaattcttaaatgaataaagattctgtttcttcactaaatatctaatccaatacaaaaactgctgcatcttagatgagatgacataacgggacgacgcagggaagaggtcagttcgcctctttcactcacactgcaccctgcttctctaagtacacaatccagccctacttggtcagttagatggcctgacctggaaaaattaaaaatgctcctttagcctatgggacctccatgtgagaactaccatcgccagatgctctgtccagacagtccgagtgtttgccacgctaatcaaaggagagatgcgggaggcctccagggctaaccccacgaggcagcaggagggctgcctaacatctcgcatactcattccggagctaagaggaacttcgggaaagtggaatgaaacaactacaagctacatacttcttttttatgtttgggcaaagcttcaacacgtcctccttgcaggccattttaaacttgtaagaaaaccgaaaatccttcatctgcacctgaaaggtaaagagaaagaaagtcagaagttttgtggcaacttgtggtcagtagtggtagggcgcactttttcatatagctctcacaagcctgtttacaagaccctgcatggcttgacccacacgtgagacatcacgacctgctcatctctccagtactccccctacaacaggcaggcttccttccttccttccctccctccctccttccttcctttccttccttccttccctccctccctccttccttcctttccttctttccttccctccttccttccttccctccttccttccttccctccctccttccttccttccctccctccttccatccatccatcctaaataaaaataggacatatatttgtaatttttttttttttttttttttgacagagcctctctcttgtcatccaggctggagtgcagttgtgcgatctcggctcactgcaacctctgcctcccgggttcaagtgattctcctgcctcagtctcccgagtagctgggattacaggcacccgccatcacgccaggctaattttgtattttttgtagagacagggtttcaccatgttagccaggttggtctcgagttcctgacctcaggtgatcagcctgccacagcctcccaaagtgctggaattacaggcgtgagccaccatgcccggctggaaaaaatgatttttttgttgttgctgttgagatggaatcttgctctgttgcccaggctggagcgcagtggcgatctcggctcactacaacctccgcctcccaggttcaagcaattctcctgcctcagcctttgaaacagctgggattacaggtgtgtgccaccatgcctggctaattttgtattttcagtagagacggagtttcaccatgttgctcaggttggtcttgaactcctggcctcaagtgatccacccacctcagcctcccaaagtgctgggattacaggtgtgagccaccacgcctggctggaaaaaaatgacttttaacagaacatcagaggtgctctgatgttccaaaaaaggaaaggattcagtcaacatccaggcagctatgatgggatattggcagccaggtgtcactgaccagctggaagtgggtaactccgatggcacacttctcgttcatgtccttctggtgtttgttctgtatcagacactccatcaggtccccagagtctatctggttatctgccacatcctggggaagacagcatgcatttacacttcattggtaacaattaatgaacaaaacttgtagcccagtccgaaacaaatgcaagcaaggttagttctagaagccctcacaaaaaaaagacacaccataaattgtaatcaaaataagcctgaagaatcacaatggtatacattcagtggcataaaactaacacagcactgtgttccgtataagacatgatatacgctttttttttcactttccgaaaagcagctggcttttgggacaatatctaacatagcctcccaactgtcagatcctaatggttcctgggtatgtttcactcccacaatttaaatagttcagtaaatgaatatgaaatagtcagaattcactcaatattgaggtactaggagacagttggaagaaggagccactattactgctaacaattcctgggcagatgctaacaattcctaggctgatgtactggaatcaaccctgcatactaatgggggtttccctgttccatctcttcttaaaaagggcaactcagtaactgctgctggccacatacctgtttttacctacaaaagctaatcaaacacaggttccaggatggtagcatctctctctcgatcttgtttactttttcttttttagacagggtctcactctgttgcttaggctggagtgcagtggcacaatcacggctcactgcagcctcgacctcctgagctcaagtgatcctcccacctctgccccctaggtaactggaactacaggtgtgtaccaccacgcccagctaattttttctattttttgtagagacagagttttgccatgttgcccaggctggtcttgaaatcctgggctcaagtgctcctccttggcttcaaagtgctgggattacaggtattggtcaccacacccggcctgtttacatttttaattttaacttgtcaaagctggctaacactcaagagtaatacatgctgcagacagaggtgagtctgagatactcaggggagagtccctgtcaatttgtttctgtttttaacccttgctcctccagacatcacttacgtggcagaagttctgaattatgggctcacaggctctcatcagcaaggcttctatttgaatatcctgtagaaaattaaatatattaatacttctgctttagaaagagccagggtggaggaggagcagtttctctttctgaatcagtaatatctgatgggcaaataatctaatacatacttttggaaacgattctagtatttgaagtagatagccccagaataaatatagaactgctcctccgttatactttgaaaggcaaatttttaaagacatattccctttcggcctgaacaaatgagaaggcagaattaagaaaagtgaggtaaaaacacatgtagcaataacattagagtatgcaaagcctttgcagattttcccaaaatgctaagtagttcaaaatgaaaacaggggtaactgatatccatcttcagtttataagctcataagccagagcactgccctcaaagcagatgccaaaccactgttactggggaacacatactaataatgcctttaaagagagaaacccgtgcaacactagctcctgaaaaaacaccttcctttaaagagctatacacccagactgctctcataagtccatgatgacaatgataatgtgagagatgacgacgaaatgagagaaggcaatgaacttctgaaaactagaaagcaaaaaagaactggttgagaaacgtaattttacattatgacaattcaaatagagtactaaaaggtttaagacaaaatggtagttccccacttctctgatttctggccccacaaaataactttaacatgtttagctgccctcctctgtatttctaaataacatcccagtgctttatgagggtttctaatccccctttttttttttctttttattgagacggagtctggctctgtggcccaggcgggagtgcaatggtgcaatctcggctcactgcaacctccgcctcccgggttcaagtgatcctcctgcctcagcctcccaagtacctggcactacaggcatgttttaccacgcccagctaatttttgtatttttagtagaaacggggtttcaccatgttggccaggatggtcttgaccttttttttttttttttttgagacatagagtctcgctctgttgctcgggctggagtgcagtggcgtgatctcggctcactggaagctccgcctcccgggttcacgccactctcctgcctcagcctcccgagtagctgggactacaggcacccgccaccacacctgactaatttttttgtatttttagtacagacggggtttcaccgtgttagccaggatggtctcgatctcctgaccttgtgatccgcccgcctcgcctcccaaagtgctgggattacaggtgtgagccactgcacctggcctctaatcccatttttaaaatattttagtgggtttcaggatggaacagggataaacatacgtattcaatcttccatgcttagctggaagtcctcagcttttatgttctgaaacacacaaacattaccaaatgacctaactaaaagagcgagggatgagagaacgggaatgtgtagattgctcttgaatgtgactgtgatgtgaagtactgctgctattttttttttttttttgaaacacagtctcccactctgttgcccaggctggagtacagtggcgcaatctaggcttactgcaacctccgcctcccgggttcaagtgattctcctgcctcagcctcccaagtacgtggcactacaggcgtgtttcaccacacccagctaatttttgtatttttagtagagacggggtttcactatgtttggcaagctggtctcgaactcctgacctcgagatccgcctgcctcggcctctcaaagtgctgggattcaaggcgtgagccaccgctcccggccgtacagctgctatcttaagggagaaacagaggcaagtctaatgactatgataaacctaatttatgaagaaaaccaaagggctgtatagagtgttgttctagagaaatgagggaaggagctcacaaagcaacacaatatacttctttataaagcaaacatggaaaatttgatcaggtttcttttgattgacagaaaatctgcactctcaggagtctagaaacagtagaatcaaacacaaaaggccaggatgctggcagccactctcctccaatgagtaagctgcataccacttacctctgattctaactcagtgaggttgccaactatatctctacactccaccaccaagtcatccagatggtcctgaaggcactccagctcctgcaaatataaaggcaagccactggcatttatcagtcacatacatgaacaaggcaaggggagatatcagcgtcatgacacttcccttttcagtggtcctcctttctcttctttttaaaattacctcactgaacaggacacaaaagctttgtttaattccccagactgagattgttgaaaagataattacttcatgtagcaggttggttatgagggccaagtgggcacaagagccatgcaaaggctgggcatgatggctcacacctttgatcccagcactttgggaggctgaagtgggcagatcacctggggtcaggagttcgagaccagcctggccaacacagtgaaaccccatccctactaaaaatacaaaaattacccgggtgtggtggtgggtgcctgtaatcccagcaactcaggaggctaaggcaggagaattgcttgaacccaggaggcgggggctgcagtaagccaggatcgtgccactgcactgcagcctgggcaacaagagtgaaactccgtctcaaaaaaaaaaaaaaaaaaaaaaaagagctgtgcaaatccctcagaagaccaaatctacaagtgcaaggagaatcaatcttcaagtgtcctcaaagtctaaaaaccttatcaggccttgattctattttcaatctgtgctttgataatttctcatctctcattttaaatatgcactttaataatgatcatcagacaaattcacagtgaagagcacagattattttaagactctttattggcaaagtaattgggaaccaggggtctggaacacaggatacaactgatagctcctgcaagtcagatctgggattctaactccagtacacatcaaaagggtcctctgaagaaaaacaagtgaacacactagggtttgggtacttaaaagctatcttgtgtgggctttggaaaccgagctggagctatctgtagcattagtctattactattccttctagaggtttacaggtttagaggtttcaagtataatatcagctcactttcacaaagcatatcaacagctatttcttagcaaagtgctctgttaaaggatcaagtttaacttactattctgcaagaatctctctgtttcagaattagaatgtgaggggaagagaggagttgtaggaattatacaacagccagaatggaagaagaagaagaaataaaaaagctaaaggaaaataccccaaacttttgggagtaaaataaatggctaagagaaacatcctattaatagaatcctggctggtctcagtggctcacacctgtaatcctagcactttgggaggccaagacaggtggattgcctgagctcaggagttagagaccagcatgggtaacatggtgaaaccctgtctctactaaaatacaaaaaatcaggtgggtgtggtggcaggtgcctgtaatcccagttactaaggagtctggggcacaagaattgcttgaacccgggaggcagaggttgcagtgagccgagatcgtgccactgcactccagcatgggtgacaaagtgaaactgtctcaaaataaaaaaaaaaaagaattcttaagtttagcttctccatgacgggctgcaatgtagtgcagctttctaaagtttactttactcggggttctaaaggaaactattttctgggattccaaatcaccatatcccttgtttcattggacagaggcaacagaaagctcaactataagcattttctaacaatatacccaacagaactgtagcaggctcaggaaacagactgctgaacatgatagtcctatgctcaacagacctgagtaggcaaccatgtttctcctttaaaatgtccaattcctgtacgtgtgactttttcatactgtacttccagagggggttttgtagtggtacaaatggaacccagaaacctgagttcactccttatttatgtggctttaaacacgcagtattcctactgctgagtatcctgcattcagatggaagacagctagcttcccacatgacctgcagtcatgcatctttccttctttcccttaaactgggacacaatcctaaggagccaatcacagcactcagggaatttttgggggctgctccttccctctgcttcctagatggagaggctatataatgaactgaactgaattttaggtaagggaatgtatacacttaacttctctgagcttcaatttgtcaaccaggtgagaaaaaattccatttctacatgttttttgggactgttctagggcatgcccactattcatgcagaccagtactcacatacgcacagatttacaccctgcttatctcaaaaggacttaatggagaaaatgaattaaaaatgagtaaaatgaataaagaagagaaacaaaaaggaaaggaaagaggatgtgaaatggagccagtagtaagctttctacaaaaatgcctaccatgaaatcttatatacctgtaagaggcaggccataccattggctctagaagttttaataagcaacaggaagagggaaaataatcaattacaaaatacaataactataatgcaaacacaaactcactgccaactattcctgatacaaagaccagagagaaaattttcctgagaatttcttccagagaaaatattgaacaatacaacaaatcacatctgtaaggtaaagagagatggattttatggtgtttgtactctgcataaaatgttaaacattaacatcatcattattgtaagacaaacagaaagcgatgtcacctacctgtccagtctctgttttctcactgcaccattttcccagatcaatcaggcacttatcctggagggcaggatccagcttgacatccatggcacgctggtgtaggatcctttggacttcagctcggcactcccgtgagagctgcatgagaaaaaatgagctaaatacttgaaaggtaacaaaacaaaaacacaaagatatgagataaacctgctatgaggaaactaacaaataaccctgtattttatctcccaaattttatacctcaaatatcttccagaataaaaattaaatgttgcggccaggtgcggtggctcacgcatgtaatcccagcactttgggaggtcgaggcgggcggatcacctgaggtcgggagtttgagaccagcctgacctacatggagaaaccctgtctctactaaacacacaaaattagccaggcatggtggcacatgcctgtaatcctagctactcgggaggctgaggcagaagaatcgcttgaacccgggaggtggacattgtggtgagctgagattgcactactgcactccagcctgggcaacaagagcgaaactccgtctcaaaaaaataaataaataaataaataaataaataaataaataaaatgtgcaagaggcttcgaaaagcccatatctttagcaatgcgattatacatattcagcagtttctaatatactatataaacaacattcttttatgacagtatcctgataaaagtgaactggcttcattcagactaggttagttggaaagttttgtgtttgttgttttgcttagcaaaactaatgtgtcagtctatgaacaccaggtagaaggtcagatccaattcaagagagcatatacacttgactcaggagaaatgagttcaaattgacctaaatcagaaaaagcaggaaaatgtagatataacattatgagataggactggactcttctagatgagctatgaagaattagcagagggtaaagcaggtgaaaactagtatttttccaagggccatgacaaagctgttattgacagatacagttagtctctcttgcaaaaaaagaaaaaaaagccagcatacctggggcaggagggatggaaagtaactgtttaatgaacacagggtttccttttggagtcatggagtgttttgaaactagacagacatgatgaccacacaacactgtaaatgtactaaatgtcactgaatttttctctttaaaatggttaagaccaggagcggtggctcacacctgtaatcccagctctttgggaggctgaggcgggcagatcacctgaggtctggagttcgagaccagcctgaccaatatggagaaaccccatctctactaaaaatacaaaaattagccgggcgtagtggcgcatgcctgtaatcccagctaatctggagggtgaggcaggaggcggagattgtggtgagccgagatcacaccactgcactccagcctgggccaacaagagtgaaactccgtctcaaaaaaaaaaaaaaggggggggttattttggccaggcgcagtggctcacacctctaatcccagcactttgggaggcccaggtgagtggatcacctgaggtcaggagttcaagaccaacctggccaacatggagaaaccccgtctctattaaaaatccaaaaaaaaaaaaaaaaaaaaaaaaaaagccaggcatgacggcaggcacccgtaatcccagctactcgggaggctgaggcaggagaatcacttgagccaggaggaagaggttgcagtgagccaagatcacaccactgcactccagcctggggtgcagtgagacacattcaagagtgaggctttgtctcaaaaaaaaaaaaaaaaaaggttaattttatgttatgtgaatttcacctcaatttaaaaaaaaaaagaaaagaaaaccagcaccacagactccaactctttcttatttaaaagagaataaacctcctaccccctagtcactatagtgaccagaaagatgccgggatgtgggagcccccatggttaatgagaggctcattatatggagagaaaaaaaaaaaaaaaacaaattcccacgttttctcacacagcagtataaacactgggttagggagcagcaactgatgtatgccatttccttctgagtcccctcattctggatttgagatagccaggcttttgcattaagctcagaaggggtatttctaaggatggatgagaagtgataccatctcaactctccggaacaaaggcaggactgataatggagcatctcagaaggtagagaaagccatcgtggagaacaagtgcatgtcagtgcgcaccgggaagcagccgatgctgccgagaccccagcacacacaaacatcccaacaaaaagcagcagttggggcagacaaataccaagagactgaggtatggaggtttctgctccaaccagtccatgggcagacaatgcaaatgtgttcagctgccaagaggagaagcctaaaatccatttgtagcctggctaaaagcttctaatggatccttaaacctaaataaagttaggacagcagaatttaactgtccatttgtgattcagattttgggaattaaaaaaaaaaatctggaaatcttcccccacccactttgttaaaaacataaaatcagatgatagaagctggtagggcaactctaagtgcactcacggaaggaagaagtttctagaagtgcagcaatcttctccccacaaaatagtctaaaaagttttcctaatatgactgaaatcagaagaatatacagcaaacaatttaaaaaacaaatgacaagaagaagaaatgaagtcgatattcactgcataccctccttccctgttcctcagtgcggtaggcgtgtctgtataaacaagagaacacagctccctgaggcataaattcactggtctcattccaaccgtgggtgtggcaaagacgagaagcgtctccctggcacttgcggtacaggacagggtccagcctataaggttaagagttaaaagataaccactaattaatagacatttccttctaacacaggctcagggtttttatgaggtgtttgcttgtatactcattgataatcacttccaggggcgtggagacagaagatatgtaaaagtatattcctgaattttgttcttttgttttttttttttgacacaggatctctcaatctgtcacccaggctggagtgcagtggtgctatcttgactcactggaacctccgtcccccggggcttgaaggcaatcctcccacctcagcctcccaagcagttgaggcaacaggcacacaccaggctcttttttgatatttttggtagaacagagtctcgccatgttgtccaggcaggtctcaaactcctgagctcaagcaatcagcctgccttggcctctcaaagtgctgggattacaggcataaggcactgcacccagccgtgaattttgttcttaatgaacacacagtagtcagcactgtgggaggcctaggcaggagaataactttctatagaagtttgttaaccttctacagaagatttaaagtctctctcaaagatatcttggctttgttagatacctaacattttaatagacagcactcacatgccctgggtgaaaacagaaaactagagttatagccaccaccaggcaattcacaactttttacttaatactttttactaaatacctttttctaagtaggaatgaagttcaatcctatgtaatgtattagattcagtaagatcaggaaatggcaagataaatagtctcctattcagttttctctcttcttcctgtgccaggtaaggtggttatctttttggttacttgagtgtgcttatcaatttatgagacttgacatttaactctgaatctggagacagtggattagacaatgagcctgcttcttctccacatcagaccagggcatgcttaattctgtccatattatattgtcaactttggtagatggctagttaatgggagaaaaaagctaatatttaatgagtaactattaagaactaatatttaatgagtaactatgcagcacttttttttttattatgggggaaggaattaaagaggagaaaacgtgattttgattaaggcaatacactcagtagactatttaggttgagatggcctgagtaagcaaagggaaattacagcccagctttctgtagtcctttccagagctaatctgaaggaatagaaataagaatatattgaatcttcaagtaatctctttctagaaaaagtatgtgggcaaaacacatgcacacacacacgtcttttgagatagggtctcaccgttaacatgcagtggcatgatcacagctcactgtaacctacagctcctgggctcaagtgaatctccttttttttttgagacggagtctcgctctgtctcccaggctggagggcagtggcgcgatatcggctcagggcaacctccgcctcccgggttttacaccattctcctgcctcagcctcccgagtagctgggactacaggcatgcaccacctacgcccggctaattttttttgtatttttagtagagatggggtttcaccgtgttagccaggatggtctcgaactcctgcccttgttctcctcccacctcggactcccaaagtgctgggattacaggcgtgagccaccgcgcccggttcaagtgaatctcctgcttcagcctctcaggtagctaggactacaggtgcacactaccatacctggctgatttttttttagtttttatagagacaaggtcttgctatgttgaccaggctggccttaaactcctggcctcaagctatccccctgcctaggcctcccaaactgctgggattataggtgtgagccactgtgcctggccaaaatatatattaatcaccaaaaaaaattaactaccacaccatggtggcttaacaaccgaatggagaagccactgaacttgaaaagctagagaagcagttggatccagcactggctgctttggaggtggggagagaaagcaagatgcggaaagaggaggggaatgacagccaatgaactcagtgattctggctgtaatacggatccttctcctagttcatcctcccacccccaccgctttttgttaacagaatgagagggaaattagataatcaagttgtcacttattgacaaaaaccccttaagacagacttaattcagtaactctgaataaataaataaaagccaattaccatatccactgcaaatcaataaaaatacaactgcactattatcttcttagagacatatctgaaggcgcttttgccacccccacaggtgccatacttcttactagacagatctttgtagtatcagaaacattttgaccctgacttccaaagtcgtggtgaacaaggatgtgtggtacaggctggtagtgggctgactctgcttttagataatgttctgaaagtgataaagaatagtttttcaggggattggagtgtgttagctgtcccagaactgaacaaaaagagtttcctactgattattttaataaatacaggtaattatgactacacaggagaagaggctgaggcaatacatttactttggcttcaaaatactcacttccaatcccgggagatgaaatactgcagctctaagagacggtgttcacagtcttctaccatcttctctgtgtataaatgttccatcaggcacgacaagatcctagccattaaatgtgtaaaattgtaacaagagagaagtgttcagaactctatgtcaatatagtatttccctggtctgtagaaggcggcttttagttattttcttagggcaatcagatttatttttctaagaatcactcaaattaactgaacctgacagtggttataccttcgatcaacttcagagccactcagcactgaagactatgcatgcacaagggcagtgtgcagctgctgtatttttaactggttatgaaaactttccaacacacaaagaagtagagaataatgtaacagccaccttccctccccataactttatcaatctgtggccaagtctgttttaactctaggcctctttgctgatattttaaagcaaaatcccagatactccatcatttcatttgtaaatatttcagcatgtttctttaaaatataaggacttaataccattatcacaccactaagcaattattttaaaagctttactatcatgtaataccctgttagttttcaaatattttcctttcttttcttttctttttttttttttgagatggagtctcgctctgtcgcccaggctggagtgcagtggcgcaaccttggctcacgcaagctccgcctcccaggttcacaccattctcctgcctcagcctcccgagtagctgggactacaggcacccaccaccacgcccggctaattttttttgtatttttagtagagatggggtttcactgtgttagccaggatggtctcgatctcctgacctcgtgatctgcccgcctcggcctcccaaagtgctgggattacaggcgtgagccaccgtgcccggcccagatattttcaattatctttttttttcacaagtttgttcaaatcaggatccagaaaaggttaactgataagtatcttaaatgtattttcatctgtagcagttcttccttcttccctctcccctgccccctctttgcttgatgtggttatttttacactgtaaatattcctaattagtttaaccacacagaaagctttgaggaagaatatgattttctaattctctagcacagcatgaacagcaggagttcttgcatagcagcatgagataaacatggactatactcactttgttgttgggtatggccaaatgcaggctataaagatttttgcagaatgggaaagctgctcttacttgcaactgtttttttttgtttttgtttttgttttttttgagatcgagttttcctcgttgcccaggctggaatgcaatggcacgatcttggcttcacctgcctcagactcccgagtaactgggattacaggtatgcgccaccaacaccccactaattttgtatttttggccgggcgtggtggctcacacctgtaatcccaacactttgggaggccgaggcgggtgggtcatgaggtcaggagttcaagaccagcctaaccaacatggtaaaaccctgtctctactaaaaacacaaaaattagctgggcatggtgtcatgtgcctgcaatcccagctactcgggaggctgagccaggagaactgcttgaactgggatccgggaggcagaggcagcactaagcgagattgcgccactgtactccagcctgggctacagagcaagattctgtctaaaaataaaaataaaaataaattgtatttttagtagagacggggtttctccatgttggttagaggctcatctcgaactctggacctcacgtgatccgccagcctcagcctcccaaggtgctgggattacaggtgtgagccaccacgcctggcttggtttggttttttgagacagggttttgctctgtcatctgggctggagtgcagtggtatgatcataactcactgtaaccttgaactcctgggctcaagcaatcttcccacatcaacctcccaaggggatgggactacaggcatgcaccaccacgccagctgattttaaaaacttttatgttgccttgctatattgcccaggctggtttcaaactcgtagcttcaagtgatcctctcacctcggcctcccaaagcactacaattacaggcatgagctactgcatccggccatggtttaagagctgtttttacatcataaaaaataaaactaaagaatgagaatactttaatatagcatttattcagcttttctagatcttggttgcaactttagtattcattttgtccattactactcccttcaactaccacattttgttttctatttctattttctgtttcaagtattttctgatgattaccaggtagtcaatgtatacaatgagtcaatatacaactaggatgaaaagtacagagtgccaaagtatgtaccacctatcctgagtgtttctctctttcattttaatttgatcgtgatataaaattattcagtaacctaatatataggtccatatatgctcagtcattgtccgtaaacaccatcacaatattgggtctaggtgtctctatatcatggatgaggcagatcctaggttttcattccaatactagttttaataaaagttggtgtatgttcaacttgttcaacaaaatttcagttaagatgtcaacaaccacccaaaagtcatttgaaggaatgttccctgtgctgccaaatgaaatacaatatggataaataccatggagaagataacttacattgggtctccagatcttatatgtttgcaggctgtctggattacagattcacaagcttcattcaaagctcgatcaatgcggtaatctgcaccagggtcagtctcctgaatcagtgtttgaagctgaattaaaataaattaagaaggaagaaagaaagtcacttaggtgctaggtaagagcagtgtcttcatacattcagttgctcagtcctatttaccacaatgtactccaataaagttgtctacagttgtcactagccaagctcaagagcatttgccaaatacttttccaactggtttctctaccttgactgcaggtttttctgtttgagtcattgatggggactgcttatctttgttctcagtaatccctggaggtctttacaacatgaatatgaaggctgcctctttgctttcatctgcctacttgttaatcagattactaaacctggtgctcccggcaaagccagatttaagtggaaaagagtaaataaagaacattttcacttagagacctaattgggtcataagaatctagaatttgaattttgctgcaaagacactggtattaagtcaagtgtgctgtgctttattaaaagcagatgtgcaatttcatttaacttgcagaaatatcaattacaaaaaacaggattatggtatttataatttcccattttcctcaactatttttctataaccaagaggtaaaccagagcttgctcattctaagtacatagaaaaatacttgtcattatgcagctggaaatgagactatattctttatcatttacttttccatcttgtcatggaacaaaggaaagacaggagaataggtacttcacattttttttcctgcctttaaggcacttggggcatagatgaaaaagctctaaattaaaatcaaaagaactgagttctattaatagttctggctctgacagattagctttgagaacatggacaaattgattacctctaagttttagtttctttaactgcagaaaattgtaagaaataataatatatgggagaatattaggtaaactgcaaagcattttacagacatgaaagatgattattactacagataagtagcagatggtgttttggggtagaaatcttttttttttcccccccgagacagagtttcgctctgtcacccaggctggagtgcagtggcatgatctctgctcactgcaacctccacttcccgggttcaagtgattctcctgcctcagcctcctaagtagctgggactacgggcatgtaccaccactcccggctaacttttgtatttttagtggggatgaggtttcgccacgttggccaggctggtcttgaactcaagtgatccgcccacctcgaactcccaaagtgctgggattacaggcgtaagccaccacacccagacctggggtagaaatctttaataatagaaagcgaatttgaaaactataatccttactggtttgcgttcccttttgccaagttaaaaaactggaaccctgttgtgtcactgatttgtcctctgatccttatacatctaacctatgatcccacagggccttcactggagcacctgtgggatcataggttagatcacaaatttatcagagaaccataatcaaaaggaaataaaggaaaaaaccacaaacttctattatcctgaaagaagctggtaatccagaagagagaaacatgaaagatttccaatattctacgatagaagttatttataccaaaaattattggtggcaatttgggaaacctacaaaatgctgtggttagctggtaggaaaattactatcgaatgattaccaatgttacttatgacatttgttgacaaagaccaaagcatttacatctttttctgagaaaagttggaagcaacatgggagtctgcaagtctctgcaagaactgtatcagttaaatatccatgactgacaggcaaacgtcaagaaacaatacatgcactagactgcaaatatttacaggcgaaaatgaatgccctctagagcctagtgggctaacagctccagggatcattatcattgccactctggaatttagtgacagtagcgtgggaaataaacactgaaaatgtgaactgctacatgattatacacctattccagcccctggcatgcctaggaaaacctgggaaaatgcttcagagagatgactagagaataagactggcagttatctttggcctaggagagcctgggcccacacttactcagccatgaacgaagagaatttcacagttcatgattatggtgcatttgggagagtaagtactgaacaagatgataattatgcttacgctttacagcttactacctgctgagaaatcactaaatcaatcaccaagcagagaacagggaaaactaatggtcaaccacagacaggtatggaagtctgctgtattaggaagaaaaatttgaaaaagaaagaaaaaaggggccaggaacagtggctcatgcctgtaatcccagcagtttgggaggccaaaacgggcagactgcttgagcccagtagtttgagaacagcctgggcaacacggcgagaccccatcacttaaaaaacaaaacaacaaaaaagaaataaaaataagctcccccaaaatgaattactttaaaacattcgtcaatttgactggggatggctactgtagtagaacactaaggacatttttctccctttggatcatttaggccttcaatttttgtgggcaaaagctaaaaaccctgggtccataaaaataaaaataaagcgcttcttccctacttggctaaatttattttttattttattttaatgttttaattttttattttttgaggtggagtcttgctctattgcccaggctggagtgcagtagtgtgatctcagcttactgtaacctctgcttcccaggttcaagcgattctcctacctcagcctcccgagtagctgggactacaggtgcatgccaccacgcccggctaatttcgtatttttcatagagactgagtttcaccatgttggccaggctggtcatgaactcctgacctcaagtgatctgcctgccttggcctcccaaagttctgggattacaggtgtgagccaccatgcccagcctcacttggctaaatttaatatgggcaaaaccatatgtttcactacttgaagccaccctctagatttggaaagtacttttcttctggacacacagggtgatgtgggaagtacttatgtatctttcaagctgagtcactagttctttcaacaagctacattttaaaaagccctgggtgtgaattaggtgcctcgaaataaagtcaaaccagtctattttcttttttctgtatcccttactacaagtgtagcctcagtaaaaagacaggtttaggccgggcatggtggcttacacctgtaatcccagcactttgggaggctgaggcgggaagatcacctgaggtccagagtttgagaccagcctagccaacatgatgaaaccccatctctactaaaaatacaaaaattagctgggtgtggtggtgggcaactgtaatcccagctactcaggaggttgaggcaggagaatcatttgaacccgggaggtggatgctgctatgagcagaggttgcgccattacactccagcctgggcaacaagagtgagactctgtctcaaaaaaaaaaaaggtaggttcattcctaacccccgccacaacaacctttctgtgctgctttaaggatgaagtgcaaatataggctgtctcctgattcatttttggtctgggtcccaggacccacactggcacagaggtttcccaaggaagtcaccagtaacaactgcaccctagaaacaacactgtggcaaaatcaaacggcagattccagaagccttccctcctgcccaggttggtattttaaagaagttacatttgtctgttttcccaccatgggatgcatagacacgcatgcgtgcgcacacacacacacagacacacgtgcacacatgcactggtgtctactctgggtcaaggtgagtaactaaagctaagacataattttactccacatccaaattctgtaaaactgttgtgtttcagaccgcaaagttttgtttcagactgtaaaaatctgattttacacgattatcaggaaaataaaattcgagttgatatccagtttttaataaaaatgctaactataaaataatagactgattgtggctttctaaagttacactgagggaggagagcctcaagtttctactattctaggatataaagcgaaactatctcttgtgctccccaaaggaaagttcactgcacagggcacactggtgcacatggtacgttaagttgctctaagactcctatccagtaaaaagtaatcaacatggacaacaggaatgaaagggatgtactaaatctctaatacattaacttgtgttttgtacctgacctacagttattcaactgtttataaacgctagatcaagaagaactttatctccccaagcaaagtatgctaactgtgaggtttagtgatagaaaaaggactcccaccatggcacacgtttacccatgtaacaaacctgcacatgtatcctggaacttaacattaaattaaattaaaaagaaaatggctcttccatgcatagttgccctagtatatgaagaaaagatagtgtgatttcaaaaatgacatgctctcttgatccttcaggccaggaattcatgccatgcggtaaattagtaacagaaaaaatttagaaacttagaaaaaatttcaattcatatcaactctttttcagcctcaactcaatcaaatctattacaacaggcaaattctctcttggtagagggcctgtcgtcattgattggaacctggtttgccttgattctgagtttaggaaatccagtctagcaagctgccctttctttaggaactctagcaaataatgcattctatctatctaagaagacaattctttttattgattatgagctcaaacttttgctctgtagcaaatgtcacattcttactaagatatgcctgaagaagcaacgttcagtctctgatcattagtacctaatgttcaatgtgataccacagatgatccatataaagcaaggtgggacagcatcaggaagaggctcttcagctgataaatgtgacattcaaaatggcaatagcaatgtctccttaccgcctgctggcagttcattccaaggttccccttctcccctcgaactactttcatcagacagtgtagggtccgcccttttcgatgtaatccggaacaatggtgttcaatctccccccgacagcttaggatgatctcagggctcagagaaaagtcttccatcaacatgcgtcggtaatccagcatctccccctggcactcactgctgacttgtcgccctaagttaggatgtaagtcataacattacgaagggtgatgctatgtattagcatcagaaatcaccacctattaaaagtacatatttctatctgtaatacaatatacctatcagacatgctaacatctgaaaagtttagaattagcaaaagctttagcagcataaaataggcttagactccagatattcaggcttctcctgtcactgttctgcatgaaacaggttttatactactgcactaataatgcaaatgctttgcccatggaaatcctatcaataagataactattagggtaaaaatgaaagccaaagaacaatctccattggcctacacaattaaagcttttagaaaagactacatttaagatattcactataagctcccccaacttctttgagctgtaaatgccaatggggaaaacttttttttttttttttttttgagacggagtctcactgtgtcacccaggctggagtgcagcgcgcgatctcggctcactgcaagctccgtctcttgggttcacgccattctcctgcctcagcctctccaagtagctgggactacaggcgcctgccaccacgcccggctaatttttttgtattttcagtagagacggggtttcaccgtggtctcgatctcctgacctcgtgatctgcctacctcggcctcccaaagtgctgggattacaagcgtgagccaccgcgcctggccaggaaaacttaaaacaaaaagattaaaacaaaacaaaacaaaacaaaaacaggtcacccagacggtttgtttagtgataaagccaaaatttgaagccaagtctgacccatgtgctaaatcatgctaccctgagtctcctcaaaatgttgcacaatgtgtatttcaaaaatgaaaactaggccaggcgcagtggctcacgcctgtaatcccagcactttgggaggccgaggcaggcagatcacgaggtcaggagatcgagactatcatggccaacatggtgaaatcccatctctactaaaaatacaaaaattagctgggcatagtggtgcgtgcctgtaatccaagctattccagaggctgaactagggagtcggaggtagcagtgagctgagattgtgccactgcactacagcctggtgacaaagcgagactctgtctcaaaaaaaaaaaaaagaaaagacaagaaaactattcagctgggcacagtggctcacgcctgtaatcctagcactctgggagctaaggtgggaggatcacgtgagggcaggagttttgagacccgggatgccaacgtggcaaaacctcatctctattaaaaaaaaaaaaaaattgctaggtgcggtggctcacacctataatccaagcactttgagaggccaaggtgggcggatcacctaagtttgggagttcgagaccagcctgaccaacatggtgaaaccccatctctactaaaaatacaagaattagccaggcgcagtggcactcgcctgtaatcccagctacttgggaggctgaggcaggagaatggcgtgaacacggaaggcggagcttgcagtgagccgagattgcgccactgccctccagcctgggcgacagagcgagagactccgtctcaagaaaaaaaaaaaaaaaagaaaaatactcaaagaagcaaatatgggaggaaactaacgtttatatatataaagctttagagtgtgaatccaaaaaggaacagaaatgataattaaaaaaaaaatatgaatgctacctctgtgtacagctgactccaggcacattaacaagtaggagagcctggcttcacgcgatcgcggaaggttttccacattgcaccggtatttcttcaagtcacttttacaggatttggccaatgaataactgactttataatcctgggcaatcagcttttggcgggttgtaagtgcttctcgacactgaggaaagagtacagcaacagccgtgagaccactcatgtaactttactgttgacgtgtaccactaagatgagcacagcgactcagccaagtacatgtcaacaactgcagttattaccaacatatctatctttaagtttggttaaaatgttcacaattgagctaaactagtgtggcatgagacaggggtaagtgggtggggaacctagaaattctgtagtcacttgctagttgttgctgcaatagcagctatccaaaacatgtaaatatctcacagatcccaatatgttaacttgacacacagcattcttttccactttaacaataccccgaacataaatttcactagcatcaaactggcaactaacataacatttgggatattctgttcaatgctttaaaatacaattattcaattattctatatcatctgaataataagatttgaataagattgttcaaatgatacaagaaaaaggaaatgagaaacatttcttcagctacacaggaaagtaaatgacaagatagcaaaattaattatttcaaaagccatcaactattcttgcattcattcagggacaaagaactaaaagaggatgcttaatgatatagctgctgaaaaattaaatagctaattgcctagaaagcacattgatttggttaacctaaacttcttgaggaggcagggctggccttagtgtggttttatataaaattctctgattttactccccaaacaaagtaatatctgagaattttatataaaatcacactgaggattttatataaaaccacagtgagaggcgggtggatcacctgaggtcaggagtttgagagcagcttggccaacatggtgaaaccccgtctctactaaaaatacaaaaattagctgggcgtgttgtcaggtgcctgtagtcatagctactagggaggctgaggcaggagacttgcttgaacccggcaggcagaggctacagtgagccgaatcatgccactgcaccccagcctgggtgacagagaaagactccactcaaaaaaaaacaaaaacaaaacaaaacaaaaacacctaaaaaaaccaccacagtgagaaccctacttggcttctcactatctagatatcacaatcagggtttcattttcttggtttcagccaaatatgcttaaaacccaagtacctcacctctgaaagcggtgagctttatcagtcatttacgtttcggtataagattataagaaatattgtttcagagaaattgagaaagctttttttttttttttttttttgagacagagtctcactctgtcacccaggctggagtgcagtggtgcgatctcagctcactgcaacctccacctcctgggttcaagtgattttcctgcttcagcctcccgagtagctgggattacaggcgcccaccaccacggccgactaatttttgtatttttagtagagacggcgtttcaccatcttggccaggctggtcttgaactcctgacctcgtgatccacctgcctcagcctcccaaagtgctgggattacaggcgtgagccaccgtgtctggctgagaaagcttttaaaaaacaaataaaacattcattagtttcaaaataatacttaccttttcactcatggattcttcaaatttatggttaaagaggcacttatacactctgccctcaccagcttgtgtctataagatggaacatacacattattattactttagctaaatagttatgctgaacattatccacaatctcatatagagctttctattaaacgattataatcgtacatacctttggacaaacagcgcttccatttataaaatttaataggcttttaacaaaaacagtgactgcagtaaagacgaaaaaaatattcccatgatatttggagtttgtcatttgttctcagatgtattttgttaattagggaaccaagagaagtgttagagtctgagtctttttttttttttttttttttgagatagagtcagtcttgctctgttgcccaggctggagtgcagtggcacaatcttagctcggtgcaacctctgcctcctgggttcaagcaattctcctgcctcagagccccaagtagctgggattacaggcccccgccaccctgcccaactaatttttttatttttagtagagatggggtttcaccatattggtcaggctggtctcgaactcctgacctcaagtgatctgcctgcctcggcctcccaaagtgctgggattacaggcgtgagccgccgcacccagcctctgagtcttctttcttacaagtgtatgctagagttaacgaaactcttacatcagtggctctgatggttaaagctgttaatgcaaaccagcaggcagagtggaagtgtacacaagttactttcagtactttgttgtaaggatggagagaccattctatttaaagacttagaaggctgttctgtagagtcagcaggtggtaatcaaggatttggttttaaagattagccacctgctgttttcttcaccttagccaaaaacacataaatatataatgcgtcaaagttttagccattgaatagatgtaaataagatcctgggtaaaataaaattcctatagataaaacagacttccaagaactgaaattgagaagtgagataaagcagaaaaaatactaagtggagatcattagaagccagctgttaaccaaatgttcagtcatcaaggttgagcatccagttaccactttctgctatactgggaccaatttcttcttccatttctgtggcttttctacatgtgaggtttcttgatggcttattttacgttagaatagagtattaaaaaatatttaagtcacagtggctcgtgcctataatcctagtactttcagagacagagggaggagatcacctcaggccaggggttcaagaccagtccgggcaatacagcaatgccccatctctacaaaaaatttttaaaaaaattggccaggcaagatggtgcttgcctatggttttagctacttgggaggctgaggcagaagaatcgcttgaacccagaagttggaggctgcagtgagccatgatcacaccactgcactccagcctgggcaccacagcaagatcctgtctcaaaaattggggaggctgagctggagcactgcttcaggtcagaagttcgtgaccagcctgggcaacatagcaagactcaatctctcaaaaaacaacacaattaaattaattaaaacaaaattatatatgtgtaaaaataaaaggaagaaaagaacagtttctgagctgactcacattttcacaaaaacgctcccgatcatctcggcaagcaaaatataaatgccggtctaagtgaaagtcatccgatgacagctcagccacccggagaatggctttcttgcagagttcagaaacttgaatcttgggttctctttcttctgcttctttcaccaggcctttctccaagcatgataccacctcaccttgtgaatgtgcatcctaaaatagcgaggatattaatattttaaaacttttatcacatgggtttcaaataaacaacatttggctacacacacacacacacacacacacacacacacacaaagtaataaaaccccatcatagagttgacttattaacgttctaccaagaaatcaagtaagaaccaaccacattgtggaagttaaagaaaatgctctcaataatcttcagttagaatataatacttgcatgctacaaatggaaacagagatcctggaaagtttaagtattatagtttagttagcactagaaataagaacctgaatttttaaaaatttaaaatgtcaaaaattcataagaaacacaacagggccaggcatggtggctcatgtctgtaatttcagcactttggaaggccgaggcaggtggatcacctgaggtcaggagttcgagaccagcctggccaacatggtgaaggcccatctgtactaaaaatactaaaaatacaaaaaattagccaggcatggtggtgtgcgcctgtaatcccagctactcaggaggctgaggcaggagaatcacttgaacccagtaggcggaggttgcagtgagccgagatcgtgccactgcactccagcctgggcgacaagacagaaactctgtaaaaaaaacacacacacacacacacacacaaaaaaccacatcggctcaaagttctggtcatagttcatgtcaagactgaaattacactgctgaaatctctgttcatttgtctctaaaaaccaggcatttcccaaataacagtgcttgctttttttttttttttttttttgagacggagtctcgctctttcgcccaggctggactgcagtggcgctatctcggctcactgcacgctcccactcccgggttcactctattctcctgcctcagtctcctgagtagctgggaccacaggcgcccgccaccacgcccggctaattttttgtgtttttaatagagacggggtttcaccgtgttagccaggatggtctcgatctcctgacctcgtgatccgcccgcctcggcctcccaaagtgctgggattactggcgtgagccactgcgcccggccaacagtgctttcagtcaagttaaaaaccaacaaaccacataatccactaagaagttagagactttcttgctcctttccctactctgtggtgtccacaaacatcccaatatgtagaatctgttgtttaatactcacgttgatgttctggatttatcttaatgggatttaacaagattaccactgtttacacaaaacgcttctgagagttttcttaaaaaccatccaattatctttaattgtacacttcatcatccccatagcaaccacaaacattcattcatgcaaaatatgagatagttcccctaaatattttctattcaagagtcctaatctatacttacaagatatgtttcaacaatttaaggtataaccactaatatagcaaaccaaagcatcttaaaatatagtgctattagcccggcacgatggctcatgcctgtaatcctagcactttgggaggccaaggtgggcggatcacgaggtcaagagttcaagaccagtctggccaacacagtgaaaccctgtctctactaaaaatacaaaatatcagctggatgtggtggtgtgcacctgtaatcccagctattcgggaagctgaggaaggagaatcgcttgaacccaggaggtagaggttgcagggagccgagattgcaccactgcactccagactgggaggtgcagtgcaaggctctgtctcaaaaaaaaaaaaaagtatatatatatatatatattatattttatatatatattttatatatagtgctatcatttatacacacgcaattaaaatcttgttataataaaatacctatctatgaaataatctgcatataataaaaagattctggccaggcgtggtggctcatgcctgtaatcccagcactttgggaggccgaggcgggtggatcatctgaggtcaggagttcgagaccagcctggccaacatggtgaaaccctgtctctactaaaaattcaaaaattaggtgggtgtggtgacacgtacctataaccccagctactcaggaagctgaggcgagagaattgcttgaatctgggaggcggaggttgcagtgagctgagttagtgccactgcactccagcatagacaacaagagtgaactccgtctcaggcaaaaaaaaaaaaaaaaaaaaagattcctaaaaccaagtagcgtaacatctacttcagacaaaatttcaaatcaaccaaagaatgtatttttttctattttaattaaaggatttgtctatagcaccttaatttccaagtgtttccatgaaagctttcgtgttatctcctaacacacatatgaagaaaggacacagctctgatatctactgcggacatgaatgaacagaggctcagaggagttaactaactcatttgagttgtagaacatgaagtgtctagctaacagtccattatttatttatggggttaatctgggtgagtgggtggagtctataaaactcctaaaacttgtttgttgttgttgtttaactttcatttttatttatttaagagacagggtcttgctctgttgcccaggctggagtgcagtggagggatcacagctcactgcagtcccaagctcctgggctcaagtgattctcctgactcagcctcccaagcagctgggactagaagcacacaccaccaccctcagctatggaacactgtgttttttactgtacctttcctatgtttatatgtacttatatacacaaatactatacttgtgttataaatgtctccagtatttcagcatagccacatgctgtacaggtttgtagcctaggagcaataggctatactacatagcctaggtgtgtagtaggctatactctatgatactcacacagtgatcaacttgcctaacaacacatttctcagaacgtgtcctggtattctcattgtatcctcatcgataagcaacgtgtgactaaatgtaactacactggcattaggtcataacaacacttctggctgggcacggtggctcacgcctgtaatcccagcgctttgggaggccgaggcaggtggatcacaaggtcaggagatagagaccatcctggctaacactgtgaaaccccgtctctactaaaaatacaaaaaattagccgggcatggtggcaggcacctgtagtcccagccactcaggaggctgaggcaggagaatggcatgaacctgggaggcggaacttgcagtgagccgagattgtgccactgcactccagcctgggcgacagagtgagactccgtctcaacaacaacaccaaaataaaaaaaaacaatacttctctactagatgtttccattcattgtaactttcagataaatatttttttcaaataagggtatttcaggagttcctcggagtctctgagcttttagtgcattggagtttataactgaaaggcatataaatatttgacagcgaagactgcatggttagttaccaaacattaattaaagtgaggtgaactacacacctgcacattatgagaaaataagctcatttaggtttaaaaagttattaatacacaggcttggcatatgagtaataaattatcctataaatgaacttacaataattttttgttaactttattatggtagaaaaacatctgcttaaaatctactgccattgccttgatccgtttttagaagtttgataggcagtatttttcttccccatattccgtgtcctttaacaacaacggcccccacaaaaaaaaacaaaaaaaaaaaccaacaacagatgctaacactaatctctaaatagtaggcgagaactcagtttttatctctgctataaaccattctctatttcaatccttctgctgtcttctgtaatctacctcactagataaaggaaaaaggaatattagaattactcaaattaactggttaaaagcaggaaataataaatgaaataataaataataaatgatacagctaccgagagaaaagcataaaagtactaatactgtggcacatgtccgcaattaagttcctttgttggcagccacagtctttttcttcagatgatgtaaatcatttatatctttacttttggaaatctgccctttcattttgacaacatttattattatataaaattctaaagcctttattaatgtatcttctttgttctaaaatttatattaacatttgaaaaaatcatagttttgaaatcatgacatttatgtgttcatacaaaggcaaggtacaaacagattaaccatgaatcctctcctcggtcctctggaggaggccaagtcaaagccagtcatagaagagtttcaagcttcagtggcagcaaatttgaaactgacaagcctgttgttttctgtgttcagaagctgctttgttaattttcagtataagttttctatctgaataactggcttcagaaaagcaaactacgggttttagaaaaaggcagagaagagctgagaacatgcctccctcttttttaaatttggctgtagtacagagtgaatgatataggaaggaaggtgttttttcagaagttcatgtgtgagtctatctcaccgtccccaaaatacaagaaagcctttgatgctggtgtagtgacctggtataaactgaaatttcacccaactggtagacatactgaaagattaaatgacaaaagtgtcatttctatctttagtccataggaacaatttttattattttatctaagtgaataaacaatcctgtcgtgccttttggctccagcagtactattttctgcaatcgtttcagtcactacagacttagtaactcatacatggaggtgacaattcagagagctagaaggaggctaatcagctgctaccttggtggttaccaggcaagaactactccacagagggactgaaacgcttggctttactgcatggagcactcatcacgagggtgaaaaagcctcatttctgattcctgaaaagtatgtttggaaccctgtggagactttaaaaggagccaggtttggaattggatataattttcaacatcctaaataaagtcagaagagcttcctgaatcatcagtgacttaagtgcttttgtgtcattttgagagtctgctgggaaggaaaacactgcgttctttattaaagctgtcctttctttatttgcctgaaagatttatgccaagccacagagtttttcaagaccaactcagtggtacactcggataagggatcaggccctgtgctcatattaaggaaagggcatcagggctttggtgacagccagacaatacacagcaagaaacccttcatttgaacggtgtgctcagttccaggatcctaacaccatgtcccctttgtcagtgatagacgcctgccaaccatgaacaaatagagggcaaagggacaaatgggttttattttccatcatatttcctgaacagtagattaatgagcagcagcaactaataggtgatgccacaggtctcagggtccctctcccactggcatccattacttttcaggagtttttttcatttttgctgagcaaacaaattcagaataaacctggccagatctctattgtgaccttctgttcagcagactaagtcaaaaaataagatcagatataactgtggaagaagaaactagctaggtagttattttctttcctgtctttactaaaatcagttcttctgagatgaagattaataatatatcacatttagagaggacttttcttccaactaactagaagtaccttcacatatcttaaaattttctgatattttatagatggacagcagccagtgtgctaagtaatttttttttttgttttttttgagacggagtctcactctgtctcccaggctggagtgcagtggcgcgatctcggctcactgcaagctccacttcctgggttcatgcctttcttctgcctcagcctcccaagtagctgggactacagacacctgccaccacgcccggctaattttgtttttggtttttttttttttttttttttgtatttttagtagagacggggtttcaccgtgttagccaggatggtcttgatctcctgacctcgtgatctgcccacctcagcctcccaaagtgttgggattacaggcatgagccaccgcgcccggccagtaattttttttatactaacagtgggacatatgcagagaaagattactgaacttggccgggaccggtggctcacgtctgtaatcccagcactttcggaggccgaggcgggcagatcacttgaggtcaggagttcaagatcagcctggccgacatggcgaaaccccagctctattaaaaatacaaaaattagccaggcgtggtggtgcatgcctgtagttccagctactcaggaggctgaggcaggagaatcacttgaacccaggaggctgaggctgcaatgagcggaaatcccaccactgtactccagcctgggaaacagagggagactctgtttcaaaaaaaaaatattagagaactcaggtctctcctttgccagaggcacattacaggtaaccagcagctggtctaatattgtgaagataacaccactctttgcaggtattaattcctctgcttcccatacagtactgaaaaattttgctacaaacacatgaaatacattgtcaaccagccttagctcttagggctgtctggacaagtttcttcaatttcaacttaaggtcactccagtcctaaatttttcccatgtcagttatacaaagcttttcatacaccaaattttaagacccctttgttgaagctaacgtagtattagataccttttctccaagccgaatactgccacatttcagaatgttgatgtcatttttgcagtcatccatgaagccacagattaaacggtaatcactaaaaatgatggccgtcatcttggtaatgtactggtgacactgatactcagtgatgttgcctcggtgatccaccaagcaggaaaccatgtaaccttttccaaccggttcatcagcacattctttaatctgctcaaaataaagtagctgttttacaaaagtgttccatgctcgtatcaaacaatatttatcaaagagaaaaatgtctgaaattttcctgttgatttcctaattctttacttggaagaaaaaaagaaaaatgcttagaaatatatccaaggaaaacatttaggaatacattcattttaaagaaaaatagtgtcatccctactcagactgttgtgccttctagaaaaacctgattaatgtgttttgcaaaagaatacctacatatcaaatgcttaggtaatgctcacttctaaatgcagtgaaaagagctgttaacatctacagctttggcatggtcctatgaagtccttgtaaccatgcaaaaaatgcaggagacagcgaggggatgaatctagggaggaagatttgacaaacaggtgcaaaagtgaagtccagctgcataccctaagccaagctacacagaaaactattattgttaggcaaacctaagggccaaggagagacaggagggaaggtgtaatattacttcttgacatgacattattattatttatcttttgaggcagagccttgctctgtcgcccaggctggagtggaatgacatgatctcggctcactgaaacccctggcacccaggttcaagtgattctcctgcctcagcttcctgagtagctaggattataggagctcacctccatgccaggctaatttttgtatttttagtagagacggagttttgtcatgttggccaggctggtctcgaactcctgaccccacgtgacccacccaccttggcttcccaaagtgctgggattataagcgtgagccacctcacctggcctacttcttgacatgacattaatgtgttctaaattaactatggattgaacatgtgtttttgaaatcagtagaatccaaacttaaccgctgtggtctgggacacatgtggtctgggaaacatgtttaaaataatgttcagtgcagtttagcaagaagtttgggaaggggaacctagtttggatggtttagacatatgatctagtggatcaggcacagagtgattctgcatggtggtgttcctgcaaagtgcattccaaaccacaaaatgctaataaagcaaactagcccccaaatgctgaaattcaggcaaaagtaaaacctaataatagaattataagcttaaattataaaacagagaagggtgtttggaaaagagcctattgcatttggggaaattaagacaaactgaagtggcaattctgacaagaggaaggagttaaatgggaatgtttattttgaatataaacaagaaacagtgctttatttgtcctttgaatgcaatagagagcattctccccattaggcctatctatcacaagcatgcccatagggcaaaacaaacacaatctcctcttccaaaaggtgctggatgaaggacacaccaccgaggaattatcctataggcaacaggttgtcttcacctctaactccagtatcaaatccagaccacgtaaataactcagttcagaaaagaaagttgtgtttacttctaaaggggcaaacttgggaatttagtaaataatagtctcacactggtttcagagacagcagagattttcaacagtcaagatgaatgaaattctttcagtttaaccccaagtaagtttttgtgatgcctaaaagagggccatggctgggcacggtggctcatgtccgtaatcccatcactttggaagaccgaggggggtggatcacttgaagttaggagtttgagaccagcctcgccaacatggcgaaaccccatctctactaaaaatacaaaaattggccaggtgcggtggctcatgcctgtaatcctagcactttgggaggctgaggcaggtggactgccggagctcaggagttcgagaccagcctgggcaacacggtgaaagcctgtctctaataaaatacaaaaaattagccaggtgtggcggcgtgcgcctgtagtcccagctacttggaaggctgaggcaggagaattgctagaacccggcaggcggaggttgcagtgagctgagattgagccattgcattccaccctgggcaacagagcgagactacttctctaaacaaataaacaaaaaacccaaaattagctgagtgtggtgccacgcatctgtagtcccagctacttgggaggctgaggcaggagaattgcttgaacccaggaggtggaggttgcagtgagccaagattgcaccactgcacttcagccccggtgacaatgagagactccatcttaaaaaaaaaaaaaaaaaaaaaagagggccaggactgtatttcctggaaaagatttttttttttttttttttttgccgaacaaaacagacttaagtttgaaaagtgaaaggaggaatagatgcttgaaaatcccagcacttgtaattcaaccacagaaaaacactggatacaaaacaagactagtggcagacacccacttaatgaaacagagaaacatttttccaggccctaatattgagcaaccaaaagttttaaaacatctcaagaggccaggagcggtggctcacacctgtaatcccggcactttgggaggcccaggcgggcggatcacgaggtcaggagactgagaccatcctggctaacacagtgaaaccccatctctactaaaaatacaaaaaaaaaattagccatgtgtggtagcaggtgcctgtagtcccagctacttgggaggctgaggcaggagaatggcatgaacctgggaggcggagcttgcagcgagcagagatcgcgccactgcactccagcctgggttacagagcaagactccgtctcaaaaaaaaaaaaaaaaaaaaaaactcaagagaaaccaggagcacattttgaactgtagcctcaataagaaactaaatgtaaattttagcttcaatcacttgagattttactgaaacagagatgtggcacctactcatttttcagctcactatccattacaacagggcgtggtgttagaatgagaagtttgcatgtttcttcattctgctggatagcactttttccttctatcttactaaacttctaagatgaacagcaaaaaaggggcactaaatcatcatcaacatatttaagaataggagtaaactctgaagtggctggggagcagattgaaaaggtaccatgagcaaaatgctgcagtcactctattttttgactggagccagaaggaaagcaggcaggatttagctcaatcctggagattaagtttggtttgtattaatagtttacaggtattcttgtgatgttgtttttctccctggaagtaggattccaaaattaagaaagatgatagaatgaaaatacagaatgaaatgttttgctggagactgtgttcttcctgatatttaatttccctgactccagtataatcttcctgtgggagggagaagtgtccttgttaatgctaatcttttacaaaactagaacaccccaaaaggtcacagaggaccatcgtgatacacacattatatggaaaccagcctaatgcaaagagtgaaattattctagtgaatatgtacatactcaactaaatttccctgggccaatcaaactggtatgtatttaatgggacacaaaatggggcaaaacaaacatatgcgggtatatatatatgtatctctccaatgtgttttttaaaaaaaaactacttatggccgggcacggtgactcatgcctgtaatcccagcactttgggaggttgaggtgggtggatcacatgaggtcaggatttgagaccagcctggccaacatggcaaaaccctgtctctactaaaaatacaaaaattagccagtcctggtggcatgtgcctgtaatcccagttacttgggaggctgaggcaggagaactgcttgaacccaggaggcagaggttgcagagagccaaggtggcaccactgcactccagcgtgggcgacagagcaagactccatctcaaaaaaaaaaatctacttacaattgtatagtaccacaatatagagggaaaatacaaacatttaaagttcaagcctaggaataatttgttagtatttagttcagttattaagcaaacatctttgcccttgatattttaaagttagaggtttagtcctatagctagctaagggagtttgagatgtagaatattaaagctaggagctaaagataaatttttcaacgatatgcctttctgctcggaagccccaaggtaaatatgaggggtcactgctttaaaagaataaaacataactgatctagtattagaaagtttgagaaaacaggttctacgagtccccataatgacacaaggaacacaggctgatggtttatctggatgagacagggtcttccttaagagctctgaagaatgtggccctgacttaattcatcaatagggccagcttgaggacaattagtatggtgtgagatctatgactgttaattctggggtggaaaaatagcaactgttttctctgtgattctcatatttcagtatgcagaaactctggcttcctggagtttctattattgattcaaaaaaaaaaaaaaccgttaaaaaaaaaagaaatttaaagtaccacaattttcactaatattatttgttgtttacactgggccaagataaataatttttaaaatcttaacctttttaacactaactcctattatttgaagtatatacctctgtgggtcaattgatccagctgcatagccaaaacaggaatgctgacagacctcctgtaaccaggctgatatgcttcagacacagcatgttgtccaatgtgtgagagtagcactgatacctcagcacttttacttgctgttttgagaccaatagaacctgatttccaactgcctcaatcaatagtatcctaatgtaagcgtaggtggacattaacaaaaagagtctaattacaccccccaacttcctaattttcaaccaagacagatgtgaattctaagaaaagtaatgtaactgagtcattcttctcataagggctggtctggtaattttctcctctaagccattagttgtctacaaaattctttgacaacttacctctgttatagtagatttgcaaacctctctggccacagattcaaatttgggatctgtagttaggttcagcttataattccacaacaactagataggagaggaaaaaaaaaaacaaagaaaaactccagttagaacagtacgaaatttattatcaacgttaaatgacaaaagccaattatacagagtcagacaaagcatattcacatcagataacaaacaaagtaggataaaatgccatcacattcctagataaaaggaaaaaaatgcaagccaaataaaaggatgactattcagatatatttttgtcgtttttactaaaggacaattttttttttttttttttttttttttgagacagagtttcactcttgttgcccaggctggagtgcaacggcgtgatcgtggctcactgcaacctccacctctcgggttcaagcgattcttaaatgacaatttttttagagctataaattaaaaaccattaaaaagtcaagaaaaaatgaaaaattaagatccttggtaaggttttcaaggaaaatataaataggttatatgagctaaattctgcttgaaccaaaaagtctaatccagaagctcagatttggtggattcagtctcagatctcacaatcaacagtgctttcatagatcggtttcatggaggagagtcgcccaggttctagtttctaggcatatttatcttcattcattcattcatttaaaaaaaaattgccaggcgcggtggctgacgcctgtaatcccagcactttgggaggcagaggcgggcggatcacgaggtcaggagatcgagaccatcctggctaacacagtgaaaccccgtttctactaaaaaatacaaaaaattagccggcgtggtggcaggcgcctgcagtcccagctactcgggagactgaggcaggagaacggcgtgaacaccgtaggcagaggttgcagtgagccgagatagcgccactgcactccaggatgggcaacagagcaagactctgtctcaaaaaaaaaaaaaaaaatttgtagagatgggatctcactgtgctgccaggctggtcttgaactcctggcctcaagcaattcccctgccttggcctcccaaagtgctgggattacaagtgcgagccagcatgcccagcctcttgattcccttaaaacacttgacacatacactataaggtctactttttttttttttttttgagacagagtttccctcttattgcccaggctgcagtgcaatggcgcgatctcggctcaccacaacctctgcctcccaggttcaagcaattctcctgcctcggcctcccgagtagctgggattacaggcatgtgccaccatgcctggctaattttgtatttttagtagagatggggtttctccatgttggtcaggctggtcttgaactcctgccctcaggtgatccacccaccttggcttcccaaagtgctggcattacaagagtgagccactgcacccagcccataaggtccactttatacaactgttttaacacatgttacactagaaaatatctaaagcctattcttgcagataatgactaaatattactttatttttgaagcttccataaaaatattttgataagtgatccaatttctgaaactaagcaaaaatgagccttaaattgttcagttggtgagatagagcagagacttgggatgatgtagaacatgaagatgtatgtatatattcatttttggaggggggtacattcctctctggctactatatactcctagacaaaaaaatacagtcatcaatcactgattcagttaaatatctgcttggcaatgcgtttcacagataggctattagaagaaacaagcaaatgtttactgagtacatactgtgttccagacacagtgttaggaactggtggataaaacataaggagaaggacaaagactgtccagtggcagctacagtcaatggcagggagtatgatcaagtaattggctaatggcatcactgggtaccacagcagtataggggaggaatattccaaactggggagggatggggagtttggtcagggaagatttaccatagaaaatgctaagatgaaacctgaaaggctagaagcagttagccagattcaagggtagggagaagacttttttaggcagatgacaccgcatccatggaagcaaggggtggagggaaccagaagtccaatggaggactgaccgaggagcctcaagccaggccagatcagaaagcctttgtaagccatgactgaactttaacccaagaataacggggaatcgcagaagagaaagtagggggtgacacgaccagatctgctttttagaaggacagaggcatataaaaagtacattagaaatgacatggaagcatgcagttaattctgtatgagtgctgaggaagatctgaagaaaacacaaaggatgggtaggatttcttctcctccctcctcaaaaacaaaaatatgagtaaaagctctcatctctcggctaccatcaataactgagtttttaggctgggcatggtggctcatgcctgtaatgccagcactttgggaggccaaggtaggtggataacctgaggtcaggagttcaagactggtctggctaacatggggaaacccggtctctactaaaaatataaaaattagccaggcgtggtggtgcatgcctgtaatcccagctactctggaggctgaggcaggagaataacttgaaccttttttttttaaaaaaaaaaaaaaaaagaaagaaagaaagaaagaaaagaaaagctttctggtatcacaaaaatttaggacaaacagtaacaaaagccagaaaaattaaaactataagcagaatatttccttactattttatcgaatgcaaagtcagatgtcctacaattgagctagaaatagattttccgccaacagacgtttagatgaccatttagattttttgaatgtcttcaccttttaatttgaaaacttacttgttctgacaggcataaatttccttatgaacaagtctcttccctaagaaccatgacagtattgtcaaatgctaaacattttactgtatctcatcttttttttgttcatttcaaattgatatataattcatataccataaaatttacctctctaaagtgtacaattcagtggttttttactttattcacaaggatgggcaacaaccaccattgcctaattatagaacattatcaccccaaacagaagcccacacccattctgtcacactttatcctctctaccctcatcttctggcaaccattaatctactttctggtcttttatttcttttttttttttttctcagacggagtcttgctctgtcacccaggctgaagtgcagtggcgcgatctcgactcactgaagcctccgcctgggtgacagagcgagaatccatattaaaaaaaaaaaaaaaaatttttgcccaggctagaagtacagtgatgcaagtgtgatctcggctcactgcaacctccgccccccgggttcaagcaattctcctgcctcagcctccgtactagctgggattacaggtgtgcgccaccacatccagctacatttttgaatttttagtagagatggggtttcaccatgttggccaggatggtctcgatctcctgacctcgtgatctgctggcttccagcctcccaaagtgctggaattacagacgtgagtcatcgcgcctggcctcaaatcttaagacatccatccatgaatctatctgttcatccatcccaaacgtgtaatgagtaactactataatctggacatccttctaggtaatggggatgagaaaggtgaaggaaggaaaaaaaaaaaaagaccattgtctcagcaagtcaagaagctcaaccacaggaggacaaaagaaggaagagtcaggttggaaagggaataaacaataaaaatatagtgtgataaatgtgataacaagcatgcaggagattttacagaacacaaaggaagaacacattttggtgagtggtaagaggagggacagggagtcttggtagcagtccagtcatcctgggcttgatcctcagggataagaagcaatttagtcagatgaactgacggagattgggcttctaagtgtacaaaagtagaaaggacacaaagaataaatgataacctatggaaacagagttcagaatagctggagttgaaggtatgaaagatgagatggggcgcaggggtcagatcacattgaataccgcagttcatattaaaggttttgaattttatcttaaaggaaatggaaggttaatggataattttgaccaaagaactcaaaagatcacatctgattacactggagaagggcaggatttagggaggttagtagaccaagaggcaagaacttatttgaatgaaaaaagatgggatatacttgagatacttagaataaagtaattacaggattagggtgtgggctaggggatgaagggaaaaatttccttcagtcaagctccttgaaaatatagtcagcctactgggagacacctcccagtaggggccaacagatatctcatacaggcaggtgcccctctgggacgaagcttccagaggaagaatcaggcagcaatatttgctgttctgcagcctccgctggtgatacccaggcaaacagggtctggaatggacttccagcaaactccaacagacctgcagctgaggggcctgtctcttagaaggaaaactaacaaacagaaaggaatagcatcaacatcaacatcaacaaaaaggacatccacaccaagaccccattcgtaggtcaccaacatcaaagaccaaaggtagaagatggggagaaaccagagcagaaaggctgaaaattccaaaaaccagaatgcctcttctccaaaggaacacaactcctcaccagcaagggaacaaaactggaaggagaacgaatttgacaagttgacagaagtaggcttcagaaggtcggtaataacaaacttctctgagcttaacgagcatgttctaacccatcaaaaggaagctaaaaaccttgaaaaaaggttagacaaatggctaactagaataaccagtgtagagaagagcttaaatgacctgatggagctgaaaaccacagtacgagaacttcgtgaagcatacgtaagcttcaatagtcgatttgatcaagcggaagaaatgatcagtgattgaagatcaaatgaatgaaataaagccagaagacaagattagataaaaaaagagtgaaaagaaacgaacaaaacctccaagaaatatggcactatgtgaaaagaccaaatctgcatttgattggtatacctgaaagtgacagggagaatggaaccaagttagaaaacaatcttcaggatattatccaggagaacttctccaacctagcaaggcaggccaacattcaaattcaggaaatacagagaacaccacaaagatactcatcaagaagagcaaccccaagacacataattgtcagattcaccaaggttgaaatgaaggcaaaaatgttaagggcagccagagagaaaggtcgggttacccacaaagggaagcccaacagactaacagcagatctctttgcagaaaccctacaagcaagacgagagtgggggccaatattcaacattcttaaagaaaagaattttcaacccagaatttcatatccagccaaactaagcttcataagtgaaggagaaataaaatactttacagacaagcaaatgctgagagcttctgtcaccaccaggcctgccttacaagaactcccgaaggaagcactaaacatggataggaacaaccggtaccagccactgcaaaaacatgccaaattgtaaagaccattgacactatgaagagactgcatcaattaacggtcgaaataaccagctagcatcataatgacaggatcaaattcacacataacaatattaaccttaaatgtaaatgggctaaatgccccagttaaaagacacaaactggcaaactgcatagagtcaagacccatcagtatgctgtattcaggagacgcatctcatgtgcaaagacacacataggctcaaaataaagggatgaaggaagatctaccaagcaaatggaaagcaaaagaaaaaaaaaagcaggggttgcaatcctggtctctgataaaacagactttaaaccaacaaagatcaaaagagacaaagaaagccattacataatggtaaagggatcaattcaacaagaagagctaactatcctaaatatatatgcacccaatacaggagcacccagattcataaagcaagttcttagagacctacaaagagacttagactctcacacaataataatgggagactttaacaccccaccatcaataatagacatatcaacgagacagaaaattaacaaggatatccaggacttgaactcagctctggagcgggcagacctaatagacatctacagaactctccaccccaaatcaacagaatatacattcttctcagcaccacattgcacttattctaaaatttatcacataattggaagtagaacactcctcaacaaatgtaaaagaggagaaatcacaacaaactgtctctcagaccacagtgcaatcaaagtagaactcaggattaaatatctcactcaaaaccgcacaactacatggaaactgaacaacctgctcctgaatgactactgggtaaataacgaaatgaaggcagggatagcattaggagatatacctaatgttaaatgacaagttaatgggtgcagcacaccaacatggcacatgtatacatatgtaactaacctacacgttgtgtacatgtaccctaaaacttaaagtataattttaaaaaatgtaaaggggctaaatgctccaattaaaagacacagattggcaaactggataaagagtcaagacccatcagtgtgctgtattcaggaaacccctctcacgtgcagagacacacatagtctcaaaataaagggatggaggaagatctaccaagcaaatggaaaacaaaaaaaggcaggggttgcaatcctagtctctgataaaacagactctaaacctaaaccaacaaagatcaaaagagacaaagaaagccattacataacggtaaagggatcaattcaacaagaagagctaactatcctaaacatatatgcacccaatacaggagcacccagattcataaagcaagttcttagagacctacaaagagacttagactctcacacaataataatgggagactttaacaccacactgtcaacattagacagatcaacgagacagaaagttaagaaggatatccaggaattgaactcagctctgcaccaagcagacctaatagacatctacagaactctccaccccagatcaacagaatatacattcttttcagcaccacaccacacctattccaaaactgaccacatagttggaagtaaagcactcctcagcaaatgtaaaagaacagaaattgtaacaaactgtctctcagaccacagtgcaatcaaactagaactcaggattaagaaactcactcaaacttgctcaactacatggaaactgaacaacctgctcctgaatgactactgggtacataacgaaatgaaggcagaaataaggatgttctttgaaaccaatgagaacaaagacacaacacaccagaatctctgggacacattcaaagcagtgtgtagagggaaatttacagcactaaatgcccacaagagaaagcaggaaagatctaaaattgacaccctaacatcataattaaaagaactagagaagcaagagcaaacaatttcaaaagctagcaaaagacaagaagtaactaagatcggagcagaactgaaggagacagagacacaaaaaacccttcaaaataaaccaatgaatccaggagctgtttttttgaaaagatcaacaaaatagatagactgctagcaagactaataaagaagagacaagaatcaaatagacacaataaaaaataataaaggggctatcaccaccgatcccacagaaatacaaactaccatcagaaaatactataaacacctctatgcaaataaactagaaaatctagaagaaatggataaattcctggacacatacaccctcccaagactaaaccaggaagaagttgaatctctgaatagactaataacaggttctgaaattgaggcaataattaatagcctatcaaccaaaaaaagtccaggaccaggtggactcacggccgaattctaccagaggtacaaagaggagctggtaccattccttctgaaactattccaatcaatagaaaaagagagaatcctccctaactcattttatgaggtcagcatcatcctgataccaaagcttggcacacaacaaaaaaagggaattttagaccaatatccctgatcaacatctagctgaaaatcctcaataaaatactggcaaaccaaatccagcagcacatcaaaaagcttatccaccaccatcaagttggcttcatccctgggatgcaaggctggttcaacatatgcaaatcaataaacgtaatccatcacataaacagaatcagtaataaaaaccacatgattatcacaatagatgcagaaaaggcctttgacaaacttcaacagccttgcaaactaaaaactctcaataaactcggtatcgatggaacatatcgcaacatactaagagctatttatgacaaacccacagccaatatcatactgaatgggcaaaaactagaagcattccctttgaaaaccagcaaaagacaaggatgccctctctcaccactcctattcaacatagtattggaagttcaggccagggcaatcaggcaagagaaagcaataaagggtattcaaataggaagagaagaagtcaaattgtccctctttgtagatgacatgactgtatatttagaaaagcccgtcatctcagcccaaaatctccttaagctgataagcaacttcagcaaagtctcaggatacaaaatcagtgtgtaaaaatcacaagcattcctataaatcaataacagacaaacagagagcccaatcatgagtgaactcccattcacaattgcttcaaaaataataaaatacctaggaatccaactcacaatggctgtgaaggacctcttcaaggagaactacaaaccactgctcaaggaaataagagaggacacaaacaaatgcaaaaacattccatgctcgtggatagaagaatcaatatcgtgaaaatggccttactacccaaagtaatttatagagtcaatgctatcctcatcaagctgccactgactttcttcacagaattggtaaaaacgactttaaacttcatatggagccaaaaaagagctagcatagccaagaaaatcttgggcaagaagcacaaagttggaggcatcatgctacccgacttcgaactatactacaaggctaaagtaaccaaaacagcgtggtactggtaccaaaacagatatacaggccaatggaacagaatggagtcctcaaaaatatcaccagatgtctaccaccatctgatctttgacaaacctgacacacgtaaacaatggggaaaagattccctatttaataaatggtgttgggaaaactggctagccatatgcagaaaactgaaactggacccgttccttacaccttatacaaaaataaactcaagatggatcaaaggcttaaacgtaagacctaggatgataaaaatcctagaagaaaacctgggctgtattaataccattcaggacataggcatgggcaaagcaatggcaccaaaagcaatggcaacaaaaaccaaaattgacatatgggatctaattcaactaaagagcttctgcacagcaaaagaaactatcatcagagtgaacaggcaacctacagaatgggagaacatttttgcaatctatccatgtgacaaagggctaatatccattaagtcaagaaacaacagatgctaaagaggttgtggaaaaatagcaatgcttttacactgttggtgggagtgtaaattagttcaaccattgtggaagacactgtgatgattcctcaaggatctagaactagaaataccatttgacccagcaatcccatcactaggcatatacctaaaggattataaatcattatatgataaagacacatgcacatgtatatttattgtggcactattcacaatagcaaagacttggaaccaacccaaatgtccatcaatgatagactggattaagaaaatgtggcacatatacactgtggaatactatgcagccataaaaaaggatgagttcatgtcttttgcagggacatggatgaagctggaaaccatcattctcagcaaactatcacaagatcagaaaaccaagcaccacatgttctcactcatacgtggtagttgaacaatgacaacacatggtcacagggaggggaacatcacacactggggccttttgggggtggggggctaggggagggataacattaggagaaatacctaatgtaggtgacaggttgatgggtgcagcaaagcaccatggcacatgtatacctatgtaacaaaactgtacgttctgcatatgtaacccataacttaaagtataataattaaaaaaaagtatagtacatacgattatgtgcaatacatacttgatattgataataaatgactatgttactggtttttgaaaaaaaaaaagaaaatttagtctatagctcgtttaatctacttcctcttttattcacccttaaaattttaagtcaaagctatgttgagtcaaacggttctataaagttagtttaaaaaatcaaaacaagaaattccctgtccaaagccccacccactccccagaagcgggcactttcaattctttttgcttacgttaattacctccatatttttaaactacatgcttaaactgtcatttcttgacttgtcacttttagatattctgtagtaacttacactataaaagatgaggaatgaattctcatacccatcttcctggtcccactcctccccatacagttaaatcatcatgttgttagatactcagtattcacattattgactatgtaaaaagttatatatactgagacacagaatattgtatttattttcctatacgacttttagtttgctctatagttaagtcacttatttcataggcctattttcctatacacccattattaattaatcctcaatctctttactagaaatgtaaatctcctctcaaaatgttctgctgtgtccagtgagacattcatcttgcagtcttttcattttcctgtttccatcagggactggctattttctctgtacatgcatcatccttctccagcatcctcagaatttcctttgcttttctctcaggctgattcattagtcactgggttcttaatctttctctgccttggtgtattccctcattttctttaagcacatcctccaggggctttatttaaaaacacgtggccggagacggtggctcacacctgtaatcctagcactttgggaggccgaggtgtgtggattacctgaggtcaggagttcaagaccagcctgaccaacatgtagaaaccctatctctactaagaatacaaaattagctgggcgtggtggcgcatgcctgtaatcccagctacttgggaggctgaggcaggagaatcgcttgaacccagggggcggtggttgcagtgagccaagatcacaccattgcactccagcccggacaacaagagcgaaactccatctcaaacgacaacaacaacaacaacaaatatgcatgagtcataaatgtttggaagaactgcatgccagaaatatctttatattactttgactggatatcatttttcggtaagcacttgtccactgtcttctagcttctaggaatgctaatgggaagtatattactcaaattgccactactttgattttgacctgggtttttcttctctctgaaagctttaaggtattttgtttattctcaggattgtgaaattttaccgacaggcagcagtgagcaaaaaggacaacagccttcaaggagtttacattctatgaaagagagaaagataaggcacaaattatcaagtaaatgtgtcaggtgataagctagggcaaggtgaattgaaagtaggggaatggggtactattttccataagagagtaagagaaggaaaatgaatagccacgaaagatgaatgttccatgtggaaagaatagcgaatgcaaaagtcccgagtcaggaacattttctgagtatctgaagaatagcaaggaggacactgtggcttaagtagaggtggcaaggggcaacggtcgtaggagaagaggtcagagagttggtatttgcacgcttgcagggcacaaagatttgggagtttaatcagtgagaaaaaagttttaggggtttttggacagagcagtaatatgaactaacatgatagagggatcattccagctgtaggatagactaagcaggagggagactgcttaggaggccaacacagaagtcccggagagacatgatgatgacttgtatcagggcaatagcagtgaaaatggccaaattcaggatatatttcaaggagcagccagaagattactaatggattgaatgtgaagtgtaagaggagaagaatcaaggtttctgatttgagcaaccagaagaatagaggagccactagtggggatggggaagactacaggaagagaaggtttaggggcagaaaaatcaagagtttcgttctggaaatgactattagacaaagtagaaatgtggaatcagcagctaaagtctgaggttctatggaaaggtctgggctgaaaaaagacaataacaacaaattgccaggaggacagcatcaactgtccctcctcaatgtaagtcctggcagcagttcatggagccatctggaggcattttctccccatggccgttgtgactattgtctagtcacaggggcatggaaaggaggtgccttggctcagaagcctcaggccccatgggaaccaatatcctttgtaacaacgctctgggcagagtttccagggtccctgcaaaggatacatccaggcttatgagtcaccacattcagcaaagcatgaaagtacggcatcccgattgggcatttataattcattaacagctcttcacagcccatctaaaatttaccaatcagggtcattttaattataaacaatgctgcctaggcatttagttgatattttgctctcattaggttaagggaaagggaaattaagaagttaatagaattcaaatacttatgaaaatgggaaaagggctttgctaaccttttactcatagggctgttgcgagctgctacaaatatttagcccttttgggcagatttacaagtatttgtgtagggtaaacacctagaagtaaaatggctgtatcatttgctatgctttagctaatactgccaagccagctttgaaagcactagctgtgctaactatcaccgttgttccacattcacacagatactcggtattggcactgtcaaggtactggtatctcactgagattttcattttcacgtccctgattactaagcgaagttaagcaccttttcattgtttttagttcattcagacgtcatctttgagacatggcagattaagtatcttacatatttttttttattccactggcttttctttgttgctctgtgtgacttctttacatattctggatacactgtcagacgtatgtattatcaatttttttacttttccatggtttgccagttcatactcttaatattgtatgcttgtttatttatttatttgagacaggaccttgctctgtcacccagcctggagtgcagtggcgtgaacatggctcactgcagcctgaagctcctgggctcaagcgatcctctcgcctcagtctccaaagtagctgggaccacaggcctgcatcaccacacccagctaatttttcatattttttgtagagacagagtttcaccatgttgctcaggctggtctcaaactctgggctcatgcagtcctctcactctggcctcccaaagtgctgggattacaggccagagccacggaacccagcaatactgtctttaatgaaacagatttttaagtaaccaatttatcagtctttttgctttatacttagtgctttttgtttcccaattaagaaaacttaaatttttaatttctgggtacatagtaggtgtatatatttatggagcacaagagatactttaaaagaggcacacaaccatttaagaaatctttgccaatctccaagtcatgaagatattttcctatttagaaattttactgttttacttttcacatttggatctgcagggcattcagaatggattttccatgaatggcatacattaagggttaagattctttattcaagtatccatttatgtatgaatctgcttctaccacactgccttaattaccgctgctttacggtaactcttccaccaggtagtacagtctctctgcttggttcttcaagatcgctttggctgttacaggtactctgtgtttccacataaattttaaaatcacgtggcaattttgctaacaataaatatgggattgcacagaatctatagtcaatgtaatgagcattcacattttttataacaccaagtcttccaactcatgagcacaactgctcatttatttatttaaaggccttcaaatttctcttaataatattttacacttatctgtagagtggtcttacacatttttgttagatttattcttaagtatttgatgctttacatgttactttaaaataatattaatttttaatatatttttaaaattggcttgttaataatatataaaagtacaattaaattttacatactgaccttctatcatgagactttactaagttcatctgttaagtacttgctggtccatttataaattcttttggattttctatttatataattacctcatctgtaaataatgacaatttatgattctgctgatagtgcattttaaaaaaaataataggccaggcgcggtggctcacgcctgtgtaatcccagcactttgggaggctgaggtgggcacatcacctgaggtcaggagtttgagactagcctggccaacatggtaaaaccccatctctactgaaaatacaaaaactagctgggtgtggtatgtgcctgtaatcccagcactcaggtggctgaggcaggagaatcacttgaacccaggaggtggagactgcagtgagccgagattgagccactacactccagcctgggtgacagagcgacacttcatctcaaaacaaaaaaaaagaataaaaaaaatgacagctcaattttttcctttttaattattacctgttttcttttttcttgccttactgcactggctaggacctctacgataataagtaactatgtcttgttgccaatcttgggtagaaagctgttaatatttcaccatgaagtacgatgcttgctgtaggcctttttatagacacgttttatcagattaaataaattcccttctagggtgggtgctaaaattggaaatttgaatgctaatttgatatttgatgatgttaaagaattatggtattttaagatatgacaacagtactatggtctttttttttttttaaagtccttatcctttagagtatttactgaaatattaacagatgacatgatatgatgtctcggttatgcttcaaatgaatacaaagggaggggaagtacataaggatataaatgacacagtaccaatctgaattaatatttgaagctgtatggtgattccatgggggctggttatactactctgttgagatagaatttacattgtaaaattcgcccttccagagcacaactcagaggttatggttgtacaatcatcaccactaattccagaatatttccccaaaagaaactctgtatctattagcagtcacctaccattccccacttctctgagttcctggaaaccactaaccttctttctgtctttgtgtcctttttgtgatcttttgagtccagttattgaggttcatccatgttgtaacatgtattagtacttcatttttttgcaaactgatatttcactgtatggccacatcatgttttatttatccattaatcagttaataggcatttgggctgtttccatttttgagcttttactaataatgctgctatgaacacttatgtacacatttttgtgtgaaaatgtgtcagctctcttgggtatacatctagcaggggaactcatgggtcatatagtaactctatttaactttctgaagaactgctaatctgtcttccacagtggctgcactatttcacattccaccagcaatttctctagactcacaccaacatttgttaattgtccacctttttgattacacccatccttcctaatgagcgtgaagtaatatctcattgtggttaggatacacatttcctttttttgtttgctttttaaagagacagggtctcactatgttgcccaggctgtggcatgatcataccaccgtgcctggctacatttttaaaattcttctttgtagagatagggggtctccgtatgttgcccaggttggtcttgaactcctggcctcaaactatcctccggtattaactttccaaactgctgggattaaaggtatgagccaccccacccagccctgcatttccttaatgacaatgatgttgagcatcttttcatgtgtaactggctatctgtatattttcttctgagaaatgcctattcaaatccattgcccgttttaaaatttgctttttattctagagttggaagagtttttgtatgatctcaatactagaccctttatcagatatatgatttgtaagtattttctctcattgtataggctgccattcaactttcttgatagtgtctgatgcacaaaagtttttaattgtgatgaagttcaagttatctggtcaggcgcagtggctcatgcctgtaatcccagcactttgggaggctgaggcaggcagatcacttgaggccaggagatggataccagcctgggccacagagcaagacccccatctctacaaaatagagacagagcaagactccatctcaaaaataaataaataaataaatagaagttattcaggctggccagatacccaaacaattttccgagagagaagtatcaattgaaaaatgaaaatagtatataagtaacaaacagttttaaagtaaaatataacttgtacataaaatataacataatggaaggtcattgtactctccaagggagaaagagaagacttgagagttggtgatggttggtaaaggcagggtatgagggaatcattctctggaaagtaatgtaaaatcagatgactgactatgaggcaggcattcagtatcagtatgaagacatattttatggtaattcttttccttagaactttggcacttagaaaaaactgatgtggaaagattcatgacattacctgtagatgaatctttgagatttaaaaaatacactttgggccgggtatagcagcttacacctgtagtcctaacactttgtgaggctgagaaggttggattgcttgagcccagaagttagaggtcagcctgggcaacaaagtgaaaccccatctctacaaaaaatacaaaaattagcagggcatggtggtgtgcatctgtagtcccagctactcaggaggctgaggtgggaggatcacttgagcctgggagactgaagctggagtgagccgtgatcacacaactacactccagcctgcgtgacagaccaagaccttgtctcaaaaagcaaaacaaaaccaacaccaaaaaccactttttgacatggagaaatactgtatgtgcaagacacactgaagaggaacagaagatgctacttgatcacttcctgctatcactcctttagcactcctaactatgaggtagaattcaaatttgttccatgtgatagtctgactagtgttgagtaagtcgctacacgcaaatttgcttagaacaataatgtctcagggcataatctgtgttttgggtaaagtgctatcaacctgtaagggtcatgatggctaaataccattaactgaacaatcattatgtgaaacaaatctgtatcctgattatacatccttaacttggtcacagtcgaaattgaattgatattatgctacctcatacacaatataagaatattccaaagtaaaattatatttttattcctacccaccctttgtgctactgttgtcatatattttattctacatgttataatctgaaagtatactgttattgttttggcttaagtcagttctttttttttttttttttttttgagatggagttttgctctttttgcccaggatggagtgcaatggcgctatctcggctcactgcaacctctacctcccagattcaagtgattctcacgccttggcctcctgagtagctgggattactggtgtgcaccaccacacccaactaatttttatatttttagtggagatggggtttcaccatgttggccaggctggtctcgaactcctgacctgaggtgatccacccacctcagcctcccaaagtgctgggattacaggcgtgagccaccacgcctggccaagtcagttatcttaaagcatgaaagaataatagtcatacgtatcaattatttttctcttctagtgctcctacttctctgcttcaatttgtgatccttttaccttcaagaatttaggatttctcacagtgtgcaaatgtgggagatgaatattctcagctttcgcttgtctgataacacctattttattttttttgagatagagtcttgctctgtcggccaggggtgagtgccgtggcgggatctcagctcactgcgacctcttcctccccagttcaagtgattcttatgcctcagcctcccaagtagatgggattacaggtgcggtggttaattctttttttttttttttttgagatggagtctcgttctgtcacccaggctgaagtgcagtggtgcagtctcggctcactgccagctccacctcccagggtcacaccattctcctgcctcagcctcccgagcagctgggactacagatgcccaccaccacacctggctagcttttttgtatttttagtagagatggggtttcaccgtgttagccaggatggtctcgatctcctgacctagtgatctgcctgctgggtttacaggcgtgagccacaaaacctggccatttttgtatttttaatagagacaggatttcaccatgttggccaggctggtcttcaactcctagcctcaagcgatctgcctgcctctacctcccaaaatgctgggattacaggggtgagccacggtgcctggcctattttcattttttaaaggggtattttttgctggatatagaattccatgttggcattttctctcagcattttacatttattgtttcatttgctctagtttctactgcttgctttgttgagaagccagctgtcattttccttccctcaagagaatgtctctttttctctgcctgcttgttgagttttctttttatcttttcgttttggcagattgttaataatgtgtctaggctaggtgtggtggctcacacctataatcccagtactttggcaagtcgaggcgggtggatcacctgaggtcaggagttcgagaccagcctgaccaacatggtgaaaccctgtccctactaaaaatacaaaagttagctgggcgtggttgtgggcacctgtaatcccagctactcaggaggctgaggcaggagaatcacttcaaccccagaggcggaagtttcagtgagccgagatcacaccattgcactgcagcctcagtgacagagcgagattctgtctcaaaaaaaaaaaaaaaaaaaaaaaaattgttaggtgagtatggatttctcttgaggttcactaagttcgttgaatttatgggttaatgcctctcattagatttggaaaacatcttggccattatttcttcgaatactgcttctatcccattctgtctgccttttttttttttttgagacagaatctcgctctgttgcccaggctggagtgcagtggtacgatagtggttcactgcaacctccacctcccagattcaagcaattctcccgcctcagtctcttgagtagctgggattacaggcacctgccaccacacccagctgattttgtaatttttagtagatatggggttttttaccgtgttgaacaggctggtctcgaactcctgacctcaagtaatccacctgtcttgacctcccaaggtgctgggattacaggcgtgaaccaccgcacctggccatgaatctgtttttatgtccactaaagctgtcttttaaaactacccataagttcttaatttctgaaattacatttagtccaaaaatgtctaattgattttcttaataaagactaattctcggttgaaatacttcatattttcatccattttaattttcctctatttataggaaaatattttattttcctctattttatttataggaaaatattttattttcctctattttattagttatttgaagtccttgtctgctattaataattccaatatatgaattacctcttctctggatctctctctgttggctactttatctcttgatatcttcctgcttcttctcatatccagccatttctgatagcatgcgggacattatgaatggctatattatagaatttctgggttatataattgttctctaaagagtcctgactgcttcttacatagaccttccaccaaatctcctgttttttggatactatttgtcccccattttcagcagtatcgtatccttcctattccttggctctttgagagttcttttttttttttttttttttttgtgacggagtctcactctgtcacccagactggagggcagtggcacgatctcactgcaacttctatctccccggttcaagcgattttcctgtttcagactcctgagtagccaggattacaggggtgtgccacgacgcctggctaatttttttatttttagtagaggggtttcactatgttggccaggctggtctcaaactcccgacctcaggtgatccacccagccttccaaaattctgggattacaggtgtggactactgcgcccggctggctctttgagagttccaaggcacacatcaacttttttctgggtttctcttctgtcagattcagtctattgatggattttgaggttttcccctaatcctttgctttataaataatgccacaacaaatatccttttatagacacatctctatccattcttttaactatccataaattcatagaagtagaaatgctgggtcaaaacatatgcattttaggttgactgttttatagcttgtttttattcccatacataggcttgaacagggttcagccaacttcttctgcagagagccagaaagtaacagttctcagggaactgtagtcactgttgcagttactcaactttgccatcctagtgtgaaaagcagccactggcaatacataaataaatggtgtggctgtttcaataaaattttatgtataaaaacaggtagtagactggatttggcctaagtgttgtagttttttgatctatgggctagagaatgcttaaatacacacatccttatcaatactgtgtatttatcctttttttttttttctttttaagagatggggggctcactttgttacccaggctgcagtgcagttttgtgatcgtaggtcactgctacctcgaactcctggctcaaggggtcctccagcctcagcctcccgagtagttgggagtacaggtgcgaacccatttatcaaatttttgatatttgctaatcaaatggatgacaacagtgcactcattttttgctgaatttttatgcttttgattctgagggagaataaactttttactgtttattggacacctttttcttttcctgtgaacattctattcatgtctgttatgtttattaatagcattttctattaacaaatatagtccttttcatctgcattgtgaatacttttttacaaaacattttttggggagaaaactttcaatgtaatcagatatagatgcagatatatatttttaaaacatcatttggggttgtgtcatatttagaaaagccttccctctaatcttctagtattcttctagttttattttgtacttgacttacctaggttttcgtaagagtaagtagttaacctaaatagccaatctgtctctgcttatacagcctccggtcccatctaccttctataatgtgatagagtgacttttgccacatatagatgcctcttctaagacccagatcaagtgtcacctcttttatttattgatttatttaagacaaagtcttgctctgttgcccaggctggagtgcagtggcaccatctcggctcaatgaaacctccgcctcctgggttcaagcaattctcctgcctcagcctccagagtagctgggattaaaggcatgcaccgccatgcccagctaatttttgttttttgtttttttttagtggagacaggattctccatgttggctgggctggtctcaaactcctggtctcaagtgatctacctgcctcagcctcccaaacaggtgggattacaggtgtgaaccaccatgcccggcctcatctccattattaagccttttctgacatcaactcacctggacaaaattcatttttgtgtctccagtgtcttctgtatagacttctaccaaagcacccaatactttttgcacagagttgatttcacatcagtctccttttaatgtgctactatagcgtttggcaaaaagaagatgactgtgtgataagtaaatgagaaaactttaaaacaggaaattctaaagttgtaaacttgataagcagagaattattttcacatggtagctgtaactgaagaaaaacttaagtacgtaaatattatttgggagaacctgcaggcttctacaatgaagggttatttgttgattttaccagcatccttaaagtttgtcatccttttaagattaagactgtaagaaaacatagcacttcccagaacaacaggaagagcatcccgaaatctgtcatcgtatctataaagcacatatggcgcatcacagaaaatccatacttacatgattgcagtctgaagaaatttcattttcaggctagaagagaaaaaaaagaagagatgatgtaaaaaaaaaaatatatatatatatatatagagaacctttcaagttttcaaacaccaccaaaataaactcaaaacaagaaatctgaatattcaaccaaatatgcttcttcaacataaggagtaaaatggagcttgcatatcttttaggctgttggggagaaatgtaccagaaaggtacatgagacttaaccccttcccgatggtgcaatgtgaagatggggagaatggagaagaatatgctaaagcaataaataaagcaacaatgacataaggactcctacaggacactttataattcacttattatagagtgcagagaaagtcgctcaatttttatttatttattttttattttttttgagacagggtctcactctgtcacccaggctgccatgcagtggcgcaatcatggctcatggcagcctcaacctcccaggctcaggtgatcctctggcctcaggctcccgagtagctgggactacaggcgcaatgtcaccaagcccagctaatttttttggtattatttatagagacggggtttcactatgttgcccaggctggtgtacaactcttggctcaagtgatccacccacctgagcttcccaaacagctgggattacagatgtgaattaccgttcccagcccccatcaatgatttttaaattggcctaatgctgctattgggggaagctatgtgatgggtatgtaagatctctaggtactgtttttgaaacttcctgtgagtctataattcataacaaaaagttttttaaaaaaaacatttggaaatatattcctatggatacatttgctttgtaaagccagatacacataccagagataaaatgaactttcaggcagggcacggtggctcacgcctgtaatcccagcactttgggaggctgaggtgggcggatcacaaggtcaggagatcgagaccatcctggctaacacagtgaaaccctgtccctactaaaaatacaaaaaaattagccgggcgtggtggcaggcgcctgtagtcccagctactctggaggcagaggcaggagaatcgcatgaacccgggaggcggagcttgcagtgaaccgagatcgcaccactgcactccggcctgggccacagagcgagactccgtctcaaaaaacaaaaaacaaaacaaaacaaaactttcaattccatgacagaaaaaaagtgtggactaggtttcacgtagtattacatagctttgcaatacataactcctttagtttccttgttcgtgccttcaaaggagacacaactgcaataaaacacaccataaggcggcaccatttcctgggtgagtgcagtggctcacacctgtaatcccagcactttgggaggccgaggcaggcagatcacttgaggtcaggggttcaagactagcctggccaacatgatgaaaccccgtctccagtaaaaatacaaaaattagccaggcgtggtggcacgcgcctatagtcccacctactcaggaggctgaagtggaagaattgcttgaacctaggaaacagagattgcagtgatctgagattgtgtcattgcactccagcctgggcaacagagcgagattccatctcaaaaaaaaagcataatttattttgagtttccatagtattcgaatctgtttatataaagtgaattctgtgtgcctataacttaaatattatcaatttaggtagcaaaacatgctagttttaaaataaacagatgttttctatccaaggataaagaaaaggcaataaagaaaatagaacacatcaagtagccacacctagcattatttcaagaagaaaaaggtttccctatggaattattaattccactgcagaattcagtaggcattagcaacatacaaactcatttttatacttacaacatatattaaaattgactttaattaggttgctaggtaatcataagattctattatataacacagtacttttgaactttctccctacttgtctaatagcagatactttaatgcctttttaaggtgcctttctcagtctcagaaatcagcctccatgctgagtcgacctagcttaactctgttcccaccacctcaatctgaagtttaacttatatctcttaatagtttatttacaagaatgctttttcttagacagttttctacactatccttttaaaatctatcctttaagttttcccaatcaattagcaattctagctctttctcaaacaagggatggaaggcaattaatatcacaatcttctctacttatactcatttctactaaacaacaaatttggattaaaggtgcattcttgaaagaaatttagagcattggagaattttcaaaataatgtcaaataagatgtaagctccccatagaaagaaatgtattgtcatgtttagagtccacaggactatattagcaaattaattactgttttaatgacttgcttccctacagcgggagactggattatttctcccaatttttcacttgcataggattttacatccagatcctctgttttgtaagtctgtaccgcctcctgctataaactgagtatacacccggctccgctgacgttgagcaaatcaagatagcaaaagagatgaaaagcaagcactgcagtccacatttgcagttaattgagtctccatggatgatgtcattccttcctaagaggtgcagtactgtgtgcttagtaatactgttaatgtaacataatataatataggccactgacatgctcaggccaatggagttttaggagatacaatatgagcagaggatttaaatgtgcctgggtagtttggcctgtattcctgcacccctgccattccccatgagaacatggtagtacaaagaaaagagacatgtggagcagacctgaacttaaccctcaacctgtagcctgaagcaaagccatctcgaataacccatgggaaagaaaaacaagcctcgagttaagcccatgaaagtttgagggtgtctgttatgaagaaaaaatgactaatatatctatcaaacaaataaaataaaaatatcaaagcctttaaattagaacctgtaacagctatgatctaaaattagtgaattatattggaaagcacagagcactactgtacctttcatgaagaaatgacataatccatggagacacaaaagtgcaaatctggacaccagtgcttgcttttcatctcttttgctatcttgatttgcaactgactataaatgcgtcttatttttgcattcattcattcatttagttttgagatagagtcttgttctgttgccaggctgaagggcagtggcaccattatggctcaatacagcgtccacctcttgggcttaactgatcctcctgcctcagcctccctagtagctgagactaaaggtatgtgccatgatagctggttaattttttaaaattttattgtacagaccgggtctcgctatgttgcctaggctgatctcaacttctggtctcaagtgatcttcctgcctcacctgcccaaagtgctgggactgcaggcatgagccagtatgcccagctttttcctaggtttagtttctctatgcagaaagaaaagatgacagaataggaatgccgtaaaaacaaggttatgatgttaggtctttgagattcatggaaccaaatcgctatgaagaattgttaagcataattgtgacaattaatttcagaaatttagaggggtttttagaatccaagaacacagtggtgatttagaggaagagaagagagagaacgaaatataaaatacaaaggagtattttatactacccggggaatggtgggtgcatcaataatgtcagaataaatgaactcgagaaagtaaataaaaataataaataaataaaaagaaaacactatgcttcagcactcagtcatgtgataaagaaccaatgaacagaaatctcaaggaacgaaaacagatgcaggtgctgattcgggtttggttctcatactgcaccattctcattatgtcccaattaaaccacttcatcagatatagtacatctatttccacaaaactttaagtgcagacaggctcacttgtctctaatcctagaagatgaatagcatgaggaataacacccataattactaaaataagataaaactgaggattttttttcttcctctttggtaataattagtgaaataatgctctgagatgatcccaagaaattagccaacaagtatatattgaataatgatgatgaactcaaaattgtgctaggcattgttgcaggatacaaagacaacattctatctggtctctaatctcaagttgtttacaatccagttatacagttaaaatagcgaaatcaaacaagcaagaggagggacttgagataggcctaaagaattagaagagtgatctccaaaaaggagtggagtgattcctcaaggaagaagttacatgatcccttgggggtcaggaagaaaataacagagcttctgtttttaaaaaagcttatcctttaatttatgttttaacgtatttttataatgcatataacatgggtgtaactaatattttatgagtatgtatctactgggggaatggttactgatttttcaaatgataggaagaacatgaccaagatagaggaaaaaaacttcttctcatcattaagattcctacctctacctgcattcttcaaaccaggggcaaagtgctggctcctagcctgtggaggcatcaaattagaagctgagctatgtcacattatcagctactccttatctggagatagaagtctgggcttcaaaaagaaggatctcttacatcaagtatttactcattggaaataaaactgtcctcttactatggaaaactgtaagaaaaaaagttatgaaaagtataataaatagctgctaatttaatgaccaaatatgagagaaatgattcctgacattgcatatattagtatcaataagtaaactattataaacagaagaatgagaaaatgaagagaatttagcacatccccatcccaatgcatcagtgactaaaacagagaaggaacttgggtaatgctgtataaatgatacagcaaacaaaggcagtaaagggaaaagcaccaagtacttggagacacctgcttgacttcaataaagaacatgatgagtgtatcaggaaatggttaaaaaacaaaacaaaaaacctcacaaaaaacagaaaacaaaaaagaaccctgccacttttctatagtagttagcaatagaagtgtgtgactttaggtacatcacttaacttctctaaacccctaacaacaggctttgaactagagtgggaatccatgaacaggctttgggagtctgagatatcctgaaattgaacgcaagcatttgtgtgtatgtatatttttctgagaagaatatccacaacagctatcaccatctcaaaaagatccacgagacaagaaaaaattaagaaatactggtcaaacattggttgcggttctttccagctttatgagtccataaaatctgagatgtggaatttaaaaatgtacttactgaatttcaagtttttttaatgcagataatttgtatattatgatggttactactgtttcaccttaatctctcctagtcaaagtcacaacaaacaggtttcagaataaactactgaaaagcttgagtctgaatgttctcaaatcaactaccgcattcacttaggaggaaggtttttacagaaagtctggaactatgatttccccaaggtgaacaggctgagttaatgagtctggaaggagaaattaaaggattcataaagctatcttggaaggtgtcccagtttctgaaacagaaatgcttgggagttggatgttgtctaaaatatggaacattctacagtttccactgaagctgaactacatcagatcacataaaggaatagggtcctttttctaagataactggtactaaattaagtgacaaccaactttgtttttgaatccctcaggagaaaacaaacaaaagatgccaacagtatcagtgcttttacagccttagaaaaatttgaagtcacgcgataacctaatgcctcctttcaattggagacactctgctgcagtattaagtcaagtcttctgggagtttattcattaagaacccagtaacttcccatcacacgaacacttcatttattaaccttgtccaaagccccaatgacaatgaagataatgtagctggtctctaacaaaataaacccaatcttttacccccgggaaactctcctgagcaagtctaaatgcaatctcgatcctcaggtttagaactgctttcctcttagtgccttattctggctctatcagaatttatttttcttatttgtacccagggatagtggctgagtattgtttttccaaaaggacagtgatcagcacaggctttatgccttccaacaatgttctgattcactaaagagttgtagctgcttttatttaagtctttagcattcaactaccttttcaaaaaggagttactgtacaggtccaacgggagattttgagatttttttttttttttttttcttaaaaagacatgagatacagaagctggctctcaagtgcatatctaatcatcatacaaggctgaatgtggagtttttagggggaaaggaggacttgatattttaaagaaggaaaaaagcaccaataaccctatgagatgagtatggcaataaagtcagtcagagaaagtttcatggagggtacatttgaattaagtcttataggcggttgtggtttggttaaggatgctgtgtgcaggctgaggcagatgagaggtaggctgtgaaaggtggagcactaggctgtgggtggcattgaaaaggcacattctgtgccgatggctgagaaagtgagggaccccatgacaatcactcctaggcttattcatttggcatctcctaatacgtgctaggacaactacaagtctttagtaaaaatccaacattggtccaataatggtttctcatagttcaaattaagatgtcatgctaaacacagtgtcataatttgatttacttttattacttgtgtgcttcccaagtggacggtgggataacagttgtcaaatattatatagttactcctataggaacacgttaagttttaaagatagacggggaaagaccctcacagacaaattagagctcatttatccctggttcttaaaaggtctcacataaatatagaacagtgagtgggctatgttgacgttaaaacttgtcttgtacctttaaaatgaaaaatctcctcaaagccctttaattctaataaaataaaagggtatacgtattttacagtgggaattagcagaatgactcagagagcatacttacacataggtataaatatactgacaggacttttagctttgtcaagtactaattaagtcatcttcagtgaggttatatccctattctgaaaatatgaaaacacagagcaatcgctaattactcaaaaccactgctttggacctaatggttgacctccctccatctcccaaaaaagactgagtaactcctgactccctgacagaaagatccatctctctagagaagatgctctgccccaaactttactttgagaagtcaaattacatcttagttttaagaaaactctaacactagttaaactgaccaagtggaaacactcaaattagtataatttctcatcttctatgcccaaagcaggaaataaaaaataacaaataagaatatagttcatggttgacctgtgagtgaaaaaataaacaaatacaaatatatatatattttatatatatatattttatatatatatattatatatattttatatatatattatatatattttatatatatatattatatatattttatatatatattatatatattttatatatatatattatatatattttatatatataatatattatatatatatagcaatttagttattgaacaaaaactgaatcattacattatggcaaatgtaatgacttttacattggattataatatttattaatccatgaatataaaaatacataaattttataaagtattaaatgtaaattttgaagtataaactgtaaattttataaaatgtaaattacaaaaacatgtaatttttttctaccgtgtataaaaaaatgtaaattctttccttatatttcccatttattttactaccaggaattagaaacaaggtgctcataaactataggagataggccatccctttagggaaacatttagagatatttcttttcatatacagagctcaaccaatcttttcatcaaattcccatctgggactgcctaacatttaagaaacgtaaggattgtcttgcaatgacaagagtttttaagtctgctgggactaaaaatcatccccatgacagtctactatctgaaaattttttcctcccaccactcattttttctccctaggagatgacttagaaatctagaatacagtttggtgctggtgttaaccatttttacctaaattatgggggaaggaaacagagtcaggcactctatcaaatgcttgttcagattccactttggcatcgaggggaagaaccttggacaggtttatccctttggctcctagccacggcaggcacacagctatcaagagataaaaggccttgttttcactgctcagctgcctgaataaagtcagttacggtgtccacatgtaatgaaagtggcgctaatgtttataaactgctttgtaggaaatacatcaaaaaggtcatatttctgaactgtgaggttgtaactaccacactactactaccgaaatacagtataaaaattcttctgccgggtgtggtggctcacgtctgtaatccctgcactttgggaggctgaggcgggcagatcacaaggtcaggtgttcgagaccagcctggccaatatggtgaaaccctgtctctactaaaaatacaaagattagccaggcgtggtggcgcatgcctgtagtcccagctacttgggaggctgaggcagaagaatcacttgaacctgggaggcagaggctgcagtgagccaagatcacaccaccacactccagcctaggtagcagagcaaggctctgtctccaaaaaaaaaaaaaaaaaaaagtctaaaatcagctactcatggtatttttcacatctcataaaagaagatacaagataacggatcccctcaagctatcatgtttgagaggcaaaatggaaacaagaattctggaataacagccaaagacttgggttttgattccagttccactgcacatttatcacataacattctttaagcttcaaattttgtgtagataaaagaggtaaatcctgctttacctacctcatggggctattataagcatcaggagaaaagttatgtagaaggccttcaaatattatagaaggctttgcaaatatatgcgaccactagcctttcattctctgtataaaatctaaccattttaaacaacaaaaacgttactgctatccaagaggccatgcttcatacaggcaaagaataagaattcaaaatacatgacacacatgttttattgtatgtgtataggttatttctgaaaggatacctaaaaaggcttatttttactacatactctttgcactttaaaatttttataccatgtgtaagaaaaggaaaaaaaaggtcattccagtttaggatatacacagacacctcagaaaatatttagaatacatcttcatgactgggaaagcaggggagtttaatgatacattttcccagttcatattttcctatttttcccccttccactgtctatttcaaaggggtggtggcagggaggaaatatatatttacatcctctgggacacagcaggtagcaatctgccctcttagagtcctagactgacagttctactctaagaaaagcacatgaaccatctgatgatctggtttgaatagtatagctaacttttacatgggagttttagaatgcagggtgaaaaaaattatctgaagggcaccgtatgaataatgaacagaattatcaactttgatatggcatccttttatattctttctttgccctgtcacatgatttggaacagctgaacaaaggtacaaatttgtcaaatcagtagctactatagccaaatgcaaagaagaaaactagactaggccgggcgcggtggctcacgtctgtaattccagcactttcggaggctgaggcgggcggatcacctgaggtcaggagttccaagaccagcgtggccaacgtggtgaaaccccatctctattaaaaatacaaaaaaattagctgggcatggtagcaggtacctgtaatcccagctactttgggaggctgaggcaggagaatcgcttgaacccagaaggcggaagttgcagtgagccgagattgcatcattgcactccagcctgggtgacaaaagcgaaactctgtcaaaaaaaaaaaagggaagggaaggagggagggaggaagggaagaagggaaggaaggaaggaagggaggaaggaaggaaggaaggaaggaaggaaggaaggaaggaaggaaggaaggaaggaaggaaggaaggaaggaaaaactagactaaaagaaaaaatttccagacatctgacaataccattaatgtttacaaccagtaaatctggaatgattctgtcaatgcagctcatactaccaatccaactttgttacttctataattttgaaaacaaaatacaaatgagggatgtaagattacatgatgcaaaaaagtcctgaaattaaatataatttctcacaccccagacccgagtacctgcacatgccacaactcttccatactgacccgtggtgagtgcattgtttacttgaactggcctaagcaagagcaaatagggctgagctgccagaatgtgctgaactctttctgtataacccagtgcaaattactggtgcttctgaagagtacagcttggattcaggaagtggacttccatctgaattaagacagcacacttcactgcacaattctgaaagatgcgtagctcaaagaaagagaccagggctaaattgggaaaaaaatttaatatattttaaaaacagaatcaggccaggctcagtggcacatgcctgcagtctcagctacttgggaggctgaggtggacagctttcttaagaccaggagttggaggcagtaatgtgttatgttagagcctgtgaatagctactgcactccagcctggacaacacagtgagaacttacctctaaaaaaacagacaaaaaactgaaatcttctgggtttgcaaatgttagtaatgtgcataaaaatctgataaaatcctcaaaaagtccctacatttcttcttgcttagataacatcattctacagttggtagaaaaaaggtatacatcaataattaccactatatcaaactatattatagtttgggaaatactgataaactaatctaaatattaacaaagatgcaatctaaaaattacccataatctccaaatcacatctgtgccttttaaagtgctaattttctgttatgaaattaactgattttgaaaacaaagtacaaagtacaaaagaccgggagaatcctgctgatggtactccacctgagccagtgatcaccacacgacctgaacaaattctaattccctgtgcttcagtgagaataggggggagatgggataaaaagcaagacagcttgactccaattgattgcaaatctaatatgattccagaaaaacagatgactacctttccaaggaagggaaaatattgttatagaaatggcttggagaagtgaaaggagatgggcagaacagatgcagatccttttagaattactgttttaaaacatctcataggtatgtcaatggttgaaaatgtattagctccctaataaagaatgttcatctccattaacggaaaaacaaagaagactcctaagtacttctaagcattcattactatacaatctataggtctggctatgcagcacaaattttggaaagagatctgggaacaaatttgggctcttccaggtactagctgcaagatcttggaaaaattatttaacatgtttttgttttgttttgttgttttgagacagagtttcactcttgttgcccaggctggactgcaatggcacaatctcggctcaccacaacctccacctcctaggttcacgcgaatctcctgcttcgtgtgagaatctcctgcacatgcaggcgtggtggcatgtgccaccaagcctggctaattttgttttttgttgttgtttgtttggttggttttttgaaatggagtctcactctgttgcccaggctggagtgcaatagcgtgatcacggctcactgtaacctccgcctcccaggtttaggcgaccctcttgccttacttagtcttatgattacaggcgcgtgccaccacgcccagctaatttttgtactttatagtagagacagggtttggccatttgggccaggatggtctcaatctcttgaccttgtgaccctcccacctcggcctcccaaagtgcagggattacaggtgtgagccaccgcgcccggccattatttaacatctgtaagcctaagtggagcaaaatacttaaagcacctagcacaatgctagtagtaagtatgtaataaatataatctataattataataataattattgcatacttctagaagagtgttaattctgcattgccccaatcccaaaataaatcaatctcaaaaataagaaaaaaatacaaaagaagtgttctattaaagcctcaacttcaggaataagtttgcagatatgtagattctggctacaggaaggcaacttcggtttaaattacatcaatcacattaggataaactagaaaaaaggaataaattcaggaaattctggtggaaagatctaatcctaatggaaaaacaggatttaaatcactccaccaagtattcttgtttttgttgagacagggtctcgctctgtcacccaggctagagtgcagtggtacaatctcagttcactgaagcctcaacctcccagcctcaagtgaccctctcacctcagcctccctagtagttgggactacaggtgcatgccactacacctggttaatttttgtgtattttgtagagatggggtttcaccatgttgcccaggctggtctcgcactcctaggctcaagggatccacacacctcagcctcccaaagtgctgggattaccagcatgagccacaccatgcctgacccactccaccaagttttcgaagcccagaaaagtatgtgtggaatttctgtctgttccagaccctagtctttcaatctaatgtttatacacaaatttaaattcagatatctattttgaatttcatttaggtttttgtttctaagtaaacatcagaggattagtttgggttttgttcacccatgtcttttaaagttctaaagaacctttgtatctgagctcaactttatatttaagttcaactgctcagatgcagacatcttttaacatgcaaacaaaccaagagggtattggttaactaaggtctcttttctaagttttacttaggaaatgtttcatgcctaccacttccagtcaatataattctctcatcacatcaaactcatgttgattaattttgtaaaagtaaatgtttgttaccaaccggtcaactttaataaagcaagatcaatgacttcaataactcagtttaaatgtcatgcatttgtctgagtttgttactgaaatcacctgacagtcacctgtgaacaggtagtacaaagcagtataaaaggaagtcctgagctacattactataattctttcaaagacgatcagatcttaccatagtatctttgaaatcttcataatcataattactgttcttcaggagagtactgggaaatctaatgtctaaaacacaaggctttgtagctcatgcctgtaatctcagcactctgggaagctgaggtgggcagactgcttgagcccaggaattccagaccatcctgagcaacatggcgaaaccctgtctctacaaaaaatacaaaagttagccaggtgtggtggcatgtgcctgtagtcccagctccttgggtggggggcgctgaggtggaaggatcgcttgagcccaggagatagagattgcagtaagcagagatcgcaccacagcactgcagcctgggtcacaaagtaagactctgtcttaacaaattaattaattaaataaaatacaaggctttgatttaagacttctgaaactttagtgtaggccataaacaaaggtaagaatttatgattagaaggatccctgactaggccaggcgtggtggctcacacctgtaaccccagcactttgggaggccaaggcaaggcggatcacctcaggtcaggagtttgagaccagcttggtcaacatagtgaaaccccgtctctactaaaaatacaaaagttagccaggcgtggtggcaggcacctgtaatccccgctacttgggaggctgaggcaggagaatcacttgaacctgggaagcggaggttgcagtgagctgagatcatgccactgcactccatcctgggcgacagagtgagactccatctcaaaaaaaaaaaaaaaaaaaggatccctgactagaagtgggtaacatgtgataatttggacccaccattttaatgaagtttgaaaagagagagaagccttccttccccaaaggcttatcactgagcaaaggatcacaacactagacctagcaaaataatttactcaactggttgctagaactgtccccgcttccagaacaaagaaatggtgcataagaataggaagttgacttccctggtttaagacagtcttttattatatcattttggggccataacaaattcctaaacttttctggttttgttgtgttcccttgcctccaagggggatgtagaggtagtgcctcaattaaacaaaaacaatttctataaatgtaaatcacctcatcgatcttttccttactttaccaataacttatttaatacaattatacatcctgtccttaaagctcagaaaaacaaaaacagaaaaaatgaagagtagatcctttttccaaagatgactaatcacatttcgctttagaatttaagattaagcagatctagcttacataagtaattgcctccaaaatagatcagacacaacaaaagtgtcttgcatctgtgtattggcttaaggctcagtttctatttatgacaaagtatatattttttcacatttagcattcttttggaatagtgaggaaacaactcacagggtaagactatggaattgttcattctaattcctgttctaccagttaatttgtgctatgttttggaagaagccaatcattaattgcatgaaaatgctttgaatgaaagtgctttgaatttgagctatgatgaagagagaaaaaatacatttttttcaacctttctcccataaaaattagagtcctatctttccaaacccctctgacaaactctgatagcataatcaccaactcacaacgttgacatctgtgacaaatttccacttccatagagggatcatttccactgtctctgataccaaaagctgtatccttttgatataaagtattcatttaatccactgatgatggcttaaaacagtattttcagaacagaagaattcagaaataaaaaatccaaagttgtttgtttgttttgagatggagtctcgctctgtcgcccaggctggagcagagtggctcagtcgcggctcactgcaacttccacctctgcattcaaacgattctcctgcctcagcctcccgagtagctgggataataggcgtgcgccaccaagcccagctactatttttttgtaaagtcaatagtcaatatctatttctgggtaagaacttgactcacaacgagcactttagctgctctgcattctaaaaatatctgccataggacaccagaaaataagtattctgaacctgtgttccaattcttacttggtaaaaccataacatcacaaagcaggcaacggcataaatgattttgctggcataaatctggctccaaattatagctatctttaaattcttcccgaaaatatctgaattcaaatgaaaaatccttggttgatcacagaacctctgtagcctctggcagaagttttcttcttaagataacagtccagacacttatatttaagaaagttctttgaaggcagtaaccacagcttggcctaccacacaattctaggcattcactggcattccatatgttatctggttgacagaaatctgacatctaggcttccaaaaacagcttactggggtcaaactgacatcaacagcttctcccaaacaacttccttcgtggacaatttttcaggacttttagcctcaatttaaatctcaattctctaaaaattcccataagactattagatgatcaattcttagacataataccaaacagggccaggtacagtagctcaggcctgtaatcccagcactttgtgaggctgagacaagcggatcacataaggtcaggagttcaagaccagcctggccaatatggtgaaacctcgtctctactaaaaatagaagaattagctgggcgtggtggcaggcacctgtaatcccagctattcaggaggctgaggcaggagaatcacttgaacccaggaggtggaggttgcagcgagctgagatcacctcactgcactccagccagggtgacagagactccatcaccaaaaaaaaaataatagtaataccaaacaacacttaatttttcagtcatttgccaatcagcaaatgaaccaatgttggttcaatgaatcaatcttatacattcctctctgagctttaagcatttcttgatggatcaggcaataacactaataagcacttctgcaaaaatttaatattttccttttgagtttaattttatgagtcacttcaagatatgaccacagtatgctttctatctctctagtaaagtaatgtactgtattataacctgtttacatattccttgcaggtggaattttgtcttctccatctttttttttgatatggagtcttgctctgttgcccaggctgaagtgcagtgatgcaatctcagctcactgtaagctccgcctcctgggttcacgccattctcctgcctcagcctcctgaggactacaggcgcccgccaccacgcccggctaacttcttgtatttttagtagagacggggtttcactgtgttagccaggatggtcttgatctcctgacctcgtgatccgcccgcctcagcttcccaaggtgccaagattacaggcgtgagccgctgcgcctggccagtcttctccatctttttatacatagtgcctagcacagctagcatagcacgttcaatatttgctccaagtatgactagacaaagctggtgaacaaaatctgtacaccttttattttcaggagaatttgctaattttatattaaaaagccttaatagtaattttataaccttgagaaaagtttggatgaagtccacaatgaactaaatgactgctctataaaatggaaaataaacaacaggaaaaggggctgagcgtggtggctcacgcctgtaatcccaccactgtaggaggctaaggcagggggatcactcaagcccaggtgttcaagaccagcctgggcaacatagcaaaaccccaaatgtgccaaaaagaaaaaaaaaagttagccgggcgtggtgggagcacctgtattcccagctacttgggaggttgagaggacaagactgcttgagctggggaaagttgaggctgcaatgagccatgatcacaccattgcactccagcctgagcaacagagcaagatctctaaaataaaaataatataaaaagaaagggcacagtggtggacgggtgctagaacttaaggggcactaaaatacttattgattgtgctttcctttcttgcagctgtcattcaaaagcttcttcctgaagttgagtaagagagtccatgatgtttagaatatgtgttttcattatgtggccaaatgttaaagctgttggagaaagagctcgaagtctcaattgatagaagaccatgatgtactggaatcctaatatatcctggtcaatatgttggcttacaaagataagcatatgagagcagagcctcagcttcatgcctggcaatgtgtccgccgtgtgtgggtttcctaaagtaacagcagtcataccatatggtgtggctttcattggcatgggcaggcgagaagatgccaaaaactcaatgtgctattttgggccatgaaacgtgataagctctaaatttaaaacataattttttaaattaaagagtattttttaattgtaagatgtttttatactggattttataatcttaagactcaattaggtaactgttctcagtgtgtgaaataagacaaagatgcaaaagtcaagagggggacaagcttggcagcaatcttctgaaaaaaaaaatttagagatttaaatgaaatctttttttagtgatactataaatataaaggtgaaatatacagaaacagcttttggaatgctacattttgataatgctgaacaagggcagtagatgtgagaagctgagaggcagtatcagtgggatggaatctcttattcctctcgagccaccattccaaattttgtacaataacacacctccagcctatcaaataagctgatctaatgtctgaagttagagcaaccctggaaatattcatgttgaatctaacggacaacttatttaacccttacaaactcagccctagatttgagcaactaggttcaagaattctaataacaatttcaaatgctatactggggctggtaatactaatctcaggaaagcaatttttgagcttccttgtctcagtgctagcctttcccgtaagtctgcttctttttcctaaattaggttaattatacataataaaaatagtttttcattagtcctgagctggcaaaatgggttttatgaactgcttcatataaagcaagtgctatatcttattttatttatttattttttgagacaaggtctcgttctgtcacccagggtggagtgcagtggtgtgatttcggctcactgcaaccttagccccaacccccacctcagctcaagcaatcctcctctctcagcctcctaaatagctggggaccacaggcgcacaccaccatgtctggctatttttttttttttttttttaatttttagtagagacgggcgtcttgccatgttggccatgctggtctcgaactcctgagctcaagcaatctgtccacctcggcctcccaaagtgctggaatgagccaccatgcccagcccttatttttttttttttaaataaaagaaaatacaactttaaagtgtcagttggctaatttgggaagaggtgtgggtgtcagtgtatggggggagggggacctgcctttaggtgtcattaccaaaggctatgatgatgtcatacagcccatttcaaatgtacaaggagaattactggggagaagaaagagaagggaagtggggaaggtatctttttaagatactttttgcacctgcagatccttaaacgtcttcgccattagtccaagtagatacaacagaaggtagtctagaatagggagttaattataaacggaagaaaacggcaaatatctttctagttttccttttcctaccagtccttcacctttcctaccgaagagttaagtttaatctaaaaagtttgaagtttgcataccctttaagccccactgctatgatctagtttgggggatgtggaaaataggttatataaaaatttttctgagtaatcaaaagcacatccaacatttaccagagacacaatattgtcttctacgggatggattagcatctcttccttcaaatgtcctgacttggaagatgcgatctctgttaagttgcaggtctctccagccccggacctgggccctgcagccaccaagatgctgatgcctaagaagaacgggattgccatctatgaactcctttttaaggagggagtcatggtggccaagaaggatgtccaccttcctaagtacccagacctggcagaagacaagaatgtgcccaaccttcacatcatgaaggccatgcagtctctcaagtcttaaggctacatgaaggaacggtttgtctggagacatttctactggtaccttaccaacgactgtatccagtatctctgattacctccatctgccccgtgagactgtgccttccaccctataccacagtcatccagagactggcaggctttggcctaaaggtctggagggtgagcaacccgcaaagctcacaaaaggggaagccaaaagacacccacagacagagtgctgtgtcccctggtccgatgagaaagccgaggctggggttgggtcagcaaccaaattccagtttagaagcagatttggttgtgggtgtggtcagtgacctcagtaaaactggagaggattattttgcattgaataaacttatagacagaaaaaaaaatgcaggtccttctgcttaagccagtgtttaacctgtggtttgattctgaatgtcttccctagttttggaaacaatttatattgaagttcagttgtgtcacaggcccttattttactttttttaaaaaaaacttgtttttggccaggcgcagtggctcacgcttgtaatccctgcactttgggaggcagaggcgagcggatcacttgaggtcagaagtttgagaccagcctggccaacatgatgaaaccctgtctttactaaaaatacaaaaaattagtcgggtgtggcggcaggcgcctgtaatctcagctactcgggaggctgaggcagaagaatcacctgaacctgggaggcggaggttgcagtgagctgagatcacgccactgcactccaacctgggcaacaagagcaaactctgtctcaaaaaaaaaaaaaaaaattttttttaaagacagggtctcgctatgttgcccatgctggtcttgaattcctggggtcaagtgatgcttctgctttagcctcccaaggagctggaatcatgggtgcacaccaccatgctcggctactattttcttcaaaatttgactattctgacagattctagcttaacagtacatattagataaataaatggcaattttctggaacattctttttttggttttgtttcggtttttttttttttttttttttgaaacggagtctcgctctgtcgcccaggctggagtgcagtggcacgatctcggctcactgccagctccgcttcccgggttcacaccattctcctgcctcagcctcccgagtagctgggactacaggtgcctgccaccacgcccggctaatttttctgtacttttagtagagacggggtttcaccatgttagccaggatggtctcgatctcctgacctcgtgatccacccgcctcggcctcccaaagtgctgggattacaggcttgagccaccgtgccaggccatggaacattctttaaaatagtatagacttcatagcagttgcaacttcagttattgtattctgctatcattttggtcttcttgtggcttctaaaagctgaattttcactgcatatccaaactccataacttggtaatcagctctttaatagaagtagctatctgacaatagcacaactcacatatgcaaaaatacaatttgtcaatctagatttatgagatcatttaaaattctcaaccaaagcgtaagctttcaacattctcaaccatggcctaagtaaatctcagtgactgagtatttaagaaccaggtacaacacaaaatatagtcatctatgggagataactagggaattacctttcgcacaaaatcagtcaggaaaaaaaaatacaatgtgtacaattcctcagaattatttatttaaaccctactttgttacaaaatgatttaagacaggatttcctcaataaatgggaggagagccaggcgccgtgactcacgcctgtaatctcagaactttgcggggccgaggcggacggatcacttgaagtcaggagatccagaccagcctggtcaacatagtgaaaccccatctctactaaaaatacaaaaattagctaggcgcggtggtgggcgcctgtaaccccaggtactcgggaggctgaggcaggacaatcacttcatcccaggaagcagaggttgcagtgagcagattgcatcactgcactccagcctgggtgacagaaaaagactccatctcaaaaaagaaaaataaaaaaatgagagggattccagcacttttctcaatatattctggctaaatgtaagatggtcacttaaattgagcagatgggacttcattaaatcacgatgaaaatgaacagccaagaaaagaactattgtatagaaaggaactttggtaaagtgcatgaataaaattacattttggtggatatatctaattaatattcatttcctcaacttgcaaagcaaatgacatcattgtttgtcactttaactagttctctgttcaacagtggacctactgacagatgcccaaataaagatcacacactaacataaaaagatgtaactgcagccaaacatggtggcatgcacgtatagtcccagtgctttaggagactgaggtgtgaggattgccagaacccaggagtttgaggctgcaatgagctataatctcaccactgccctccaacctgagcgactgagcaaaaccctgtgtctaaaataaataaataataaaaacatataattgccttcagtttataagactttgtgataaaacgggaaaaaagaaaaaacagttgtaactgtgcttggagatacccaccagatgggccattctcacaaactgatcaaatgatcactatggtggtgttaaaaataagtttacaaattgtaacttttccttcactgaaaactgatcaagaaagccaactccccaaattataatcttgtcttatctagtggtctgtcctagattgacagaacataaaattgggcaattattcatgttgtgaaaggatccactacacaaaaaacaaaatttaaaaattaacgcaagtttccttgacattgtcaactccatcagtacatttaaaatgggattccaggctgggtgcggtggctcacacctataatcccagcattttgggaggctgaggcaagacaactgcttgagcccaggagttcaagaccagcctgggcaacacagagagacctcatctctacaaaaaaatattaaaagattggccaggtgtggtggtgtgtgcctgtagtcctagctgcttgggaggctggggcaggaggatcacttaagccaggaattcaaggctacagtgagctgtgactcctccattgtgctccagcctgggcaacagagagagatccctgtctctaaagaaaagaagaaaaaggaaagaaagaaaagaaacatgctgggtttcaggaacaattagcctaagatttaaaagatttctgtggaaaaatcaagtcactaagtcacacaaagacaattatagctggtgataattcatctttttttttttctttttcttttgagacagggtcttggtctcgctgtatcacccagggtgaagtgtagtggcacgatcatggctcgctgcagcctcactcttctgggctcaagcaatcctcccgcctcagcttcctgaatccctgggactacaggcacatgccatcacatgaggccaatttttaatttttttgtagagaagggtctcactatgttgcctgagctagtctccagctcctgggctcaagcaatgctcccaccttagcctctcaaagtgctgggattataggcatgagccactggtaagaataaatcgcctactttatattacagttaacagttaattacaaattcctaaatcacaaaatgtccctcttactcttactataacaaagtgaaatagtcctacaggaaagatccattacaataagatatacagttaggtgctggaaacaagcaacagtaagtagctattgattatcttaccattttacaataaatcatgactttaaatactttactagaaaatttaaagttctttgactaggaaaaatggacctctttccataaaatttttggttttgtttggggctaacccaaacaatttatttaaaccaactttagtatgaaatatacagattatacacaaaataatctaatacactctggggcaacctggtgagacaatgcctctacaaataaaatagtcagctgggcgtggtggttcatgcctgtggtctcagctactggggaggcagaggtgtgaggaatgcttaagcctagccatcagaggctgcagtgagctaggattataccactgcattccaacctgggtggcaggttggaataatattattatttttttattattttatatatacataattttgagacaaggtcttgctctgtctcaaatatatatattataataaatattattactaataaaaatatataaaataatattattattacaacctaatagtctttagccaatgagtaagagaatagctgaaactgtgtaacagtctgtttacagactatttccatatgtaggctgataagaacaactctaataatatagcttttaaataatacagcaattatttaaatgcattctcataaataaaatatattctaattttcactgctcaggaacagtgaagtactttataatttggcaggaggaagatttactccccatacattaaagataagcagtagaaagaatctttatatttttgcatctgaccagtttcaacagcacccctaattggtgtggggttagcaaaaagtttgtggttattacaatcattgtataaagagctaagtaaactagaagaaacccaggacctttgataaaacagctttgtaaatccttacctcaaatattacaaatgtttctataactatatatgatttgtttgacttttgtagatctttatttcctgcttatccattactatgtaatagtaagtgtgctgaagtaaagctgtgagactcaattaaaggaaaattttaatcatagaggtctttagatagcaaaataggcaagaagctctctttaggtctggggagaggcaagaagctctctttaggtctggggaggggccagagcataggcttacttatgggtgaccacttagcccaagagtgtgagcaggtggaagtgagaatgctttgcagatactagtaggccaaaactctaggcatagttaattcagatactagtccagacgcagaagatttcaggaaaacagaccaaaagcctgagtcaggagctcttgagactgagcaggtaacaggaagcaaaggaggctaaagaacatggtcagaagaccatatcccagaagcatctgaaagaagtctggtgcagctatctggaagcagccagctggttccttggtagaaagtgtcctgtgtgtcttttttttttttggtagggttggggtttcaccatgctttctaggctggtcttcaactcctgggttcaagtaatccatctgcctcagctcccaaagtgctgggattacaggcgtgagccaccaggcctggccatagaaagtgtcctgtcttgaagattgtgctgaggggataatgagtccttttttatggaagacataccactcatttgtaaagaacatatgctgaacaaaatagaaaaattttaaatgctagacacacacataaggaaagcagtaaaaccctgaaactgtaggtagttaaaaatttaaaatatttgcatttttattcacagatggtcttcaactttcacagtctgattttcatatattatatacttatgtacctaagaggcttttcaatgtggattttatattttgtgttcaccagctgacaaacttttgagctactgagtgaaggtggtactggctcaccaacatttcacttttggcagtatcaccacattgatgcatctctgtgaaattattagagtattttattggatttgggggaaaatgcaagtgttagtatcagcaaaaagaagcatctcaatgtaacagattgctttcaggtgttaagccagccttccatgtgctcaattatgaataatggataataaaatgaaagtgtgtgcacaaatgtttgaactgtattactgaagattataccaaaaaggttaagtataatttaggattttataatatttgttaactcgctgagcacctgctttacaacatttgagtctgactttaacctgcatggctttcgcccatgtttccatggatacacacacatttgtaaatttcaggacttgagaaccttaagacatttttagaaaatgtgaagaaatctccaattttatttttagctttaaaatttttttgtaacttatttcttacccccaaaggatgcggaaagtttcctatattaactattttgaccctacgagtttcatggtggattagaatagtcagaagaaaagagaagggcagataaatgtttcaatctgtcttcaaacatttaattatggcttacaataaaataaaatttaacctaattctattacctattttgtcacagactgtacatcttctttttactttttatattttcttagagacggggtctcactccgtcacccaggctggaatgcagtcacacagacatagcttactgcatcccagaactgggctcaagcaattctcccacctcagcctcctgagcagctgggactataggtgtatcccactatgtgtgactcattttttagatttttttgctatgttgcccaggctggtcatgaactccaggcttcacgcagtcttcctgccacagcctcctaaagtacagggattacaggcctgaaccactgggcctggccttttattttttaaacgaggtatctgagtacatttccttatttcctgcttcatatgacttttactatcagaagtaatcctttttacccatctttaggcttcctgctgtttaaaaaaaaaaaaacttagctgggcatggtggtgtgcaactgtaatccaagctactcaggaggctgagggcaggaggatcgtttgagcccaggagtttgaggctgcagcaagctatgatcacaccactgcactccagcctgggtgacagagggagatcctgtctctagaaaaggtgagggtaaggctgggggaggaggggcgatgggggggcaggggacaacacaaatacagtcaaataaaaatataactcttccttaatcctctgtcctctttaggccaggctctctcctcctcaaacctctctcatcttaattttagagagtgaaatatgcagatagtcttggatctcttcttcccttctaattctagacattcttagaacttaattctttgcctgctttttcttcattactcattcccaccgagattacgtcttcgtatcatgtctctattgatgaagacttcatttttcatcttcagccttctgacatatgtattttcagtttcttaatgtattcactttgaatgtccactgtcacctaaaatgtaacatgcctaaaacataattttattttgaatttattattttaaaaaataaaccactggagaattttagacttaatggaaaagttgagaagacagcacacagagttcccatatgccttctcattttcccctattgttaatagcttactttatatagtgcaatctgtcacaactaaagaaccaacaatggtacacattttattcagattgtactaggtattttatgaggatgatggttaattttttgtgtcaacttcactgggccacacgcgtttcgccaaacattgttctgggtgggtctacggtgctgtttttggatgagattagcacttggacaggcagactagcaaagcagactgtccttcccaatgtgggtgggtcccattccatcagttgaaggtctgaatagaacaaaaaggctgaagctcccccaggactccagaatcaaagaaaggggggatttcctcctaactgctttgaattgggacctcagtttttgtctttttttttttttttttttgagacggagtctcactctgtcgcccaggctggagtgcaatggcacgatctcagctcactgcaacctccgtcttccaggttcaagcgattctgccacctcagcctccccccgccgcccccctgcccccgcagtaactagtaacttgactgccatcaagcctagctaatttttgtatttttgtagagatgggtttcagcatgttggccaggatggccttgaactgacctcaggtgatctgcctgcctcagcctaccaaagtgctgggattacaggcatgagccactgcgcctagccctaaaaactctttataaaaggcaaagcttaagcaactaattgtaagaaaaattaaacctgagctgggcatggtggcttaggcctgtaaccccagctacttggaggctgaggcaggaggatctctggaagccaggagtttgattgagaccagactgggcaacacagcaatcccatctcgaaagaaaaaaagaagggaggaagggagggaaagaaggaaggaaagagagaagcaattctgtatatagaatatgtaaagaaagtaagatatgtttttgtaaggaaagctataaaggcataaaaatatgtgtttgctgagaaaaaaagttatttaaaggttatttcaaattgaatgaatttttagaagagatatagtctggcaccacgcagtcctgcgcagtcctgcacagtcctgcttggttgcatggcagcacctgggggtgcccagctggagggatggggcaggatcggggccaacaggcagcaagccaggatcctgcagcagccagcaccttcctcctgctggtgtcagagctgggcatggggggcagcatgcctgtgagtagcctcagaaggctgaggtccctgcccccaatattggcacctaggcctgcaccctcacacccttcatgaccacaaccaaattttcttgtcaattatgtctttaaccatgatcattttgtttccacagttaattgctttatacggatgcattttctttaagctctttacaaccaagtaaaatcctagagcattatgtcttcaagaacgttcatggaaagtaatggaaaggaccctaataagcactactgaatacaagtttctgataactttaggctcatctaatttggactgggtaagaattcccagaactttaataaagagactggtttataaaactgctaacccaagcaggacaaaaattaactgaatactaagaaaaatactctgccagattttcatgctaaatcagccagtactaaaactgttaagatatgcaacttgaatgaactctatgttccaagtcaaattacctatgataacccatttaatgaacagtgctatgcacctgaattggagatacaaaattggtatttaacaggctataaatgcaatgttaagcatggaatcacagagatcctgcacagccacctggtccttcctgaatccgtaaatcttccattattaaaagctctgcactccatgactcatcatggaagacagaaaatgatccaaatagaaaacatatacattggtgtggtgactgctctaaatcgctaaaaatggtttatgaccaaggtttggcttatcaaacctacaacctgggaagataattaaaacttcagctacctgatgggtcattggaacacttatagaggaatttcattcaactgtcattttcaacacgttttctggtaaaagctttctcatgcaagaaggctgatgctataacagtagctaaaaggttgtcagaaaatgtgtttccctcacggggcattcctggagaaatctccagtgatagtggtacttgtttcactggacaagttgtaaacagttaagtaaggtattacagacacaacagctttaggtgaagctaactgaattgactggttgccttggtcaaaggtattgcagattgatgacaacctcatctgcttccagtagaaaatataagttgactcattatgaaatagtcactggaaggcctatgccactaataatagaacctcatgtatcttcctctcccaaactctgatatgaataaatgctgcaagcctttaatgcattataccaaagtgtattttcaccagctaaaggaagcttttcttttttttattttctgtagatggtctcactctgttgcccaggctggagagcagtggtgtgatctcagctctctgcaacctccacctcccgggttcaagcaattcttgtgcctcagcctcccaagcagctgggattacaggcatgcgccaccacacccagctaatttttgtatttttagtagagatggggtttcaccatgttggtcaggctggtcttgaactcctgggttccagagacctgacctccagtgattcgcccacctcggcctcccaaagtgtagagattacaggcatgagctaccgtgctggcagtaaaggaagcttttcatgacccacccactgaggacattcaaatccttcacaatctagaacctggaggttggttcttctggaaatgacgtcaggaaaacactgcccttgttacccacaatgaagcaaaactctggggcctcaaacactgggtcaattgatatcacaatgcaggagggcccctccagacttggaattgtacacccattggaaatcttaacgtaaagctaaccagttagaaaaggttttcccccagaagcagatggcaccctagacatggacagctttcccaaaagcatggatcaaaacttctctgtcatcatgagactcttacctctcaatgttttccttgtttatgcctctatgaacaacagaaaaggggtcttatggtgcaccaatggggcacacttttatttgtgaaaacttttacagccaaccttatccataggcagcattatgtcttaatggatgaaagatgacagtccaatgtgggttaggaattttaatggttctgtcagaaagagaacactggtccactccttttaacctacatcagaggtgaaaaagaacactagtgcttggaagccttcatcattctgaatggccttcattgttaggtcactttttccagagtttggagtaaacgatacagtgtctagaaatttgtccctcatgggctggacgcagtggctcatgcctgtaatccaagcactttgggaggctgaggtgggcagatcacttgaggtcaggagttcaagaccagcctggtcaaaatgggaactctgtctctagcagaaacacaaaaattagcggggcgtggtggcgtgtgcctgtagtcccagctatttgcgaggctgaggtgggagaactgcttgaacccaggaggcagaggttgcagggagccgagatcacgccactattctccagcctgcgcaacagagtgagaccctgtctcaaaaaaaaaaaaaagaaagaaaaagaaaaaaaaaagaaatttgttcctcatgatatgctccatagcagattctactgcaaaggctatggttacaaaacagacttctttaaattatcttgctaaaggtctactggataacagaattgctcaaggttgcctactggctaatcagggaagtatctgtgaagttgctgacacttttatttttattctttgagacaggtttttgctctgtcacccaggccggactgcagtggctcaatcatgactcatttagcctcaaccttctgggctcaagtgatcctcccacccagcctcctgagtagtggaactaccagcatgtgccacgaggcccggctaatttttgtattttctgtagagacagggtcttgctatgttgcctacgctgtcttgaactcctggcctcagggatcctcccgcttcggccttccaaaatgctgggattaacaggtgtgagccatcataccaggccttgctgacacctcttgttgcacgtggatgaatatactggatattacagagattcagttgtaggggattaatgaactggctgcttggttgaaatgagtagattgtttatcttgctcattctttgatctatttgattttagttggtttggttcatgcgaactctggctaaggagcatactccaaactcttagtattatcctcctaacagtcataatagcagtctccctgctgcattatattctctcaaaagttataaatgtttgcatgcagccatctatgtaagttcaaatggtctctcttcagcaggaatgataaacactcaaagacatgcatgatcatgaggacaccaaaacctatgaataaagtgctaggactggaaacccaaaaggatggtaactgagtagcactaaagccctaagtttcagtaacactcacacccaagtgagaacctgaccaaaaaggcgaagctgttaaacaaaattgtgagagcccactgttttggattaagcttattcactaggcatcaataggctagaccagatcaaacctaaatgaagtcactcatgctaaatgcaacatcatcaaattgaaactttaaggaagcagaaagatcccaaacagcccaggttttttattcctttcctaaaaacaagagatcccagcataaggaggttgcccctgctctaatccctacagaaaactaacctgaagtccttgttccccaccttgcaaaagccagttttgttacctcccagttggatttgagatcaaataagtacatttatggatgcctaaagttttgtcaacctctcaaaattgacaaacaatacaaaattgaggccagatggggtggctcatgcctgtaatcccaacactttgggaggctgagatgagcaaatcactggatgtcaggagttcaagaccaacatggtgaaatctgtctctactaaaaatataaaaattagacaggtgcagtagcacacgcctataatcccaggtacttgggaggctgagacatgagaatcacttgaacccagggggcagaagttgcagtgaaccgagattttatgactacaccccagtctaggcaacagagccactccatctcaaaaacaacaacaataacaaaacaaaactgagaggttgaccaaagaggggaattgttaaagttagcctaaagctgccttcttacatattttaagttcgggcctaaagatttctcagtacatagggaactgtaacctgactagaagagaaaacaaactgcaacctactcctgtaacaagtaactcagtctccgccaatcacagcagccatacttcactcatagaccgccaactgcttaaactgtgttcagataagccaaaggcccagctgtaaccaatcctgcagtttctgtacctcacttcctttcctgtatgtcactttcctttttctgtccataaatcctctccaaccatacaccagcaccagagtagttctcaacctttcctggttcgagaggctgcctgattcgcaaattattctttgcacaattaaattctgttaaatttgtctgaagtttttcttttaacacaccttattggttctatgtctctggagaacactgcctaatacaaaccaaactaaaaagtttggtttaggtttggttttgcttaaagcagtgttttctaacgttccgtctttgttacaggatcccatccaggatttagtcaccatgccttcttaggctccttgttctgatgatcttgactgttttgaggaaacctcgtcaggtattttgtagaacgtccctcaatttgggtttgtgtgacgttttcctcatgggttataggctttttggagaaagaccatataggtaaagtgccattctcaacaatcgcatcaaaggcatacatgctacaaacaccacctcactcataacgtcaactttgatcacttggccaaggtttctccactgtaaaatgattccctttccaccttcccataggctactctttggaagcaattcaccaagctcagcccatcatcaagaaagaaatgcagaggcccacctcctggacagggaaagtatctacataaattatttgtgattcttctctacaggacatttgtcttttctatttatttatttaacagaatttatttttgtccccaagccagttctttctaccacggcttcatcgttcccacagggagtaacccccacatacccagtgaaacttttggtttatctttaatttttctcctgtatgtctcatattttaatcctttaaagagctctccattgtcatctttttccaatgttgtttagatttagtcaatctcttttccttctgtcatgactttaatccagactaccgtcttcattctctcgaagagttaacctctgagcaggtctctttttttcccctccatgcctattctgttgtaatttgccttttatatcctttagtcatactattagattattattcttatactttcaaaagtataattttagtagcattacagagtcaagaccattcccaaccctagaactcagaatggagaaagtgcataataaatatctgatgggaagtagaagatacaacaaatttttttccaccacaatttattctccacaccaggaaaataataccctgcaggaaactttaaataaacaacagaaatatttaaacattaattattttaaacctaacacatattgctaagatgtgaatgaaaagtatatatagtcacgcaaagaatatagatatcagaggagaaaatgtttaagatgttgcaaaactataggaagctaagaaaaagaaaattgtctttgcccagaaaaagaatctaagaaaacctttcaggccgcttaatgggtctcctaaaatctagcatttttgaattttctataggagaaaatcttgaataaaattacatgattacatgtaattgtgtgtgtgtgtgttgtgtgtggggggtgtagggagcggggagagagagacagagagagagagagagagacagacagagagaggagttagctgtttcttttgttttgttggtaggaggaacagagttaagttcaattaccaatgttgtaacacgtccctcagctctggcctggctcacaatagtttcactgaaatttgtaatgccagcgctttagaatttgaaatgagaaattgacaggtatctctttattctaatgatagaagcaaatacaaaacattggggtttcctaggacacaggactattcttcatttgggtcacgtcagaagtaaaactccaaaagataaaaatcactgcttcctgtgctgaaaccttactatatatggtgcactttctttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatatggtgcactttcattgtctgcttctctagcctcctggctttcttttggggattcacccaactctgtcaatctcagtctgagtgctccaggtcgggcctcattcctgacacagatagagcaaatgagtccacataatccaagactatgcacataacattcctaactggttcagggactcagacaatgacaaacaatacaacatttgcaataatgctgggacacatggaggaacaggaataaaagctactttggccaccttgccacaacgtggagactgtgaaagaagccagcccagaagcagatggtaagagaagtcagtcctgctaagatgccaagtatcaatacctatctaagcctgaagcctgtgctaaaccttgtctttacagttatatgaggcaaattctctttttacctgaagctagtttggaaaggacttcctattactataaaagaatcataactcctaactgatatagtgaggaacatgaactttttacttaaatctcactctgataaagcagaaagaagtatcagaataattttactgctttttttttttttttttgagacggactcttgctctttcgcccaggctggagtgcaatggcatgatctcggctcactggaacctccgcctcccgggttcaagcgattctcctgcctcagcctcctgagtagctgtgattacagttgcacaccaccacgcctggctaatttttatgtttttagtagagacggggtttcaccatgttggccaggctggtctagaactcctgatatcaggtgatccgcccacctcggcctcccaaagtgctgggattacaggcatgagccactgcgcctggcctgtacgtatattttctatttgcaaagtgcttaaccaatagtatcttaaatcaggtgcacatgcaaagtaacagaaaagcttaaaaataagtgcagttatctgcttctggaagtggttatttagaacaaccctttaactataaacaactaaaagtgttggaaaacaaaaatcttcttaaaagcaataaagagctaaaaataccgtaaattactgtcaagccagaactgaaggaaaagggggtacatacccaagaacacaggagagctcaaaagctcacttctgccttgaaggcacttgctaaacccatcaaaatgactgaagggccgtgtgggcagaaaccaagcccaaggcctgcccaaggtaggaaatctaatgagatagtcctcacttaaagctggcatctcaaaaggctacacccttaagacaagggtgaatcagaagtaaaccagcctttccacagatctgagcacagatttgtactgtatgggtgtttcagaaaacctcgaactgtgagaatgatgtaagatggtcttagaatggagtggtcagaattccctagcataagcaaataaaaatcctttctgaaacaagacatcataaacgataatcagcagaaaggcaaagaaactttaatagacatttaaacacagtaaacccaagtatttattctatgtttccttgggtttgaaggtatatatacctgaactgaacaatgccagctgcttatcaactgtcattcacaaacctggaacacatccacctcgtaaatactgattccagtttcaaatacatctctaacagagtctagcttatcattatttctagttctcatatttgcacttgtatcatcaaaatgcaatagtgccatgcacagtggctcacacttgtaatcccagcactttgggaggccgagatgggtggatcacctgaggtcaggagctcaagaccagcctggccaacatggtgaaaccgcatctctactaaaaatacaaaaaattagctgggcatggtggggctcacctgtaattccagctacatgggaggctgaagcaggagaatcacttgaacctggggaacagagttccagcgagccaagatcacgccactgcaccctagcctgggcgacagattgaaactccaactcaaaaaaaaaaaaagaaaaaaaaaaaaaagcaacggttttggccgggcgcaatggctcacacctgtaattccagcattttgggaggctgaggccagtggatcgcttgagcccaggagtttgagaccagtttgggcaacacagcaaaccccgtctcaaaaaaaagaaaaggaaagaaaaaaaaaaaacaatagttttgaaattttttgatggctcataattttattgaaaagacaaatggtttttgctccataattacaaaatattttcatttttatattaataaaaatcaatcagaataataaatccaatgaatattttcacttctacatcacctatttccttctaggtgcttttgtacacacacctgacttcaccatttctccagctgtctaataaactttggtgcaaaaacatcataaaaccaccagctatttgtctctctactggtaccagcaaactaccaggtatttgtctctttacatttatcttttaattcacataataattgtgaagcatttctcagcctcagaaaatcttaaaagaagctataggaataaactgctcaatagcaaaaatgaaagccaaaagacagtggaataaaaaaaaatgcactgaaagaaaaatatattccaacctaaaattctatactgtgatggattttttcaaggccacaaatcccacctgcccccctttctgaaagcacagccctttgaatgtgacattgttgctcatgccatcaacagatggagtcaggccaggcacagtggctctcatctgtaatcacaacactttgggacgccagggcaggagcatcacttgagatcaggagtttgagaccagcttggtcaacatagtgggaccctgtctctataaaaaatcagccaggtgtggtggcacacgcctacagacacagccacttggaaggctgaagtgggagaatgggttgagcccaggagtttgaggctacagcaagctacaatcatgccactgcattccagcttggatgacagcataagaccctgtccgcctaccacccgctggcccctcaaaaaacagatggattataattccttcactctttgtgtttttttggtctttttttttttttaaccacacctcacttggcactttaaccttttgaatctgggcatggctacctgacctgctttggtcagtaaaacattagcaaatgtgacatcagaggactgaaaagtgcttgtacactggagcttgtcctttccgtattgatttttggacccagccatgtgaaggagtgagacagcaagctagatgatgagacatggagcccagttgcttttttcacccaacaaactaccagacatgtaagtgaggccatctgggtctgtccaacccacagctgacctgccaagtgactacagatacatgaatgagcccaactataaccatgtataccagagagataagggatcccattgagtactgcccaaaaatctgacccacagattcaggggcaaatatgtagttgttgttcttgagtcattaagtttgggaccgggtacagaggctcacgcaagtaatccatgttttgggcaactgaggtgggaagatcacttgagcccagaagctagagaccagactgggcaacattcagagaccttgtctttataaataataataaaattagccaggtgccagctactttcaggagactgaggcaagagaatcgctcgtacccaggaggcagaggctgcagagagctgagatacagccaccgcactccagcctgggcaacagagcaaggctccatctcaaaaaggaaaaaaaaaaaaaaattagccgggcacagtggtgcacgcctgtggtcccagctatttgggaggctgatgtgggaagatagcctaagcccagaagatcgaggtgtgactgcaccactgcactgaagcctgggtgacagagaccctgtctcaaaaaataaaaataaaaatactaaaaagattagaaaacaaaatgaaagtaactaacaataaaatgcaaaagaagtttggggtggtgtgttcccagcatgtgatactgtggaatagatacttggtctctgtgcctgtttcctgacgcacagatctaactaaaagccttggagtctcagaagagataactgtcttttgcatgctactgaatgaattgaatggtggtgttgggggtggtggtggcgcttaaaaagctaatttaggatggggctagtcactggaaaaaccaaggcatgattggagggttgggactttcaggcccacccccaatctccagggaggggaaaggggctgaaggttaagttgatcaccaaagggcaatgatgcctaagtaatgaagactccataaaaaccccaaaggggctgggcacggtggctcgcacctgtaatcccagcacttggggaggccgaaatgggtggatcacctgaggtcaggagttcaagacaagcctggccaacacagtgaaaccccgtctctaccaaagatataaaatttagctgggcatggtgacacccacctgtaatcccagctactcgcaaggctgaggcaggagagtcacttgaacttgggaggcggaggttgcagtgtgagccgagatcgcaccactgccctccagcctgggaaacagagtgagactctgtctcaaaaaaaaaacaaacaaaaaaaaaaaaacacaaaacaccccaaaggactgggttctgaggtcttccagataactggacacaggttcctggagagtggcctgcctggagagggcatagaagctccttgccccttctcccatacctcgccctatgcacctcttccaactggctgttcatctgtgtccttcataatattccttaaaatacttgtaaatagaagtgttcccttgagttctgtgacctgctctagcaaattcactgaacccaaggatagtgaggggtgggagggggtggtgcctgtgggaagcccaatttatagcaggttggtcagaagcacaggtcaaacctgtgtttgaaactggcatctgaagtgacgggctgtcttatgggaatgagctctcaacctgtgggatctgatgctatttccaggtatatagtgtcaaggattgagctgaattagaggacactcagtgggtatacactgcagaattatctgcagaattggttgttggtgggggtaaaaaaatccatacatctggtgccagaagtgttgagtgactatattgagagtagatagtaggaaaaactctttggtttttcacatatcctcagacccagaaatagataattgacacataagcccagcaaaaatatcttttaagaatagggtagaatgaagatatttctagacaaaaaaaccctgacagttggccctcagaagatctttactacaagaagttctgaagaatgtattgtaggcagatgagagatgcaagaagatacagggagaaaagaaagtgctaaatatctgggtaaatatattttttttaaaaattgctttttaagtacaataataatcgtatcttaaaggattctgaaaatttgatgccagtatccactctcagacattctgatttaatttgcctgaaacatctgggtattactatattaaaaatcaccctagatataactagggttaggaaccactgacttaaattttaaaacttatacttatatatctaaagctggcatgaatcctcatcttccttccccttttatttatcttgcctttttttttttttttttttttttaaatagagacagggtctcaccctgttgcccaggctcgacctcctgggctcagcttccccagtagctgggactacagtcgcacactactgagcctggctaattagccctcctgggttcaagtgattttcccaccctggcctcccaaagagctgggattacatgtgtgagccacctggcccagcctatctagcgtcttttttttttttttaaacggggtctcactctgtcacccagactggagtgcagtgacgcaatctcggctcactgcaacctctgcctcccaggcgaaagtgattctcccagctcagcctcccaagtagctgggattacaggcgcacaccactacaccccactaattttttgtagaggcatgacttctccatgttgcccaggctgtcttgcctctttttaagctactgactcatgattctccacggaagtaagcaacatgcgtgtgcacgcgcacacatacacacatacacttattatctctgtaatacaaagtagctcagcctaaagatactaaaggtctaaagaacactaagcttctcagcctttggtgaagatgaagtggaaaaaacaattactatgtaatttctaattatttcccatcaacaggatatgactatttaaattcagagggtgttcacagttgcaagcatccaagaaaatctcagctaaagctaacgctaaacaggttttctggttaatgttcttctacggtatattcagcaaaatattatctaatataaaagaccagactgcaggccatctgttaacagtaacagatagggatactgcattactcaaaactgactatgttaactgttcattttcctaaactgctctgttgactagctatgaaggatggtgcttatcatctaactcaaaatgcaaatatcagaattaacccccaaagcaagcctttgaatgatgaaagatttccaaaataataaattttggcaacaaaatcaaaataaaaaagaggtagaatctaggtcagtgcagtggctcacgcctgtaaccccagcacttcgggaggctgaggagggaggatcatttgaggccaggagtttgagaccaacctggccaacacggtaaaatgccatttctactaaaaacacaaaaaattagctgagcatggtggtgcacacctgtagtcccagttgcttgaaaggctgagacacaagaatctcttgaactcgggaggtggaggttgcagtgagcctagattgcaccactgcactccagcctgggtaagagagcaagactctgtctcaaaaaaaaaaaaaaaaaaaaaaaaaaaaaagacagagagagagagagacaggaggaatccatataaagaacaagaagccgggtgcagtggatcacgcctgtaatcctagcactttgggaggccggggggggggggggggcggatcacgaggtcaagagttcaagaccagcctgctcaagatggtgaaatctcacctctattaaaaatacaaaaattagctgggcatgatggtgggtgcctgtaatcccagctactcaggaggctgaggcagggaattacttgaacctgggaggcagaggctgtagtgagctgagatcacaccactgcactccagcctaggccacagagcgagactccatctgaaaaaaagaacaaaaaaacactgcacctaacagttaatacaaatgagtaaactgtctgaatcacacactgattttgagatgcaccattactttacgtaccactaggggagaaatattctaccaatcatatgatgtcataaaatttaagatgcattctgatttcaaagatgttaagatgaaaaattaacagcatgttttagaatcaataagacatcacaaataacaaaatattatgaccaggtaaccagaggacttttgctggaagctaactaccaatattagaactcaaccaaaccaaacatacaaccaactgtaacaccaaaatacagcctcaaagatctctcgctctgtttttgtttgtttgtttttttgagacagagtctccctctgtcgcccaggctggagtgcagtggcacaatctcagctcactgcaacctctgcctcccggattcaagcaattctcctgcctcagcttccgcagtagctcgctctttatttttatgctgtaaatatagatatcaatgagaaaatattgatttcatagagaagtggcaatatattcaaattcatcaccaacaaaaaagcagtatcacgaaaccatatacaaccaacagtaagcatacaagcacagtgtgctctcatgctctctctctctctctcaaaattccaaactagccaggcgcggtggttcacgccagtaatcccagcactttgggaggccaaggtggcagatcacctgaggtcaagagtttgacaccagtctggccaatgtggtgaaaccctgtctctactaaacatacaaaaattagccaggcatggtagaggttgcctgtaatcccagctactcaggaggctgaggcagaactgcttgaacccgggaggtgaaggcggcggtgagctgagatagcaccactgcactccagtctgcgcgacagagcgagactccttctcaaaaaaaaaaaaagttcaaactattttaagtctgtggtgtcatacatacacatttggccctggttaataaaactccacaccaactattaaagactgacaaattccgtgaatttctataaaaatgcaagacatataaagagaatacagccaaacatttttctaacttaaaatgacaccatgatttggatggatcatagaccattttaaatgagttgcatgtacattatatattatagtctaagacacgtgtcagcaaattttttcagtaaagaggcataccatacttattttaggctttgcagaacacatacaatctcttgtggtctctatggcatccccttaataaccttttaaaattataaaaaccattcttaactccagagccatactaaaacaggttgtggggctggatctgtcccttggactacagtttgcccacctctggtctgagatataaatggggcataaatgagtgcttcataaaataaggttgctggagaaattagagaacaaatctattcttttttaaggtacaaaaattgctaaacaaaaaaataatgaagcctgctgaagaaaaaatttttattgttttcattttaaatataatctttgagtatactttctttactcatgaatgagatactgaattgagtagctgaagaaatatttttatttttacctcttggaagaaaccatgtaccctgcatataaattctaaccactcctaattttttttttttttttttagaggcagggtgaatgtcactctgtcagtctcccagtggcatgaacatagctcactgcagcctcaacttcttgggctcaaacaatcctcttgcctcagccttccaggcaactagcaccataggtgcatgccaccatgcctggctaattgtttttaattttctggtagaaacaggagtctctccatgttgcctaggctggtctcaaactcctgggctcaagagatcctcccaccttggcctcccaaagtgctgcaaatacaggtgtaagcccacttattttaaaaaatagacattgaggactgggtgtggtggctcctgcctgtaatcccagcactttgggaggccacggcgggtggatcacccaaggtcaggagttcgagatcaggctggtcaacatggtgaaaccccatctctactaaaaatacaataataagccaggtgtggtggcaggcacctgtaatcccagctactcgggaggctgagacaggagaatcgcttgaactcaggaggcagaaagtgcagtgaacagcaatggcaccattgcactccaccctgagaaacaagagtgaaactccatctcaaaaaaaaaaaaaaaagaatcccaaatacaataatgaaaaactataaaacaggaaggggtaagtattctgacttcacacgaaaacattctttttatttttatttttttggagacattgtctcattctgtcacccaggatggagggtagtggcatcatcatggttcactgcaagcttgatctcttgagctcaagcaatcctgcttcagcctcctgagtaactgggaccacaggcactaccagccaccatgaccggttaattttatttttattttttgtagagatgaggtttcagtatgttacttgggctgatctcaaattcctgagctcaagtgattcttccaccttggcctcccaaagtgctgggattaaaagtgtgcagtggctcatgcctgtaatcccagcactctgggaggccaaggtaggaggattacttgaggccaggagttcaagaccagcctggacagtagagaaagaccttgtctctcaaaaacaaaacccattctaacagcaatcatttggatttgctccttgttctctgttaaaactaaaagaatgagtaagacacaattttggttgtctgaggtattttgtttgtttttgtttaattagacctaagttgcaatacatttgatctctttttgaaaaactgtttattatgagtatgtgatgactcatgactgatgaataagactgaaacaagaaggaaatggacgaaaattgatctcattaaagtagataaaagctttttgtagaactcagccaactaatgccatctcctgcagctactgccttgtccaaatactctttgtggcaccgcacagtccattttatcctctagctttgtaggatgtcttactttatgaagttcaatttcagagtaaactctgtcaagtgtgttttatgaagactaaatgttgcttgtaataagtcaacggataatgtctaatttttttaaaaaaatcaagagaacagcttacacattctatttaaaaattaggtaaataagagtaaagagctaaaacagttgaaattgcagagaactaagactgactgtagtccttcattatcaacctgatagcgctctgacttaaaactatgaagatgcattacttggtttaaagggagacgaagagattaaatccatgtgcctgccagaacacaggcctccttagagtataggagtatgttctgaaggctgaatgcacacacaaaaaaagctatctgatgtagatatattgattctgtggttttttaaaatcttccccaatacaattaacatgcagtatcataagtcattctgtgaaaacaagatttaggataaggtttttgaaataactttttctccaaaatgacatggtctcacaaggcatttaagtaatctttaacaagatgaaaataggtaaatgtgtcctgagaattctgcatttatgtctgcatttattaagagccagctcttattgatccatatgaatgggttggaatcctgaacaacaaggttcaggtttgccctaggaatgctgagttgcaataacgtacacaagctgagaagttaaattcataagttgtttttaaaactcaacccaggagttccaggctgtagtgagctatgatcgcgccactgcactccagcctgggagacacagcaagaccctgtctcttaaaaatacaaacaacaacaacaaaaaaaacagcctgggcaacatggtgagaccccatctctactaaaaacacaaaaattagccaggtgtggtggcatgcgcctgtagtcccagctcctggggtggtggaggctgagacaggaggatcacctgagccttgggaggtaaaggctgcagtgagccgtgattgtgccagtgcactccaggctgggtgacaaaatgagaacttgtctcaaaacaaacaaacaaaaaacccttggccaggcgcagtggctcacgtctgtaatcccagcactttgggaggccgaagtgggtggatcacctgaggtcaggagttcgagaccagcctggccaacatggcaaaaccccatcactactaaaaatacaaaagttagccaggtgtagtggcacacacctgtagtcccagctactagggaggctgaggcaggagaatggcttgaaccagggaggcggaggttgcaatgagctgagattgggccactgcactccagcatgggtgacagcaagactcagtctcaaaaacaaaaaacaaaacaaaacaaaaaaccctcaagagatcttcatatgaagaccttagcatggccacgcacagtggctcacgcctgtaatcccagcactttgggaggcgaaggcaggtggatcacaaggtcaagagatagagaccatcctggccaacatggtgaaaccccgtctctactaaaaatacaaaaattagctgggcgtggtggcacgtgcctgtagtcccagctactctggaggctgaggcaggagaatcgcttgaacctgggaggcagaggttgcagtgagccaagatcctgccactgcactccaggctgggtgacagagtgagactccgtctcaaaaaaacaaacaaaaaaccttaggataacttttccagaagagctgaatctcatgttgcaccattttttaaaacacaggcctaaatcctaaaggctatttatcaggtataaaagatgctaaatcaaaaaaccaaattttacgcctgtgcagtggtttatacctgtaatcccagcactttgggaggctgaggtgggaggattgcttgagcccaggagtttgagaccagcctgagcaacatggcacaacccccatctctacaaaaaaaactaaaaaaaaaccaaacaaaaaaaccaagcctggtagcatctgcctgtcgtccctgctactcaggagaccaagatgggaagagtgcttgggcccaggaggtcaaggctgcagtaagccatattcacgccattacactccagcataggaaacagagagagaccctatttcaaaaagaaaaattttttttaaattaactcaaaatggatcaaaggcctaaatgtaagatctaaaactacaatatactgtgaagcaagcataggagaaaagcttcatgacattgaatttgcaataatttattggctatgacactaaaagcacagacaacaaaagaaaatgataaagtaaactacatcaaagttgaagacgaccaaatcaatagagtgaaaaggcaacctatgaaaaggaagaaaatatttgcaggtcatctatctgatgagaggttaatattcagaatatataataaactcttacaactcaacaacaaaatacaaacagcctgattaataagtgggcaaggatcacctgaggtcaggaatttgagaccagcctgaccaacatggtgaaactccatctctactaaaaatacaaaaaattagtgcaccgttgcactccagcctgggcaacagagcgagactacgtctcaaaaacaaacaaacagaaaataagtgttggtgaggatgtgaagaaattagaactctctgaactgttggtgggaatataatatgatgcagctgctgtgaaaaacagtatgccctaacctcaaaaacttaaaaatagaattgccatatgacctagtaattccactactgggtatataccaaaaaaaagtgaacacagggtctcaaagagatatttgtatacccacattcacagcagcattattcacaaaagccaaaaggtagaagcaattcaagtgtccattaacagatgaacagataaacaaaatgcagtgtatacgtataatggaatgttattcacctttaaaaaggaaggaaattctgatacacatgccgcaacatggatgaaccttcaagacattaaaagtgaaataagccagacataaaaggacaaatatcacgattccacttacatggaatacctagagtagtcaaattcacagagataaaaaatagaatggtggttgccagggactctggaatgggaagttgttatttaatgattatggagattcaatgtaagatttaaaaaaaaaaaaaaaaaaggccaggaggtgcttcatgcctgtaataccagcactttgggaggctgagactatctaaaagggaggacactcctgttaacaaagatctttcaagattaaggaaaccccagcacctcgggatgttgaggcaggcagatcacctgaggtcaggagttcgagaccagcctggccaacatggtgaaaccccgtctgtactaaaaatacaaaaaattagctgggcttggtggcgggcgcctgtaatcccagctactcgggaggctgaggcaggacaatcgcttgaacctgggaggcagaggtcacagtgagtcgagatagcgttactgcactccagcccaggcgacggtgagactccgtctcaaaaaaacaaaacaaaacaaaacaaaaacaaattcaaagtacaaatcatgttctgtgacaccacattggcttgaaccctctcctccttcctctcttgcgtagcattttacatgcaccctcttcctctccagcatttccaatctctcaccctctctactggttccctgtttctttgcctttaaaacagattttcctagatagtaagattggggtgaaaaatattttaataaataaaaaaatagatctccataatctgtttttttgtttgttttttgagacagacttccgctcttattgcccagggtggagtgcaatggggcaatctcagctcactgcaacctctgcctcccaggttcaagtgattctcctgcctcagcctcccaagtagctgggattttaggcatgcgccaccatgcccagctaattttgtatttttagtagagatggggtttcatcacgttggtcaggctggtcttgaactcctgacctcaggtgatctgcctgcctcaacatcccaaggtgctgggatttccttaatcctgaaagatctttgttaacaggaatgtcctcccttttagatagtctcaccttctcttcactatcaaacttttcggtcaaaatctgggttctgccgggcgtgggggctcacgcctgtaatcccagcactttgggaggccaaggcaggcggatcacgaggtcaggagatcaagaccatcctggctaacacagtgaaaccctgtctctactaaaaatacaaaaattagccgggcgtggtggcgggcgcctatagtcccagctacttgggaggctgaggcaggagaatggtgtgaacccgggaggtggagcttgacagtgagccgagatcgcgccactgcactccagcctgggtgacaagagtgagactccttctcaaaaaaataaataaaataaaataaaataaaataaaataaaataaaataaaataaaaatctgggttctatagaaggtattctatctcttttaccagaaaccatgctcttttctcagtcattaactttagctgtgctactctagttacccaagggtttactaccttttaaatttctcttttcttgactctcacaactaaaatttccctttccttggcttccacaactaaactcctgtaaatcttcttgtaactcccaaccactcctcctgttacctataattccctccacaagcctctttccaacccttcatcgcaagctgtccccagggctcagtccttggaatcatagtcttctatttacacattctttaagagggcttggccattttcatagccccaactatagccttataagcaggatgactctaaaatttagactcagttcaagagttagttccaagtttatatcctcttactggaaactgcctgaaatgcctagctgtcatttcaaattcagcacaaattacatatttttggaggtagtgtaacagttaaactttgacttttttggggggttgggcgcagagtttcgctcttgtcccccaagctggagtgcaatagcgtgatcttggctcactgcaacctccatctcccgggttcaagcaattctcatgcctcaactccctagtagctgggattacaggcgcacgccaccacacctggctaattatgacatttttagcagaggcagggtttcaccatgttggccaggctggtcttgaactcctgacctcaagtgatccaccggcctcagcctcccaaagtgctgggattacaggagtaagccacggcacccagcctaaactttgacttctcttcacttggttaaattctatcattccttcagctcaatcatcatcttctcagggagacatatccagactccaattagccaatgtccaagcatctctctttcaaagctctcaccatggctacgtcctccactcgaccatgtcttttagaagggggagctgagggtatcatcatcaccacattcccagcacctacaattaaggtgctggcacacagtaaataatatttacccaaaatttgtcaaacgaatgaacaaaagcactgtaaatttttcctaggtaagaagtccccatcaatcccacttctatctcctttgctactagtctcctttggcccaagtctgttttgaggtctcattgtaacagcagctttctcagcgccttcaattttcctcacttcaattcatagtgccccgagtaatttccttaactatttcatcatgacattctcctacccaagaatgtttatagacctcctagttcccccgaaaacaaaactaagttaatatagacatttcaatagacagccagctttgacaagaacagtaatgccagctgctcaggacccttcccactagccatgcacggcttcgaaaaacattgactgttttctttgactctcctttattctccttgcagacaataatatgaacttggaaatgttactattaattgcatcataaatgcctaacattaattaacgaagttttgttagcaatacatttataaaccatctcttagggtatctttcttacaaagcatgattaatattatttataacactcttaccaattagtttcagtttcactttagaaacctatccttaaatcctagggagctaagtaagctatgaagaggcaaaggcataagaatgatataatgaactctggggacttggggtagagggtgggaagcggttgaggaataaaaaaaccacacactgggggctgggcacggtggctcacacctgtaatcccagcacttcgggaggctgaggcgggtggtcacaaggtcaagagatcgagactaccctggccaacatgatgaaaccccatctctactaaaaatacaaaaattagctgggtgtggtggtgcgcgcctgtagtcccagctacttgggaggctgaggcaggagaatctattgaatctgggaggcagaggttgcagtgagctgagattgtgccactgcactccagcctggcgacagagcgagacttgtaaaaacaaacaaacaacaaaaaaacccctacacactgggtacagtgtacaatgctcgagtaatgggtggaccaaaatctcagaaatcaccactaaagaaagaacttattcatgtaaccaaacaccacatgttccccaaaaatctattgaaataaaaaaaatttttaaaaccctatctttaaatcgcagattcaaaaactctaagtaaaattgaccaggcacagtgagtgactcatgtctgtaatcccagcactgtggaaggccaaggcaggcagatcacctgagctcaggagttcaagactggtctggccaacatggtgaaaccccatctctactaaaaatacaaaaaattacctgggcgtggtggcacacacctgtagtcccagctactcgggagactgaggcacgagaatcacttgaacccaggaggtggaggctgcagtgatctgagattacagcagtgcactgcagcctgggcaacagagcgagactctgtctcaaaaaaacaaaaaagaggccgggcctggtggctcacgcctataatcccagcactttgggaagctgagatgggcggatcatgaggtcatgagattgagaccatcctggctaacagggtgaaacctcgtctgtactaaaactacaaaaaaaattagccgggcatggtagtgtgcgcctgtagtcccagctactcaggaggctgaggcaggagaatggcgtgaactcaggaggcagagcttgcagtgagccaagatcacgctactgtactccagcctgggtgacagagcctgagactccgtctcaaaaaaaaaaaaaaaaaaggcctctaagtaaaattatgacaaataaagtttagttatctaaagtaagatttggccggatgaggtggctcatgcctgtaatctcaacactttgggaggccaaggtgggtagaccacttgaggtcaggagttcaagaccagcctggccattatgataaaaccctgttcctactgaaaatacaaaaattagccaggtgtagtggcgggtgcctgtaatcccagctacttggggggccgaagcaggagaactgcttgaactcgggaggcaaaggctgtagtgagccgagatcacaccactgcactctagcctggacaacagagcaagactctgtatcggaaaaaaaaaaaaaaaacaagaacaggtggtaaacagggtgaatcctatggtaagtgaatttcatctcaatgagttagaaagagctgataaggaaaaaaacaaaaacaaaaacaaaggcaaggccctaggaaacgaatggaaccacaagataaaaggaacctgggtctctggatcaccagatgactgcatcacagtcccccacaacttctcttgtgttcaaccactgatatttttgggttttttatggaagttagttttgtcctaattagcacatgaactgaaaggaaatcttttatcttgtacactggtaaagggcttattattagctcaactcaattacaagacaagttgaccaccttgacacacaatgaaattatatcatgcttaaatatttttccattgggcaatggaaagataattttttttttgagacagggtctcgctctgtcacccaagctggagtgcagtggcacaatcataactcactgcagcctcaatctcctcagctcaaacaatcctctcacctcagcctccagagcagctgggactacaggagcctgccaccacgcctggctaatttttttgttttaataaagtcagaactttggatcaaaatacacacacatttgtaattctaatttttttttttttgaaatgtagtctcgctattgttgcccaggctagagtgcagtggcgtgatctcagctaactgcaacctccacttcctgggttcaagcaattctgcctcagcctaccaagtagctgggattacagcctcccaccaccacaccctgctaatttttgtattatcagtagagatggggtttcaccatgttcgtcagtctggtctcaactcctgacctcaggtgatctgcctgcctcagcctaccaaagtgctgagattataggcgtgagccaccgcacctggcctcattaatctctctttctaacaaattctccccattccttcccacatttaatatgtcagaagttaaaatccaagaagtaatgatttctacttccactcatgaggattaactactatggaaactatctcccttactcccattgtgaacgagacacaatatatgacgtaaccttcagtcactggacaacaggcagcattaactatgatccctgagagaaggcaacaaaccaggtgagccgatgattacctagcttactgtatggaagtggcttcccggctgcaacacagggagagggaacccaaacagaattggatagtcttgctgaaaagaggagagaaattaaactttagggtatctaaagcagctagaatttgaaagatttgaatagtggaaccaagaaagagtgagaataaagagttctgtactgagaatggtcacaggagatttgtggagggatccccttgaatctaataaacaattaccacacttgtaaagcaggaatatgactaataacaaaacttaatcaatagaaaaagatcaagaaatgacagacatgatggaattagcacatgaggacctcaaacagctattacggctgggcacggtggctcacgcctgtaatcccagcatttcgggaggccgaagtgggcgatcacgaggtcaagagatcaagaccatcctggccaacacagtgaaaccccgtctccactaaaaatacaaaaattagctgggcattgtggcacgtgcctgtagtccggaggctgaggcaggagaatcacttgaacctgggaggcggaggttgcagtgagctgagactacaccactgcactccagcctggcgacacagtgagactccgcttcaaaaaagaaaaaaacagctattgcaagtacactaaagggtgtaaagaaaaacatgaacataatggataatcgaatatataaataaaacacccaaatcaaacgtctataggtgaaatatacttaaaatacaaattcactggatggtattaatagctgactgaaaactacaaaagaaaacatcagtgaacctgaagatcagcaatagcaattatccaaaatgaaacacagagagaaaaaaaacagggggagcgttggtggggggattaaaaacagagcccacttgtgggacaatagcaatcaatttaacctacataagattagagcccaggagagaaagagggacaaaaaaactgtctgaagaaatagtgggcaaatagtatgtgatcaaatatttgttgatggatttaaataaaaatggtaggggcataaaaatataaaaaaaatagcatgaaaatatgttatctatgtaaatgtgaaaaataacagagaagcaatgtggtaacatggaaagacagaggctttgaattttaaaagatttgaatttaagctttttggatttgaatttaagctctgtttctttctttctttttttttgagacagggtctcactctgatgtccaggttacccattctgttgccactgcagcctcgacttcccaggctcaggtgatgctcccacctcagcctcacaagtagccaggactacaggctctcaccaccacactgactaatttttgtatgttttgtagagatgaggtttcgccatgttgcccaggctgatctcaaactcctaggctcaggaaatccacccgccttagcctcccaaagtgctcggattacagacatgagccaccacacttggcctgttcttaacattatgtgacttgggcaaataaaaatctatctgattcgtggtttttcacctgtaaaataagtctcatatctgtcatatctaccacacatggttatcaagagctacaaataagattaaaagggttccataaactgaaagctaaatagcaacttgactaagaataatcaaatagggaaaaggttgttagaccaatatccttttttttttttaaatcaaatgtatttggtgagtggccgggcatggtggctcatgcttgtaatgccagcactttgggaggctgaggggggtggataacttcaagtcaggagttcgagaccagcctggccaacatggtgaaaccccgtctctacaaaaagaacaacaacaacaacaaaaaattagacgggcgtggtggcgtgcacctgtaatcccagctactcgagaggctgaggcaggagaatcacttgaacccaggaggcagaggttgcagtgagccaagattgcgccactgcactccagcctgggtgaaagagtgaaactctctgtctcaaaaaaaaaaaaagaacaattatgttaaaccatatgaaaatgtttttataagtcaaatatgatgaaatattggtaatttcttatagttcattcaatctaacaaaaatgaaggaagaaaacaatgcctaaagcagacctagctggcaggggaagagaagcagcgggctgtgctgagggaagggcactgggaaatattttggtgcagcaaattcccaaaccactgatataaaatattttcccaaaaataacacttacatataagccctgtaaactctgaagctgtaactctgtactctccaaaagcccacaccactacactatttatttgcgggtgtggggcagcaagatgtgtatggagccagtgcgaagcagaggcaagcaggctgagaatctgggctaaagaatgggaatttccacaagaggaagggaaacacaacaatgtcttctgacttctgctttcagtgctctaatttctcctatttcacatatactctcaagttgaaaaggaaagtataccaatagtaaaaattcttggccgagcacggtggtacacgcctgtggtcccagctgctcaggaggctgaggcaggagaattgcttgaacacgggaagcagaggttgcagtgagctgaaatccagccaatgcactccagcctaggtgacagagtgagattctgtttcataaataaataaataaataataaaaatataccgatagtacaaattcttgaaacttcacttttgttgttgttgttgtttttttgagatggagtctagctctgtagcccaggctggatggagtgcagtgacacgatctctgcaagctccgcctccagggttcatgccattctcctgcctcagccttccaagtagtagggactacaggcgcacgccaccacacccacctaagttttttgtattttttagtagagacaggatttcaccatgttagccaggatggtcttgatctcctgatctcgtgatccgcccacctcggcctcccaaaatactgggattacaagcgtgagccaccgtgcctagccgataatttttctttttttaccattataagaagtttcaggccaggtgccatggctcacgcctgtaatcccagcactctgggaggccgaagcaggcggatcacctgaagtcaggagttcgagaccagcctgaccaacatggagaaaccccgtctctactaaaaatacaaaaaaaaatagccaggcgtagtggcgggcgcctgtagtcccagctactcagaaggctgaggcaggagaatggcgtgaatccaggaggcggagcttccagtgagccgagattacaccactgcactccagcctgggcaactgagtgagactccgtctccaaaaaaaaaaaaaaaaaaagaaattagccgggcgtggtgacaccacatgcttgtaatcccagctactcaggaggctgaggcaggagaatcacttgaacctgggaggcagaggctgcagtgagccgtgatcacaccactgtactccagcctgggcaacaagagtgaaactgtctcaaaaaaaaaaaaaaaagaaaaaaaaaaaggaaagcatcaccaccaccagacacactaaaagctgctatcaatacacataagtcaggttctaacaaacctaccaaactcagagttttaaaatgaaattgtgtcaaaggagggcctttcttgttaaaaaaaaaaaaaattaaaatataaaaatatgaaaatgaagttgtggattttcaactatttcaaaactctgctgcctagttacttctgaaagaagacttacagggccggatgccgtggctcacacctgtaatcccagcactttgggaggccaaggtgggcggatcacgaggtcaggagtttgagaccagcctagccaacacggtgaaaccccgtctctactaaaaatacaaaaattagctgggtgtcttggcatgcacctgtagtcccagctactcaggaggctgacgcagaagaatcacttgaacccgggaggcggaggctgccgtgagccaacatcgtgccactgcactccagcctgggtgacaaagcaagactccatctcaaaaaaaaaaaataaaggcctggcacggtggctcacgcctgtaatcccagcactttgggaggctgaggcaggtggatcacaaggtcaggagatcgaaaccatcctggctaacacggtgaaatcccatctctactaaaaatacaaaaaaatagctctgcgtggtggcgggtgcccgtagtcccagctacgtgggaggctgaggcaggagaatggcctgaacccgggaggcggagcttgcagtgagccgaaatcgcaccactgcactccagcctgggagacagagcaagactctgtctcgaaaaaaaaagaagacttacaaaccaaaaattttttgcgctgtccttaacgtatggctaagtttagtatttatatcttagtatcacagactgtttcacaggccagagaaatgttccaacctgggaaatatgagagcaaaaggccttacatattattttccctctgaaaagtcaccatctttcagaaaaatttcagtaatttttgaatttatctggttttatacagggaaaaaaagcagtcttctgaactattctttttccccttatacgtgggagcagagttttcctttgataggcagtattccaaatttggcagaacataattcctttacccagaggatttaccccttcatagtgtacacatttaaataccatgcatatatgtatgtatgtagagttgggctctcaccgtattgccaaactggtctcaaacctctggcttatgcaatctgccaccttggccgcctaaagtgctgggctgtgggccactgtgcctggccttctgtaatttattcactgattgattgattgattgagatggagtcttgctctgtcatccaggttggagtgcaatagagcgatcttggctcactgcaaactccacctcctgggttcaagcgattctcctgcctcagcctcctgagtagctgggattataggcacatgccaccacaccttgctgatttttgtatttttagtagagacagggtttcccccatgttgcccaggctgttcttgaattcctgacatcaggtgatccacccgccttggcctccccaagtgctgagagccactgcacccggactgtttatataaatgttcttgaccttattccaaagctttatggaagaagctctggaaggattatataaagggtgtgaagcattccagtttatttcacacttctcttaaggcagcgaacaaaaagcattatctcgaatgatctcacctataacaacaaaggggaaagggaagaccatttataaataagaaaactggaggtctgagagattaatttgcccaacatcataataactggtaagtgagctagggtttgaatccaggactgcagctccaaagcccattctatttttccatttaccacaatgcttttcctctcatcacaagcttcacatgactataggaccttctctcttcttattttatttcatatataataggtgtgtcctcagcaaatggctgctatcgtttgaatatgtcccccaaagttcatgtgttggaaacttaatccccaatacaagtgttgagagatgggacctttaagagctcactaggtcatgagagcactggtctcatgaatggattaatgcccttatctccgtgatcctgggagtggggttctgataaaaggatgagttctgcacattccttgtgcaagcccgccctccctcttgcattctcttgcccttccacattctgccatgggatgatgcagcaagctggccctcaccagatatggcctctcaatcttggacttcccaacctccagaaccatgagccaaataaatattcctttatatattacccagtcttgggtattctgttatagcaacacaaaatggactcagacaatggcactaattaacagatggcattacgtttgtcaatgattaaaattctccattacacccctttctgcatcgttgaagttactgtccacttcatgctatttatcacattacagagctgatatggccagtgcaagaattttgagagttctgttaaatgacttgcagggcagtctttatagtttacacctaaattacaagtgaagtaccagagcttttttttttttttttttttggagacagaatttcactcttgtcacccaggctggagtgcaataacgcgatctccgctcactgcaacctccacctcccaggttcaagcgattctcctgcctcagcctcctgagtagctgggattacaggcatgtgtgaccatgcctggctaatttttgtatttttagtagagacagggtttcaccacgttggccaggctggtctcaaactcctgacctcaggtgatctgcccgcctcggcctcgcaaagtgctgggattacaggtgtgagccaccacacctggccaggtaccagagcatttttaacataatttcttttgctgtcatttgtttaaaacttgtatttcaattgatgtagaacttacattcctattctcctggttaattttactcatctaccatttcacttcattgtttatcattcttatgattttaaataagtataacatttttatttttttcttgttgtcatttttttgagacagagtctcactgttgcccaggctagagtgcaatggcacgatcttggctcactgcaacctccgcctcccaggttcaagcaattctcctgcctcaccctcctgagtagctggggttacaggcatgcgccaccatgtctggctaatttttttattggtaggagagacgggatttcgacatgttagctaggctggtctcgaacccctgacctcaggtgatctgcccacctcagcctcccaaagtgctaggattacaggtgtgagccactgcgcccagcctatcacatttattttttaaagaaacacaaaattattttaagaatttgttttattttacaagtgtatagatccaggattcaagtcagcacccatttttaatatgattcaccctatcaagaattataggtgttattcaagcctttaataggaaaatgtacaggtcctgtaaatatcacacattcagtcaaacaaaactttctgatttcagtaaaattattaaagctgaatgactacagatgcctggttctcttaagtcattgtttttagattccagtccacactccttgttccttcacactctattttaatgcagatacaaagggtagtactggcacagttctgaggaccatcacttaggatcttttcttaagtttcaaatctatctaaggcaaccaaaataagatgagtcactaactgacctccagttttatcagagtattgttctcaagtggaaggagctaaagcaccccttacaactcataaattaggcattcggaagatgaaatctactcatgaacaagattaggaggcttttgttttgttttgtttttgagacagactctcactctgttgcccaggctggagggcagtggcacgatctcaaaatgtgtacactttgaaggggtaaatcctctgggtaaaggaattaagttctgccaaatttggaatactgcctatcaaatcaaaccatgttgatttaaggccggcgcggtggctcacgcctgtaatcccaacactttgggaggcagaggtgggcagatcacgaggtcaggagatcaagaccatcctggctaacacagtgaaacctcgtctctactaaaaatacaaaaaattagctcggcgtggtggcagacgcctgtagtcccagctactcaggaggctgaggcaggagaacggcatgaacccgggaggcggagcttgcagtgagcggagatcgcgccactgcaatctagcctgggcaacagagcaagaatccgtctcaaaaaaaaataataataatttaattaacatgaaccaccaatttaagaagaattaaaagtactgaagggctctgggtgtggtggctcacgcctgtaatcccagcactttgggaggccgaggcaggcagatcacaaggtcaggagatcgagaccatcctggctaacacgttgaaacctggtctctactaaacatacaaaaaattagccggtcgtggtggcgggcgcctgtagtcccagctactctggaggctgaggcaggagaatggcatgaacccaggaggcagagcttgcagtgagccaagatcgcgccactgcactcccgcctgggcgacagagcaagactccgtctcaaaaaagaaagtactgaagggcttttttttctgattctcccaaccatttcctgtactgtacgcctacagcatttaatttattcttctcttatgacacttattactttaaaacttgtattatggttttcagtaaagatatctttttcttctagatcagtgctattcataagtatgtgagacacatacataattttatgttttctagtagtcatttatttttaaaaagtaaaattgattttgtaatttattatttaacccaatatatcgaaattttttttaagacataaacaatataaaaattattgggccaggtacagtggctcacgcttgtaatcccagcactttgggaggccaaggcgggtggatcacctgaggtcaggagttcgagatcagcctggccaacatggcgaaaccccatctctattaaaaatataaaatttgccagccatggtgccacatgcccatagtcgcagccactcgggaggctgaggcaggagaattgctcgaacctgagaggcagaggttgccccttatacgtgaaagtggagttttcctttgataggcagtattccaaatttggcagaacttaattcctttacccagaggatttaccccttcaaagtgtacacattttgagatcatgccactgccctccagcctgggcaacagagcgagactctgtctcaaaaaaagaaaaaaaatttattgtgggctgggcgtggttgctaatgcctgtaatcccagcactttggggggctaaggcaggtggatcacctgaggtcagcagttcgagacaagcctggccaacatggtcaaaccccttctctactaaaaatacaaaaattagccagaagtggtggcgtgtgcctgtaaacccagctactcgggaagctgaggcaggagaattgcttgaactcgggaggcagaggttgcagtgagccaagatcgtgccattgcactccagcctgggccacaagagactccacctcaaaaaaaaaattattgtgatattatgcatccttttggtactaaatcttcaaaatcaaatgtgtattttatacttacagcacatctcaattcaaacaggccatgtttcaactgttcactagctgcacgtggctgatgactaccacagtagacagtgcagtcctaggttacttatgctttagggacaggggggaaaatgagctatcacacagctggactgacttgttttcaaatcttgattccactacttacaagccctgaggcaagctatttagaatcagttttctcactaaaaataataggatgtaataggctgggtacagtggcacatgcctataattccagcactctgggaggccaaggcaggaggactgcttgaactcaggagttggagaccagcctggacaacagagtgagacctcatctctacaaaaaaaaacaacttttaaaattaaccgagtatggttactactaaggaggagatactcaggaggctgaggtgggatgatcactcgtgctcgggaggcagaggctgcagtgaatcatgatcatgccactgcactgcagcctgggcaagagagtgagacctcgtctcaaacaaacaaaaaaaaaacccaaaacaaaactcaccaggcacagtggctcacgcctgtaatcccagcactttgggaggccgaggcgggaggatcaccaggtcaagagatcaagaccagcatgtccaacatggcgaaaccccgtctctagtaaaaatacaaaaattacctgggcgtggtggggtgcgcctatagtcccagctactcaggaggctgaggcaggagaatcgcttgaaccagggaggctgaggttgcagtgagctgacatcatgccactgccctccagcctggatgacagagtgagactccatctcaaaaaaaaaaaaaaagaaagaaaaaagaaaaaaaaagctccggtgatagatggtggtgcaagcagatcacctgaggtcaggagttcaagaccagcatagccaacatggcgaaatcctgcctctactaaaaaaacaaaaattagccgggcgcagtggctcacgcctgtaatcccaacactttgggaggccgaagctggcggataacgaggtcaggagattgagaccatcctgactaacacagtgaaatcccatctctactaaaaaatacaaaaaattagccgggcatggtggcgggcgcctgtagtcccagctactcgggaggctgaagcaggagaatggcgtgaacccgggaggtggagcttgcagtgagctgagatcgcaccactgcactccagcctgggtgacaaagtgagactgcctcaaaaaaaaaaaaaaaaaagctggacatggtggtgtgtacctgtagtcctagctactcatgaggctgaggcaggagaatcgcttgaacccgggagccagagattacagtgagctgagatcacaccactgcactccagcctgggcgtcaagagcaagactctgtctcgaaaacaaaatcaaacaaacaaaatcaataagaatgataataataaaacatctctcataagattaaatgagataacgcctagaaagcatccagtccctcagaacagggcacacagaaaaccctcagtaaatgctaaccattataagtagcagtagtatacttgaacactgagcagtgtcttgcacacaggtttcaataaatgtttgctgaaagaagaaaaattggtcgggcgcggtggctcacgcctgtaatcccagcactttgggaggccaaggcgggcggatcacgaggtcaagagatcaagaccatcctggccaacatggtgaaaccccgtctctactaaaaatacaaaaaattagccgggcgtggtggcgggcgcctgtagtcccagctactcgggaggctgaggaaggagaatcacttgaacccaggaggtggaggttgcagtgagccgagatcgcgccactgcactctagcttggtgacagaatgagactccatctcaaaaaaaaaaagaaaaaagaaagaagaaaaattaatttacatgatagcctataagccattttaactgctgcttttaaaaatatataaataaggccgggcgcggtggctcacgtctgtaatcccaacactttgggagactgaggtgggtggattgcctgaggtcaggagtttgagaccaccctggtcaacatggtgaaacctcgtctctacaaaaattagccgggtgtgctggcaagtgcctataatcccagctactcgggaggctgaggcaggagaatggcttgaacccgagaggtggaggttgcagtgagtcgagatcattccacttcactccagcctgagcaagagcgaaactccacctcaaaacaacaacaacaaatatataaatatatatatatataacttatataaagaggagatttttgttattgttcctgagtaaatttgttttgaacacattaggagaaatgcacaaaagagaaatacagcatttcatcttttggactgttcaagtattttatttccttctacagaacaatgaattattaagcaactatatactgtaaagcattctcatcaagagatttcttaaaaagtatttgccataaacgacaatgctactttacaggtaattctcaattatctgctgtaatatttttatctgaggtagggataaaaacatcccatttctggactttacttggagaaccagctagaggtgaatatacgacccttcatgacctggactgaaaacattttcaagttctctatttcggtcaatacagcccctttaataattccccaaagcatctcccctttccacctgtgctacgactctcttgcacacgttttgtattcccacagatcacaaaatcacaaagcaccggagctggaagaatcttaagagataatccaaggccaggagcggtggctcacgcctgtaatcccaccactttgggaggccaaggcgggtgggattacctgaggtcaggagttcaagaccagcctggccaacatggtgaaaacccgtctctactaaaaatacaaaaattagccaagcctcggccggacacagtggctcacgcctgtcatctcagcactttcggaggccgaggtgggcagatcacgaggtcaggagatcgagaccatcctggccaacatggtgaaaccccgtctctactaaaaatgcaaaaaattagccgggcatggtggtgggcgcctgtagtcccagctactcgggaggctgaggcaggagaatggcgtgaacccgggaggtagagcttgcagtgagccgagatcgcgccactgcactccagcctgggtgacagagctagactctgtctcaaaaaaaaaacaaaaaaaaaattagccaggcatggtggctggtgcctgtaatccctgctactagagaggtggagccaggagaatcgcttgaatacaggagacaaaggttgcagtgaggtgagatcgcgccactgcactccagcctgggtgacagtgcgagactccgtcttaaccaaaagcaaaacaaaacaaaaaaacaacagagaaagataatccagtgttagtgctttctgaagcatgtgctattggtaatatgcaagatgatttcaggtggtatgtgttggtacttatattttatagtcatatatttagtttcatatatattagagaagtatacctaccacatcaaattcatgagttcacgtatatttccgcttagaacaaggctaagtggtgttgtgtacctatagtcccagctactcgggaggctgaagtgggaggagagcttgagcccaggagtttgaggttgcagtgagccatgatcatgccactgcactccagccagcctgggagatagagtaagactttcaaagaaaaaaaagaacaaggacaaagctaaagtagacagtccttgcttaagaaaagaggccgggtgcactggtttacacctgtaatcctagcactttgggaggccaagacaggcagatcacttgaggtcagaggttcaagaccagcctggccagtgtggcgaaacccccgttttactaaaaatacaaaaattagccgggtgtggtagcgcatgtctgcagtcccagctactcgggaggctgaggcagaaaaatcacttgaacccaggaggcagaggttgcagtgagccaagaatacgccattgcactccaatctgggcgactgagaaagattccacctcaaaaaaaaaaaaaaaaaaaaaaacaaaaaaaaacagtgacagaaatttcaagctaagaatagcagagctgtgttccacccaaatctaaatcctaattttgtcttattacactgccctaaaataatttactatctgtatgacatcaagtgattaacactcttatataatcgcttctcgatcacaacaatctcacttatcaaaccaactgtaagcaatggtggtgtcttaaagtactagtgtccttccacaatgataggtgtataatagaagatcaataatgacttgattatgtggttagattgcttccaaccagacagacagcataggaggaaattccatattggctcaaacaaaacaatcataatatatcctaaagccaaacaatgtttggattaattgctgtttgaattattcattgtcactgattccctccatgaatgaatatggaatcaggaactggtacatatataatcctagaaactttacaatatatacatacccagagaatatatacaggaaacgactcatataagttagacagcagagatcttagaaaccgtactgtaggggcagggtgtggtggctccgcctgtaacctcagcatccgggaggcagaggagggtgggtcggttgagctcaggagttagagaccaacctgggcaacccggcaagaccttgtctctcttaaaattaaaaaaaaaaaaaagtataccccaactactcatttaacacatcaggaagcagagagagaaaatgcttacagtcatttgttagttaatggcactgacagctctagtctcagttcactttttgtgatgttccatggattcaatataaatatcaaggaaatacaactaaatgcttccagtgttctagtacaaatcctgcttaaggtgagttgggatttgaaactcttttcataaagcagaaattcggtttatgatgcactcagactaattaaattagcgttgggtgataacgcatttgcctgagaaatctacaaatacttcaatgcactgttacaactcagttgttcttgtgtcccatttagcatacatttataaacctatggcattctcaacagtcacagactaatgtccttagctacaaccacccatggtacattagaaagagtatggtcttttaagtcaaaaaggacttcctgaacaccagctctaccacttaggatataacatcagacaacttactttagctctttgagcctatttctctgctaaaagaataacactagcactagcactagcacctcattatcattatcattgataatgatagtcattatcaacagtgagacaatagagatggtgtagtccactatctcaagtatacagttaagtgaaaggttaaaagcagagtataaaaatatttacctatgagtctaaaagggggtttatggtttgcaacactgaaatgttaattcctgttcaatacctaaattagtttatttaaatatttacaaagcattcactctgtgcaaagcttagagcatggctacaaatttataatctgagactgatatatcaagaaaaggtggcaagaaagaatttttttatgtttttctttttagtgtcagaattacttgcaaaagaaagattatacatttaaatacaaaaacaaacaaaaaaaaccttctagtttttaaaaagtatttatcacagacatgcttgaagtatttgaaatgacagtatctgggatttgcttttaaatatgccagcctcccaaccctgtgccctaaaaataaaagggcggggctgggcgcggtgactcacgcctgtaatcccagcactttgggaggccgaggcgggcagatcacgaggtcaggagttcgagactagcctggccaatatagtgaaaccctgtctctactaaaaaatacaaaaattagccgggtgtggtggcggatgcctgtagtcccagctacttgggaggctgaagcaggaaaatcgcttgaactcgggaggctgaggttgcagtgagccaagatcgtgcccctgcactccagcctgggtgacagagtgagactctgtctctcaaaaaaaaaaaagggtgggaacagttgaagctgggtgatgtatacccagggactcattaccctattctctctacttctgtgtaagaaaatctatggggcacgcacaatggctcatgcctgtaatccagcagtttgggaggccgacgcaggcagatcacctaaggtgaggagttcaagaccagcctggccaaggtgatgaagaggctgagacaggagaatcacttgaacccagaaggcagaggttgcagtgagccaagattgtgccactgcactccagcctgagcaacagggcaagacttcgtctcaaacaacaacaacaacaacaacagcagcagcagcagcagcagccaggcgcaatagctcatgactgtaatcccagcactttgggagaccaaggtgggcagatcatgaggtcaggagatcaagactatcctggccaacatggtgaaactctgtctctactaaaaatacaaaaattagctgggcgaggtggtgcgtgcctgtaatcccagctacttgggacgctgaggcagaagaactgcttgaaccagggagtcagaggttgcagtgagccgagatcacaccactgcactccagcctggcaacagaataagactccgtctcaaaaaaaaaaaaaaaagaaaatctaatctatgaacatcacaaactttttattagagacggtgtctcactatgttgccaggctggtactgaactcctagctcaagcaatcctcctgcctcagcctcccaaagggctaggatttcaagtgtgagccactgcgcccggctgaacaccacaaacttctaaggaaccaaggtctccatctgaaacttcgaaatacaagacactagtggaaaaaaaaaaagtgctactggccatttcaaccaagaataagtaaagtattttaaaatgactgacaacatcaagcatgccttccttatcacatactaagcaacagtatcttctctttctttggtattattactccacctactagaacagcccagggaatattttttcttttctgccttacactttctaattttttgtttttatttaaataacttgaactactaataattatacacacacaactaggactactaacacaccattactggctattacatctattatttcatagtggacccatgatatacttggcctttttaaaagcatgactcatccgagagcgttaaaaaaaaaaaaaaagaatcccaaggccaggcacagtggctcacaactctaatcccagcactttggaaagcccagctgggaagatcacttgaacccggaatgtggaggcttcagtgaactctcaaacccagaagactgaggctgcagtgagctatgactgcaccactgcactccagcctggatgacagagcgagaccctgtctccataataaaaaattttttttcagaaagaaaagttccataaggttccaaaaagcaaaagttaagtttgacatatgccaagtactacagtgaatccacatgaatgaactgatatgtaggcactgtactaggtatcacaagtattttagagaagacaagaattcggaagggtgtgcacagatgatatggaaatacgacaccattttatacggtataaggtacttgagcgtccttggatttcaatatctgcaggaggcctggaaccatcctccagtgataccaaggaacaactgtactcatatgctctgccttttcataattccaataatgggtacggataggaaaatgttccctgcatttgcatgcaaagggacagaaaagtacatatatctatttcactatcaaatagttctacttactgaacagcaaatacaaaacatattctatacatgtttcttcaaatgtgcctaactagtttacttctttaagttatgctctttcaaacacatagatcagatttaattaactcccagactaagcagaatgaaatttcctttcgctgtctttaaagaaaaagaaaatagggtgggggtggtggctcacaccactaatctcagcactttgggagcccgaggctggcagatcacaaggtcaggagatcgagaccatcctggccaacatggtgaaaccctgtctctactaaaaatacaaaaattagctgggcgtggtggcgctcgcctgtagtcccaggtactcaggtggctgaggcagaattgcttaaagccgggaggtggaggttgcagtgagccaagttcaagccactgcactccagcctggcgacagagtgagactccatctcaaaaaaaagaaaagaagtttaaaaataactccacctcctgaagaatacacataggtgttcacagtactcttccttcattatttctgtatgtaaaaactggaggaaaaaacattaaattggaaatttggtccctccacctccccccaaccccccaaaacccccatttccaatttatatgacgcctttcctcctctggagcataaaactgcctcctttaagtggaggtttccaaatgtccggaatacacatgaaggatatatacactccttgaataggccactttttgccactttccctaataatgtgctgtttctaccacaaactactactaattgtttggtcaccagtattaggatcctagtttgatgaaacgacatctattatgtgtcctcaaagagcgaaaagaaaattccaaaaagttcgacagagttaggaatattagctgtatctaccagaggactatccctctagtcgttaagctgaagatgagaagtcaggtaaggcctcacatttctaggggctctggaaacttcctttctttctgtctcctgcttatgtatgtcttttcctctatctgaattgcttttgtatagaatactagaacacgagatgaaggggggaaatgccaagagaagcaaatttctacaagcaagtggtcttgctatagcttgaacgccttaaacaaatctgatatttaaaaaaaaaaccaaaaacagtatcaagtggtagcttcattctatttgtccacctttagggctaattttatatacctacacctctggaaaaagttactactgtcagatttgctcccaaactttgagaattgtcattatggtctgcagcattaaacctagattataaattatcaatgtcacttgattataaattatcaatgtcactcaactgaatcacaccaagcaacgacaaatgtagatttcattaagagatactgttaaaatcacattcagacctcagaaaggcaagatcccataacccagtcacaaacacagcttcaaacgcttccccaacttttcaagctttggggcgccaagtcactgggagttaacagcttaaacatggggttcaatacaactgaccaaaggaagtgaagaaaacaaagcatacattaatttcagcaccaaaaatatggatttgcgaattacatctactgctaataaacagatcattctttacagcctaagtacgccaggcatttttttatgtttaaatggcttgccacaaattgtcctagtcgaaactgatggcaaaatcctaaactgatcttcggcgaggagacactctgcatagagcatcacacaaaagacaggagcgaacagacacgctctgggcctcggcggattgcggccaggagcccaggttttcgtcccagaccccggcaacagggagggaaataagggcgggggaaagaaggagtgggagtggtatccttttccctgaaagcgcctgggagtgaggagcaaagagggaaggagcgagtgcagcacagaggaagcaaggaaagcagccgaccggcgtcagcggcttccaaggccggcaacaccctcgggcccgcaccaggcctggccctcccggcttcgtcccacctcctcacctccctcacatcctgcaggcactcgagcaccgccaggttgttgctccaggtgtgcttagggcacacgcgggtcacgtcctccctgcaggactcttcctccgccagcttccagcccccaccagcccccgctcctccccgccgggccggaggcccacccgccgggaaaggcggctgcggcggctgaggctgctgttgctgttgctgctgctgctgttgctgctgaagctgcgatgactgaggcagctggggcagctgctgacccgccgggccgccgcctccggcctgccctacgaaggacacaaagttggccccgggaccctggccctggctgtggacgccctggccggggagtttctcggccccggccgcgaatagcagcagcagatgcagcgccgccgacaagcggaacatcctccgtacacgtccacacgccgccatcttgagtccgcggcgagctcgacgcactcgccggcgccgcgtatttaaat

SEQ ID NO: 1554 - DNA, 159717 bp, Homo sapiens; identical to SEQ ID NO: 1553

SEQ ID NO: 1555 - DNA, 159717 bp, Homo sapiens; identical to SEQ ID NO: 1553

SEQ ID NO: 1556 - DNA, 159717 bp, Homo sapiens; identical to SEQ ID NO: 1553

SEQ ID NO: 1557 - DNA, 159717 bp, Homo sapiens; identical to SEQ ID NO: 1553
